United States Patent 8,344,211 (PLANT NUCLEOTIDE SEQUENCES AND CORRESPONDING POLYPEPTIDES) - sequence listing, part 2

SEQ ID NO: 6126 - DNA, 488 bp, Zea mays
  misc_feature: Ceres CLONE 329233-F
  misc_feature: Encodes the peptide sequence at SEQ ID NO. 6127
ggaaatttcatgcgttccttatcttccgttccgctcggaagtctctctaccaccttctccccgtgccgctttcaagatgttggaataccaaaacgcaattggggggagactgaagctgaagggtaaagcgctggacgtaaaggatggtggggtgaagaaaaagaagaagaagtaccagcgtgaggagtcgtctcagattgcgcacgatgagctccacaaaggggggagatctgaatcaccaattgatcccaacaatgagcggattgaatctgacaagaccggagatgaagggaacccacatcctgactatggccatctcacaccagcagagcgacgctacatggaacagaagcagaagatcgacatgcagaagatggccaaagtcgccaacaagtcccatagagaccgcatccaagacttcaatcagtacctggcaaacctaagcgagcactacgacatccccaaagttggtcctggctaacatagcc

SEQ ID NO: 6127 - protein, 134 aa, Zea mays
  misc_feature: Ceres CLONE 329233-F
  misc_feature (3)..(134): Pfam Name: DUF1754 Pfam Description: Eukaryotic family of unknown function (DUF1754)
MLEYQNAIGGRLKLKGKALDVKDGGVKKKKKKYQREESSQIAHDELHKGGRSESPIDPNNERIESDKTGDEGNPHPDYGHLTPAERRYMEQKQKIDMQKMAKVANKSHRDRIQDFNQYLANLSEHYDIPKVGPG

SEQ ID NO: 6128 - DNA, 107 bp, Zea mays
  misc_feature: Ceres CLONE 329253-F
  misc_feature (51)..(51): n is a, c, t, g, unknown, or other
acagattattataaaakatttcagtcctccatggacgacacgacgaaggtnccgacacaaaggtacagctggagagccctgtcgcacccgcacccgcacccgcacgc

SEQ ID NO: 6129 - DNA, 437 bp, Zea mays
  misc_feature: Ceres CLONE 329278-F
  misc_feature: Encodes the peptide sequence at SEQ ID NO. 6130
  misc_feature (81)..(81): n is a, c, t, g, unknown, or other
tktkggttgcccacagcttccgcgatccacagaaaatacatcgccatttccccaatttaccgctgacaccctccacaaacngcgaattktcctccccggmtcctctccctcctccccagtcaatccccacacagtctcggccgggccctcgcgakgycgccgtggaaggacccccagcgatgggctccggcgaggaggacacakgaggcggaggaggggcggtgcggggcgcggtgctgaaggcgctcgtggttgttcggcggcgtcctgctgctccgccgcctgcgccgctccactacccgatgggaccacgcgcgaccgtcgccgacgcgctctccggagaaaagttctcgagggagcaggcgaggaaggatcctgacaacttcttcaatttgagaatgctcacatgtcctgcaaccgagatggtggatggttca

SEQ ID NO: 6130 - protein, 86 aa, Zea mays
  misc_feature: Ceres CLONE 329278-F
  misc_feature (9)..(9): Xaa is any aa, unknown, or other
MGSGEEDTXGGGGAVRGAVLKALVVVRRRPAAPPPAPLHYPMGPRATVADALSGEKFSREQARKDPDNFFNLRMLTCPATEMVDGS

SEQ ID NO: 6131 - DNA, 541 bp, Zea mays
  misc_feature: Ceres CLONE 329306-F
  misc_feature: Encodes the peptide sequence at SEQ ID NO. 6132
aagtcaaattttacgtaacttgcgtggttctcttcctgcgacggaagcaaacactgcccgagacatagacagcgggacgtcgagatggccgacggggaggacgccgccgccgcgcgccgccgggccgccatcacagactaccgcaagaagctgctcaactgcagggagctagagtcgcgcgtcggcaccgtgagagaaagccttaaaactgcaaagaaggattttaccaagactgaggacgacttaaagtctctgcagagtgtggggcaaataattggagaagtactccgacctcttgataatgaacgctttatcgtgaaggccagcagtggtccccgatacgtggtcggttgccgaagtaaagtggacaaggagaagttgacatctggtactcgtgttgtacttgacatgacgaccttgacaataatgcgcactcttccacgggaggtggatcctgtggtatataacatgcttcatgaagaatccaggaaatgtcagttactctgctgtaggtggtctgtctgatcagattagagagctc

SEQ ID NO: 6132 - protein, 146 aa, Zea mays
  misc_feature: Ceres CLONE 329306-F
MADGEDAAAARRRAAITDYRKKLLNCRELESRVGTVRESLKTAKKDFTKTEDDLKSLQSVGQIIGEVLRPLDNERFIVKASSGPRYVVGCRSKVDKEKLTSGTRVVLDMTTLTIMRTLPREVDPVVYNMLHEESRKCQLLCCRWSV

SEQ ID NO: 6133 - DNA, 438 bp, Zea mays
  misc_feature: Ceres CLONE 329342-F
  misc_feature: Encodes the peptide sequence at SEQ ID NO. 6134
agttcctcagacgcaaagaagatcgagtctgcagcccacaccatagtgcgagcagattgcgtccaataggcgcaaagggagatgggggtggccgctggacgagcggcggccatggtggctgcggcggcggcggcgctgccgtacaagaggacgcctcctacctggctcaagaccgctgcctccgacgtggaggagatgatcacaaaggcagcgaagaagggacagatgccgtcgcagatcggcgtcctgctccgtgaccagcacggtatcccccttgtcaagagcgtcaccggcagcaagatcctccgcatcctcaaggcccatgggctggcaccagaaatccccgaggacctgtacttcctcatcaagaaggcggtggcgataaggaagcaccttgagaggaacwggaaggacaaagactctaaattcaggctcatt

SEQ ID NO: 6134 - protein, 119 aa, Zea mays
  misc_feature: Ceres CLONE 329342-F
  misc_feature (11)..(63): Pfam Name: Ribosomal_S13_N Pfam Description: Ribosomal S13/S15 N-terminal domain
  misc_feature (109)..(109): Xaa is any aa, unknown, or other
MGVAAGRAAAMVAAAAAALPYKRTPPTWLKTAASDVEEMITKAAKKGQMPSQIGVLLRDQHGIPLVKSVTGSKILRILKAHGLAPEIPEDLYFLIKKAVAIRKHLERNXKDKDSKFRLI

SEQ ID NO: 6135 - DNA, 394 bp, Zea mays
  misc_feature: Ceres CLONE 329385-F
  misc_feature: Encodes the peptide sequence at SEQ ID NO. 6136
  misc_feature (367)..(367): n is a, c, t, g, unknown, or other
atttgcgacaattcatctgcatacaggggcaacatatctagcagctactccgcccccaaatgctcgccggcatatcccgtttcctcactcgccgccgcccgccctttccgcttgccgctaccgcgctgcagcagccatgtcgtcgtcgtcgtccacggcagcgaacatctccgagcgtccgatctctccggacaccacccgcgtggcctgggtggggacgggcgtcatgggccagtcaatggccggccacctcctcgccgccggctacgctctcaccgtcttcaaycggacggcatccaagacccagggccttgtctcccgcggcgccagcctcgcggacagcccgcgcgcggccgcygcggctgcngatgtcatcttcctcatggtcggtttc

SEQ ID NO: 6136 - protein, 86 aa, Zea mays
  misc_feature: Ceres CLONE 329385-F
  misc_feature (20)..(86): Pfam Name: NAD_binding_2 Pfam Description: NAD binding domain of 6-phosphogluconate dehydrogenase
  misc_feature: SWISSPROT Homolog: EC 1.1.1.60 2-hydroxy-3-oxopropionate reductase
MSSSSSTAANISERPISPDTTRVAWVGTGVMGQSMAGHLLAAGYALTVFNRTASKTQGLVSRGASLADSPRAAAAAADVIFLMVGF

SEQ ID NO: 6137 - DNA, 679 bp, Zea mays
  misc_feature: Ceres CLONE 329493-R
cgattgggtacccggccccccctcgaggtcgacggtatcgatattttttttttttttttttcgggcgggagcgagggagtatatatcatgtttatatatatagtttagatggagagaccatacgtgcctttgcgagtggtaagcaatacaatcacgaggggaaacaaagaacaaaaaaaggaagaagctgtaagctttgcttctcttcacgagttcacatgatccatacagctagatcctggcgagcgtgcgcagatccatggggtggacgtcggacggcagcgccgcgctgtacgccctccgaccgacgaggatgttggccgcctcggtggggtggaaggcgtcccagaaaaggtactctttcctgtccccccacgggggggggggggggaagcacttcaccctgcccgttattccttccgacgccgcaacacccctgggtcgtcaccggcagaccgggggaccctggggttctgaggatgtcctggaagatccccatacccctttatgtaggtgaaagggggccccccccaacccctttaaacttggtcaacaagggcgcaccaacttccgggttgaagatccccaatggcgccctttcaactttggcaccccgacggctgtggccctccgccgctcctccctcgcccaccccccttagcgggcccctccctccccg

SEQ ID NO: 6138 - DNA, 511 bp, Zea mays
  misc_feature: Ceres CLONE 329502-F
  misc_feature: Encodes the peptide sequence at SEQ ID NO. 6139
aattaatgtgaccaaactttagttcagaagaattttggttggaggcgacgacgatttgtttcttgctctcgtggtttcggacttctggtctggaggtcccccagcagcccaggctccacctctccacggcagcaccaacgctccattctgtcagccacagcccacgccgctgaacggccggagatcgccccccactccctctcgccggacggttgcagatcaggtctaccagatccgtctcagattaggtggcaggmsaggaggaattcgggtctgaatctgatcgatatgcggcagcagcggggcggggccggggccgggaggagggcggacgacccggggctcctcaagagggccttcgacagggtgttccgcttcgtccgcctcgccgagttcgagatcttcttcgtcctcttcttcctcatcgccttcttcctcttcaaggacctcatggcacggcctcaatacaatcagctgtttgtcaagaagcctgaactagatgattcctggc

SEQ ID NO: 6139 - protein, 74 aa, Zea mays
  misc_feature: Ceres CLONE 329502-F
MRQQRGGAGAGRRADDPGLLKRAFDRVFRFVRLAEFEIFFVLFFLIAFFLFKDLMARPQYNQLFVKKPELDDSW

SEQ ID NO: 6140 - DNA, 431 bp, Zea mays
  misc_feature: Ceres CLONE 329527-F
  misc_feature: Encodes the peptide sequence at SEQ ID NO. 6141
gcgtccaaactcccaaacacaccatttttttttcatctctatctcatcgtcatcattagaaaggccgaagccttctccgttcctcctcgacgcgtctcttccacagccgcaacctctatccctcgtctggtatcgtctctcccacacccctctgccccaacccagaaaaaccctcgaaaagcggcggcggcgcgacatggcggaggtcgaggctccagctgctgcggttgcggcggcgacccctgaggtggcgacggtgaccgagggcggagccgctacggaggcgaagggtccgcataagctgcaccgccagtggaccttctggtacgacatccagtccaagcccaagcccggcgctgcgtggggcacctccctcaaaaaggcgtacaccttcgacaccgtcgaggagttttggggcttgtatgatcatg

SEQ ID NO: 6141 - protein, 78 aa, Zea mays
  misc_feature: Ceres CLONE 329527-F
  misc_feature (6)..(78): Pfam Name: IF4E Pfam Description: Eukaryotic initiation factor 4E
MAEVEAPAAAVAAATPEVATVTEGGAATEAKGPHKLHRQWTFWYDIQSKPKPGAAWGTSLKKAYTFDTVEEFWGLYDH

SEQ ID NO: 6142 - DNA, 462 bp, Zea mays
  misc_feature: Ceres CLONE 329547-F
  misc_feature: Encodes the peptide sequence at SEQ ID NO. 6143
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggaggcgtcyctgtcgtgcgtccgctcgtggggcggc

SEQ ID NO: 6143 - protein, 126 aa, Zea mays
  misc_feature: Ceres CLONE 329547-F
  misc_feature (10)..(125): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MVSSSMDTTSDKRASSMLAPNPGKATILALGHAFPQQLVMQDYVVDGFMKNTNCDDPELKEKLTRLCKTTTVRTRYVVMSDEILKNYPELAQEGLPTMNQRLDISNAAVTQMATEASLSCVRSWGG

SEQ ID NO: 6144 - DNA, 449 bp, Zea mays
  misc_feature: Ceres CLONE 329580-F
  misc_feature: Encodes the peptide sequence at SEQ ID NO. 6145
aataaaacgacttggctacgcttcacgcacacggcgtctttgggtgagcacaccgcgcagcaacgagaggggcaaacaagcttgctactgtgatttctcgtccgagcagcggcggaggagagagagagagcatggccgaccacaaggaggagcctgtgccggagtctgtgatggacaagatcaccgagaagttccacggcggggactcgtcgtcgtcgtcgtctgactcggacgacgagaagaaggggtcctcgttggcgtcggcggcggaagccatgaaggccaagatctaccgccttttcggccgggagaggcccgtccactccgtcctcggcggcggcaagcctgccgatcttatcctatggaggaacaggaagatctctggcggggtacttgctggtgccacggcatctggctcctattcgaggtcatggagtaccatctcctca

SEQ ID NO: 6145 - protein, 106 aa, Zea mays
  misc_feature: Ceres CLONE 329580-F
MADHKEEPVPESVMDKITEKFHGGDSSSSSSDSDDEKKGSSLASAAEAMKAKIYRLFGRERPVHSVLGGGKPADLILWRNRKISGGVLAGATASGSYSRSWSTISS

SEQ ID NO: 6146 - DNA, 456 bp, Zea mays
  misc_feature: Ceres CLONE 329592-F
  misc_feature: Encodes the peptide sequence at SEQ ID NO. 6147
acaaatgataatggcaaaattgacaatgctcatcgtcgaaggcccgaccgcaacaaatcacaccgaatcaccctctcgcccaccaggccaccaccacaccacaccacaccacaccaccggcggcggcggcgacccagtcgagaacacgaaggcgatggcgacagcgctgaaccgcgggctccgcctcctcgccgccggcgccgaggcgtccaagccagcttctcgtggattccatgccaccggcgtgaagagaatgggagggcatggccatgatgagccatactacatccatgccaagcacatgtataacttgcacaggatgaagcatcagggtttgaaggtgacactctccgtgctgggagcggttggcatcggtgttggagtccctgtgtatgcagtcatattccagcagaagaagactgcctctggctgagatgatgcctctcgctgcctgca

SEQ ID NO: 6147 - protein, 92 aa, Zea mays
  misc_feature: Ceres CLONE 329592-F
MATALNRGLRLLAAGAEASKPASRGFHATGVKRMGGHGHDEPYYIHAKHMYNLHRMKHQGLKVTLSVLGAVGIGVGVPVYAVIFQQKKTASG

SEQ ID NO: 6148 - DNA, 530 bp, Zea mays
  misc_feature: Ceres CLONE 329617-F
  misc_feature: Encodes the peptide sequence at SEQ ID NO. 6149
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggaggcgtccctgtcgtgcgtccgctcgtggggcggcgcgctctccgtccatcacccacctcgtgtacgtctcgtcgagcgaggcgcgctttcccgggcggcgac

SEQ ID NO: 6149 - protein, 148 aa, Zea mays
  misc_feature: Ceres CLONE 329617-F
  misc_feature (10)..(148): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MVSSSMDTTSDKRASSMLAPNPGKATILALGHAFPQQLVMQDYVVDGFMKNTNCDDPELKEKLTRLCKTTTVRTRYVVMSDEILKNYPELAQEGLPTMNQRLDISNAAVTQMATEASLSCVRSWGGALSVHHPPRVRLVERGALSRAA

SEQ ID NO: 6150 - DNA, 410 bp, Zea mays
  misc_feature: Ceres CLONE 329675-F
  misc_feature: Encodes the peptide sequence at SEQ ID NO. 6151
ccaacccaacccaacgacgcagctagcgcatctccgatctgcactgcaccttcgtctccgaagaacgtcgatcgtactcgtacaccatgaaggcagtcgtcgcggcgacgatgcttctgctggtgctggtggccgcggcgacggtggcgagcgcagaccaccgtgatgacgacggccaccaccaccagcgccaccgcggccagagctggcaccgccacagcggcggcggccgagatggccgccgatcgacccctctggcggggctgacgcagtgcgtgacaagctgcgggtctggggtcacctcctgcatgctggactgctaccagccgctggtcgacctgttcttcagtcgtttttctttctttctgttttgttccttatgcctccgttgttgtgttaggctgtgtttt

SEQ ID NO: 6151 - protein, 108 aa, Zea mays
  misc_feature: Ceres CLONE 329675-F
MKAVVAATMLLLVLVAAATVASADHRDDDGHHHQRHRGQSWHRHSGGGRDGRRSTPLAGLTQCVTSCGSGVTSCMLDCYQPLVDLFFSRFSFFLFCSLCLRCCVRLCF

SEQ ID NO: 6152 - DNA, 529 bp, Zea mays
  misc_feature: Ceres CLONE 329696-F
  misc_feature: Encodes the peptide sequence at SEQ ID NO. 6153
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggaggcgtccctgtcgtgcgtccgctcgtggggcggcgcgctctcgtccatcacccacctcgtgtacgtctcgtcgagcgaggcgcgcttcccgggcggcgact

SEQ ID NO: 6153 - protein, 148 aa, Zea mays
  misc_feature: Ceres CLONE 329696-F
  misc_feature (10)..(148): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MVSSSMDTTSDKRASSMLAPNPGKATILALGHAFPQQLVMQDYVVDGFMKNTNCDDPELKEKLTRLCKTTTVRTRYVVMSDEILKNYPELAQEGLPTMNQRLDISNAAVTQMATEASLSCVRSWGGALSSITHLVYVSSSEARFPGGD

SEQ ID NO: 6154 - DNA, 535 bp, Zea mays
  misc_feature: Ceres CLONE 329748-F
  misc_feature: Encodes the peptide sequence at SEQ ID NO. 6155
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggaggcgtccctgtcgtgcgtccgctcgtggggcggcgcgctctctgtccatcacccacctcgtgtacgtctcgtcgagcgaggcgcgcttcccgggcggcgactgcact

SEQ ID NO: 6155 - protein, 150 aa, Zea mays
  misc_feature: Ceres CLONE 329748-F
  misc_feature (10)..(145): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MVSSSMDTTSDKRASSMLAPNPGKATILALGHAFPQQLVMQDYVVDGFMKNTNCDDPELKEKLTRLCKTTTVRTRYVVMSDEILKNYPELAQEGLPTMNQRLDISNAAVTQMATEASLSCVRSWGGALSVHHPPRVRLVERGALPGRRLH

SEQ ID NO: 6156 - DNA, 406 bp, Zea mays
  misc_feature: Ceres CLONE 329779-F
  misc_feature: Encodes the peptide sequence at SEQ ID NO. 6157
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcgg

SEQ ID NO: 6157 - protein, 107 aa, Zea mays; identical to SEQ ID NO: 3294
  misc_feature: Ceres CLONE 329779-F
  misc_feature (10)..(107): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase

SEQ ID NO: 6158 - DNA, 496 bp, Zea mays
  misc_feature: Ceres CLONE 329792-F
  misc_feature: Encodes the peptide sequence at SEQ ID NO. 6159
atctcacgccgcaacctccctcgagcccgagcaaacaagggcggacgcggagccggcggcggagcggagatggcggagaagaagcgaggagccggcactcgcaaggatgaagtggtgacacgcgagtacaccatcaacctccacaaacgcctccacggatgcaccttcaagaagaaggcaccaaatgccatcaaggagatcaggaagttcgctcagaaggccatgggtactactgatgtccggattgacgtgaagctcaacaagcacatctggagcagtggtatccgcagtgtgccgaggcgtgtccgtgtcagaattgcccgcaaccggaacgatgaggaagacgccaaggaggaactctactccctggtcacagtagctgagatcccaccggagggtctcaaaggtttgggaactaaggtcgttgaggatgaggattaagcctgtataccmtgagayaaatttgagaatgttgcttcagcttatggttatctac

SEQ ID NO: 6159 - protein, 123 aa, Zea mays
  misc_feature: Ceres CLONE 329792-F
  misc_feature (11)..(105): Pfam Name: Ribosomal_L31e Pfam Description: Ribosomal protein L31e
MAEKKRGAGTRKDEVVTREYTINLHKRLHGCTFKKKAPNAIKEIRKFAQKAMGTTDVRIDVKLNKHIWSSGIRSVPRRVRVRIARNRNDEEDAKEELYSLVTVAEIPPEGLKGLGTKVVEDED

SEQ ID NO: 6160 - DNA, 496 bp, Zea mays
  misc_feature: Ceres CLONE 329818-F
  misc_feature: Encodes the peptide sequence at SEQ ID NO. 6161
ggttcaggcagtttctacttcttcagagttcggggaggcgaggcgtggagggattgggaattttttgggaggggaggacgcgtgagcgggaggaaagtgaagagagagtagcttccgatctcgattaccccggtctccgtatcgggaatccaattcggttccatccaacgcctgagatcggattccaacccccatttcggaccgatcgctttccgcagaccgatcggctttggggaaatttttttccgagcgatttttctggaggctcagatcgggtcggtctgagtttagttgatcgcggagcgatgctaatcgaggagcttccgggcgatccgggtggaggacgaggtgagggcggggaggatgagctgctgctgccgcgtcgcgaggatggcgacsccgcggagggcgagagtggagtggtgatgcgggtggccgtcgacgcgaagcgcgcagcggtgggtgtaggcsctcggatgcttttctacccgacgct

SEQ ID NO: 6161 - protein, 63 aa, Zea mays
  misc_feature: Ceres CLONE 329818-F
  misc_feature (32)..(32): Xaa is any aa, unknown, or other
  misc_feature (56)..(56): Xaa is any aa, unknown, or other
MLIEELPGDPGGGRGEGGEDELLLPRREDGDXAEGESGVVMRVAVDAKRAAVGVGXRMLFYPT

SEQ ID NO: 6162 - DNA, 406 bp, Zea mays
  misc_feature: Ceres CLONE 329910-F
  misc_feature: Encodes the peptide sequence at SEQ ID NO. 6163
acacaaccaagctcgatccatctcactctccgctggtcgctcactcttgcagctccacccttcactcagtcttagtctcttattagctctaggctctagcttgccgcgccactccttcgtgtagccatcagccttctcatcgccaccaatggccactgccgaggtccagaccccgaccgtcgtggcggccgaggaagcgcccgtggtggagaccccgccgccggccgtcgtgcccgaggagtctgcccccgccgaggccgaggccgaggccgaggctgctgctcctgctgatcccgaggagcttcccgcggccgagcagcaggcagccgccgaggcggaggccgcggctcctgctggtgccgaggagcccgtcgcggccgaaccggccgccgaggcggaggctgct

SEQ ID NO: 6163 - protein, 86 aa, Zea mays
  misc_feature: Ceres CLONE 329910-F
MATAEVQTPTVVAAEEAPVVETPPPAVVPEESAPAEAEAEAEAAAPADPEELPAAEQQAAAEAEAAAPAGAEEPVAAEPAAEAEAA

SEQ ID NO: 6164 - DNA, 495 bp, Zea mays
  misc_feature: Ceres CLONE 329997-F
  misc_feature: Encodes the peptide sequence at SEQ ID NO. 6165
  misc_feature (57)..(57): n is a, c, t, g, unknown, or other
aagtttagttggtgctggtgctggtggaggaagaagcagcgcagcaggtggcagggnatgggtcgcggcggcgggatggggaacccagtcaacgtgggcatcgcggtgcaggcggactgggagaaccgcgagttcatctccaacatctccctcaacgtccgacgcctcttcgacttcctcctcagattcgaagctacgacgaagagcaaagagtgcaagaagcacacactccacaaggtgactcagtataagaagggcaaggatagcctgtctgcccagggaaagcgccgttatgaccgcaagcagtcaggatatggtggtcagaccaagccygtcttccacaagaaggccaagaccaccaagaagattgttctgaagctgcagtgccagagctgcaagcactactcacagcacgccatcaagagatgcaagcattttgagattggtggagacaagaagggcaagggcacatctcttttctaagcttctcgtcca

SEQ ID NO: 6165 - protein, 135 aa, Zea mays
  misc_feature: Ceres CLONE 329997-F
  misc_feature (49)..(125): Pfam Name: Ribosomal_L44 Pfam Description: Ribosomal protein L44
MGNPVNVGIAVQADWENREFISNISLNVRRLFDFLLRFEATTKSKECKKHTLHKVTQYKKGKDSLSAQGKRRYDRKQSGYGGQTKPVFHKKAKTTKKIVLKLQCQSCKHYSQHAIKRCKHFEIGGDKKGKGTSLF

SEQ ID NO: 6166 - DNA, 441 bp, Zea mays
  misc_feature: Ceres CLONE 330015-F
  misc_feature: Translation starting site: 199
  misc_feature: SWISSPROT Homolog: EC 3.1.3.16 Phosphoprotein phosphatase
gtgacaagacttccaggcttccagccatcccttctacgctctccccgttcccgtgtcgtcctcccgayaaagagggagccgctagggtttagcggcttccgcgtctgggcragggcttacctcgcgagggacggcgcgacgcggcggcacttgagctagggtttaaccctccgatcccgttcctttcccggcgaggcgatggacgaggcggcgattgacgacttgatccggcggctcctcgaggcccgcggcrggcgcaccccgcgcaacgcgcaggtgactgacgccgagatccggcgcctctgcgcmaccgccaaggacgttttcctctcccagcccaagcctcctggagctcgaggcccccattaagatatgcggggatgtccatggccagtattcagacctccttcgattatttgagtatggtggctatccaccaga

SEQ ID NO: 6167 - DNA, 513 bp, Zea mays
  misc_feature: Ceres CLONE 330021-F
  misc_feature: Encodes the peptide sequence at SEQ ID NO. 6168
ctcacaaacctctcctggcacgagatcacgcttctcgttggatcgaacagctagggtttccaagatgttcgggcgcgcgccgaagaagagcgacaacacacggtactacgagatcctcggggtctccaaggacgcgtcccaggatgacctcaagaaagcctaccgcaaggccgccatcaagaaccaccccgacaagggcggcgatcccgagaagttcaaggagctagctcaggcttatgaggtcctcagtgatcctgaaaagcgggagatttatgatcaatatggtgaggatgccctcaaggagggaatgggaggtggtggagggatcacgatccctttgacatattccagtcattctttggtggtggaagcccttttggaggtggtggcagcagtaggggcagaaggcagcgaaggggagaggatgtggttcatcctctaaaggtttctctggaggatttgtacaatggcacatcaaagaagctctctctgtcccgcagtgtcctctgctcc

SEQ ID NO: 6168 - protein, 125 aa, Zea mays
  misc_feature: Ceres CLONE 330021-F
  misc_feature (13)..(71): Pfam Name: DnaJ Pfam Description: DnaJ domain
MFGRAPKKSDNTRYYEILGVSKDASQDDLKKAYRKAAIKNHPDKGGDPEKFKELAQAYEVLSDPEKREIYDQYGEDALKEGMGGGGGITIPLTYSSHSLVVEALLEVVAAVGAEGSEGERMWFIL

SEQ ID NO: 6169 - DNA, 525 bp, Zea mays
  misc_feature: Ceres CLONE 330090-F
  misc_feature: Encodes the peptide sequence at SEQ ID NO. 6170
gaacaccaatggcattcttgcattgaaggaaccttccctccacctccaccgcccgagagcgagcggccggacggggttttggttgggcatggctgccccggcgatgctccaagtggtgatcctcgccgcggtcctccttctcccgttcctcagcgtgccgggcgccgaggcacagaccaagaagttctgcctcacgcagttcgccatcgctagccaggcctgcgccatcctgccacccaccagtcctgagcaccaccaccatcatcacgatgacgaggacaatgacgaggacaacgacgaagatgaggacgaagacgaggacaacgatgaagatgaagacgaggacaatgacgacgatagcggcggtgataagggtggtgctcctgcagatttccaaccatcttttaggggtagcagacctggcttyggccgcggtggcggcggtgctttcggtgctggtggatcttccatggagtgatgtgtcaacatgagctagcataasattcgtctttgaactatgagaac

SEQ ID NO: 6170 - protein, 129 aa, Zea mays
  misc_feature: Ceres CLONE 330090-F
MAAPAMLQVVILAAVLLLPFLSVPGAEAQTKKFCLTQFAIASQACAILPPTSPEHHHHHHDDEDNDEDNDEDEDEDEDNDEDEDEDNDDDSGGDKGGAPADFQPSFRGSRPGFGRGGGGAFGAGGSSME

SEQ ID NO: 6171 - DNA, 253 bp, Zea mays
  misc_feature: Ceres CLONE 330113-F
  misc_feature: Encodes the peptide sequence at SEQ ID NO. 6172
ctaattacttgcctctcgctcgccaacaccagtgcgagaggtccagagcttcgtcaaagacacgccgaaaagggggaggcgactcggccgaggtccggttccgaactccggtcctccgatttgcgcgtccggatctaccagccatggcatcatcttcggacccgtggatgaaggagtacaatgaagcatccagacttgctgatgacatcagttccatgattgctgatagagggtcccttccacaatcaggccc

SEQ ID NO: 6172 - protein, 36 aa, Zea mays
  misc_feature: Ceres CLONE 330113-F
MASSSDPWMKEYNEASRLADDISSMIADRGSLPQSG

SEQ ID NO: 6173 - DNA, 330 bp, Zea mays
  misc_feature: Ceres CLONE 330124-F
  misc_feature: Encodes the peptide sequence at SEQ ID NO. 6174
cttttttttgcccccctgcttcctccgcctgcaccctctcacgagcgcccgctcgcccagatctagggttccatccgcgggcaagatgagcagcccccatggcggcctcgacgaccagatcgagcggctcatgcagtgcaagccgctcgctgagcccgaggtaaggactctgtgtgagaaggcaaaggagattctgatggaggaaagcaatgttcagcctgtaaagagtcctgttactatatgcggtgatattcatggacaatttcatgatcttgctgaactcttccgaattggtggaaagtgtccagatacgaactacctgtttatggg

SEQ ID NO: 6174 - protein, 81 aa, Zea mays
  misc_feature: Ceres CLONE 330124-F
  misc_feature: SWISSPROT Homolog: EC 3.1.3.16 Phosphoprotein phosphatase
MSSPHGGLDDQIERLMQCKPLAEPEVRTLCEKAKEILMEESNVQPVKSPVTICGDIHGQFHDLAELFRIGGKCPDTNYLFM

SEQ ID NO: 6175 - DNA, 531 bp, Zea mays
  misc_feature: Ceres CLONE 330151-F
  misc_feature: Encodes the peptide sequence at SEQ ID NO. 6176
gttttctcttcgccttttcctcccctactttttcctgctactgttcacgctctacagtacggaggctcctacgtgcaggtagctcccaggaccagatccgaaccctaaccctagccaatttggtcggtgatggaagagcacgtgcctcgaggcggcggcggcgggaggcccccgatcccggcggcggcggcgaggaagccggcgctcgcgcggcactcctcttttgtgaggagtcctgcaaacaatacaaagcctgcaactgagagagcttttgaaggcatggacactgaatttatccctattgtacgatctggtgggtgggctgatattggctccaggcacacaatggaggatgtctttatctgctttgataatttcatgcaagattttggaattgaaagttttgaagaaggactcagtgccttttatgggatttttgatgggcatggtggaaagcatgcagctgattttgtgtgcagtaatttaccaaggtttattgtcgaggatgaggattttcctagggagatagtg

SEQ ID NO: 6176 - protein, 134 aa, Zea mays
  misc_feature: Ceres CLONE 330151-F
  misc_feature: SWISSPROT Homolog: EC 3.1.3.16 Phosphoprotein phosphatase
MEEHVPRGGGGGRPPIPAAAARKPALARHSSFVRSPANNTKPATERAFEGMDTEFIPIVRSGGWADIGSRHTMEDVFICFDNFMQDFGIESFEEGLSAFYGIFDGHGGKHAADFVCSNLPRFIVEDEDFPREIV

SEQ ID NO: 6177 - DNA, 487 bp, Zea mays
  misc_feature: Ceres CLONE 330222-F
  misc_feature: Encodes the peptide sequence at SEQ ID NO. 6178
agacctatcgctacacagtccgccgtggctctctgcaattaatggctgcctccacagcgtcgtcgtcatactctgccggtgtaagcgccgcctgctgtgtgtctccgcgccatggcagcagcttcgtcaagccgcagcgctctggacggccggcggcggcggcggcgaccctacctgcgtcaggcggcgaccagccgaacctatcgttagactgctgtcgtaggagtaagagtagggctagaagaggcgagcgaatcagggcttcagatgatgctgcgaccatcatggacgcgggcggctgggcagcacggcttgaagccccgccgccggtagccgtcgtcactggagcgtctagagggattggcagagccatagctgtagcacttggcggagcagggtgcaaggtggttgtgaactatgccaagtcaggcgtggaggccgaagaggtgtgccagagagatcgaggcgtccggtggaacsgcsgtga

SEQ ID NO: 6178 - protein, 146 aa, Zea mays
  misc_feature: Ceres CLONE 330222-F
  misc_feature: SWISSPROT Homolog: EC 1.1.1.100 3-oxoacyl-[acyl-carrier-protein] reductase
MAASTASSSYSAGVSAACCVSPRHGSSFVKPQRSGRPAAAAATLPASGGDQPNLSLDCCRRSKSRARRGERIRASDDAATIMDAGGWAARLEAPPPVAVVTGASRGIGRAIAVALGGAGCKVVVNYAKSGVEAEEVCQRDRGVRWN

SEQ ID NO: 6179 - DNA, 236 bp, Zea mays
  misc_feature: Ceres CLONE 330395-F
  misc_feature (17)..(17): n is a, c, t, g, unknown, or other
ctccaaaactgtgagcnagaagcagggagtgcgctcgacggccgccgcattagtgatttagtgttgaagagggagagaatctaaagtgaccggacgctgtcttccttgctgatcggcgacacggtccatccctccctcgctcgctagggttccttttcgtccgatggatcagagcttcgggaatctcggggccggagctgggagcagcagcgtgggctccaactccaaggctggcg

SEQ ID NO: 6180 - DNA, 517 bp, Zea mays
  misc_feature: Ceres CLONE 330477-F
  misc_feature: Encodes the peptide sequence at SEQ ID NO. 6181
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggaggcgtccctgtcgtgcgtccgctcgtggggcggcgcgctctcgtccatcacccacctcgtgtacgtctcgtcgagcgaggcgcgcttcc

SEQ ID NO: 6181 - protein, 144 aa, Zea mays; identical to SEQ ID NO: 6070
  misc_feature: Ceres CLONE 330477-F
  misc_feature (10)..(144): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase

SEQ ID NO: 6182 - DNA, 508 bp, Zea mays
  misc_feature: Ceres CLONE 330507-F
  misc_feature: Encodes the peptide sequence at SEQ ID NO. 6183
aaaaaacggaagtttcggcggcgccggcgtgctcgtgatctcaacccaaggcgtgcctccgctccggtcacccgtcgctccacgcaaccatgtcgaggaggaagaccagggagcccaaggaggagaacgtcacccttggacccactgtccgtgaaggagagtatgtctttggtgtcgctcacatctttgcatccttcaatgacaccttcattcatatcactgatttgtctgggagggaaactctggttcggatcaccggtggcatgaaggtgaaggctgaccgtgacgagtcgtcaccttacgctgctatgcttgctgctcaagacgtcgcacagcgctgcaaggagcttggcattactgcactgcacattaagcttcgcgccaccggaggcaacaagaccaagacccctggacctggtgcccagtctgccctcagggcgcttgctcgttccgggatgaaaatcggacgcattgaggacgttaccccggtccccactgacagcactcg

SEQ ID NO: 6183 - protein, 139 aa, Zea mays
  misc_feature: Ceres CLONE 330507-F
  misc_feature (28)..(137): Pfam Name: Ribosomal_S11 Pfam Description: Ribosomal protein S11
MSRRKTREPKEENVTLGPTVREGEYVFGVAHIFASFNDTFIHITDLSGRETLVRITGGMKVKADRDESSPYAAMLAAQDVAQRCKELGITALHIKLRATGGNKTKTPGPGAQSALRALARSGMKIGRIEDVTPVPTDST

SEQ ID NO: 6184 - DNA, 493 bp, Zea mays
  misc_feature: Ceres CLONE 330522-F
  misc_feature: Encodes the peptide sequence at SEQ ID NO. 6185
  misc_feature (460)..(460): n is a, c, t, g, unknown, or other
aattacttgcctctcgctcgccaacaccagtgccagaggtccagagcttcgtcaaagacacgccgaaaagggggaggcgactcggccgaggtccggttccgaactccggtcctccgatttgcgcgtccggatctaccagccatggcatcatcttcggacccgtggatgaaggagtacaatgaagcatccagacttgctgatgacatcagttccatgattgctgatagagggtcccttccacaatcaggcccagaaattatgcggcatacttcagccatccggagaaaaataactattcttgggactagactggatagcttggagtcgttgcttggcagaattcctccaaagtcaatcactgacaaggagatgcataagcgccaagacatgttttccagtttgaagtctaaagcaaagcagatggcgacaagtttcaacatgtcaaactttgctaacaggnaggatctgcttggtcagagtaaaaaaggcagat

SEQ ID NO: 6185 - protein, 117 aa, Zea mays
  misc_feature: Ceres CLONE 330522-F
  misc_feature (107)..(107): Xaa is any aa, unknown, or other
MASSSDPWMKEYNEASRLADDISSMIADRGSLPQSGPEIMRHTSAIRRKITILGTRLDSLESLLGRIPPKSITDKEMHKRQDMFSSLKSKAKQMATSFNMSNFANRXDLLGQSKKGR

SEQ ID NO: 6186 - DNA, 445 bp, Zea mays
  misc_feature: Ceres CLONE 330589-F
  misc_feature: Encodes the peptide sequence at SEQ ID NO. 6187
aagatcgagcagcgagagacgggcaggggagagggaaaaaaaaatctaaccctagcatccgcagcgctagggttcgggggttgcgatggcggcggcggcgagacagcgggggacggtgaagtggttcaacgacaccaagggcttcgggttcatctcccccgaggacggcagcgaagatctcttcgtgcaccagtcgtcgatcaagtcggagggcttccgctcgctcgcggagggcgaggaggtggagtttyccgtctcggagggtgacgacggccgcactaaggccgtcgacgtgaccggccccgacggatccttcgtcaggggcggcggaggcggaggaggaggcggcggcggctacggctcccgcggcggtggcggatctggcggcggcggtcgcagctacggtggtagctggggcggcggcyggagatccggcggcgggggc

SEQ ID NO: 6187 - protein, 120 aa, Zea mays
  misc_feature: Ceres CLONE 330589-F
  misc_feature (6)..(73): Pfam Name: CSD Pfam Description: 'Cold-shock' DNA-binding domain
  misc_feature (56)..(56): Xaa is any aa, unknown, or other
  misc_feature (114)..(114): Xaa is any aa, unknown, or other
MAAAARQRGTVKWFNDTKGFGFISPEDGSEDLFVHQSSIKSEGFRSLAEGEEVEFXVSEGDDGRTKAVDVTGPDGSFVRGGGGGGGGGGGYGSRGGGGSGGGGRSYGGSWGGGXRSGGGG

SEQ ID NO: 6188 - DNA, 361 bp, Zea mays
  misc_feature: Ceres CLONE 330655-F
aatgaagacaaacattcaccgagccgaccgttgccttcccccaactcccagccccagcgtcaactgactacactcgctgactcgctcccccggttccccttctctgctcgccatcttttgctctccgcttggctcgtcaatcacctcctacgctccacacgccgccggcgactacaactgcttctgccgtggttacagagaagaagggtttggggagaagacaacctaaatcaattggatctgggagtatcagatctaaaaaggttttcatcaaggtagaaaaagaaacttttctgtacggtatggctttcccaactgcagcagctgttttgcttaatgagaacatgcagattcataaagg

SEQ ID NO: 6189 - DNA, 475 bp, Zea mays
  misc_feature: Ceres CLONE 330677-F
ataccaccagggagtaaaggttaggatgttgttgtcgtgcttgaacctggaagcatgctccaccgggacctgggttcggtcgagcaacaactagtccgctaatgacgccagtcgccggctgctgttcggaggctagcaaaagggcgagagggtttgctagtacgtacagagcgtgcgcgagtaagtggctgggagcccgccgttgtcaagagagaagttgcgaggggcagaggatcatggcgctagaacttgtcgatgcgcagggagttcgccgaagggcgttaaagagcaccgaagccttggcgagtttcctccatactccgaaatttgtcgtcgtgccgttacagcgtgggtcgacgtcactgcggtctcgttgccggtcaagaacaggtaccgcaggatgaggcgcatggaggatgctgtggcgagttcgcgagaggtctaggtcgtcgtctccyagtcaactttgggttgc

SEQ ID NO: 6190 - DNA, 427 bp, Zea mays
  misc_feature: Ceres CLONE 330682-F
  misc_feature: Encodes the peptide sequence at SEQ ID NO. 6191
aattttcaaaggtagagatctctccgccgccgccgcgctatgcctccctccccatcctccggcgcgggctccgcctcgccgtccggctccgcgtccgcctcggcctccaacccaaccccatcctggtgggagtccgtgtcgcaggcgcgctcccgcatcctagctctctcctccatcctgccggccccggcctcccacgacgtcgcggcgctggccgacgccgaccgcccggcgcgcgcgctcctccgctcacccactgcctacgcggcgstctctgacgcactgcgggcgggtggcggcgccgatgaccctgcctgccactggctctacgacacgctcctctccgccgaccccgacctccgcctcgccgcgctcgcgttcctgcccctgctggcggcgctctacctycgccactcccgcccgagct

SEQ ID NO: 6191 - protein, 129 aa, Zea mays
  misc_feature: Ceres CLONE 330682-F
  misc_feature (78)..(78): Xaa is any aa, unknown, or other
MPPSPSSGAGSASPSGSASASASNPTPSWWESVSQARSRILALSSILPAPASHDVAALADADRPARALLRSPTAYAAXSDALRAGGGADDPACHWLYDTLLSADPDLRLAALAFLPLLAALYLRHSRPS

SEQ ID NO: 6192 - DNA, 523 bp, Zea mays
  misc_feature: Ceres CLONE 330691-F
  misc_feature: Encodes the peptide sequence at SEQ ID NO. 6193
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacsgaggcgtcctgtcgtgcgtccgctcgtggggcggcgcgctctcgtccatcacccacctcgtgtacgtctcgtcgagcgaggcgcgcttcctgggcgg

SEQ ID NO: 6193 - protein, 146 aa, Zea mays
  misc_feature: Ceres CLONE 330691-F
  misc_feature (10)..(137): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MVSSSMDTTSDKRASSMLAPNPGKATILALGHAFPQQLVMQDYVVDGFMKNTNCDDPELKEKLTRLCKTTTVRTRYVVMSDEILKNYPELAQEGLPTMNQRLDISNAAVTQMATEASCRASARGAARSRPSPTSCTSRRARRASWA

SEQ ID NO: 6194 - DNA, 489 bp, Zea mays
  misc_feature: Ceres CLONE 330699-F
  misc_feature: Encodes the peptide sequence at SEQ ID NO. 6195
aatagctggggcactgctcgctcgctcgctacgcggacctgtggcgtacgcgtaccactccgagacagcaggcgcgtgcgagagcagcccggcgaggatggggcggatcccgtgctgcgagaaggacagcgtcaagcgcgggcagtggacgcccgaggaggacaacaagctgctctcctacatcacccagtacggcacgcgcaactggcgcctcatccccaagaatgccggactgcagcgatgcgggaagagctgccggctccggtggaccaactacctgcgtcccgacctcaagcacggtgagttcacggacaccgaggagcagaccatcatcaagctgcactccgtcattggcaacaggtggtcggtgatcgcggcgcagctgccgggtcggacggacaacgacgtcaagaaccactggaacaccaagctgaagaagaagctgtccgggatgggcatcgaccccatcacgcacaagtccttctcgca

SEQ ID NO: 6195 - protein, 130 aa, Zea mays
  misc_feature: Ceres CLONE 330699-F
  misc_feature (14)..(61): Pfam Name: Myb_DNA-binding Pfam Description: Myb-like DNA-binding domain
  misc_feature (67)..(112): Pfam Name: Myb_DNA-binding Pfam Description: Myb-like DNA-binding domain
  misc_feature: The sequence is a functional homolog of SEQ ID NO 58 in the 10/666,642 US patent application
  misc_feature: The sequence is a functional homolog of SEQ ID NO 1411 in the 11/479,226 US patent application
  misc_feature: The sequence is a functional homolog of SEQ ID NO 2492 in the 10/374,780 US patent application
  misc_feature: The sequence is a functional homolog of SEQ ID NO 52 in the 10/225,066 US patent application
  misc_feature: The sequence is a functional homolog of SEQ ID NO 1040 in the 10/225,066 US patent application
  misc_feature: The sequence is a functional homolog of SEQ ID NO 2864 in the 10/374,780 US patent application
  misc_feature: The sequence is a functional homolog of SEQ ID NO 2572 in the 10/374,780 US patent application
  misc_feature: The sequence is a functional homolog of SEQ ID NO 636 in the 10/225,066 US patent application
  misc_feature: The sequence is a functional homolog of SEQ ID NO 838 in the 10/412,699 US patent application
  misc_feature: The sequence is a functional homolog of SEQ ID NO 2564 in the 10/374,780 US patent application
  misc_feature: The sequence is a functional homolog of SEQ ID NO 276 in the 10/225,066 US patent application
  misc_feature: The sequence is a functional homolog of SEQ ID NO 818 in the 10/412,699 US patent application
  misc_feature: The sequence is a functional homolog of SEQ ID NO 296 in the 11/479,226 US patent application
  misc_feature: The sequence is a functional homolog of SEQ ID NO 110 in the 10/412,699 US patent application
  misc_feature: The sequence is a functional homolog of SEQ ID NO 259 in the 11/479,226 US patent application
  misc_feature: The sequence is a functional homolog of SEQ ID NO 1052 in the 11/479,226 US patent application
  misc_feature: The sequence is a functional homolog of SEQ ID NO 456 in the 10/412,699 US patent application
  misc_feature: The sequence is a functional homolog of SEQ ID NO 134 in the 10/412,699 US patent application
  misc_feature: The sequence is a functional homolog of SEQ ID NO 321 in the 11/479,226 US patent application
  misc_feature: The sequence is a functional homolog of SEQ ID NO 108 in the 10/412,699 US patent application
  misc_feature: The sequence is a functional homolog of SEQ ID NO 1740 in the 10/412,699 US patent application
  misc_feature: The sequence is a functional homolog of SEQ ID NO 1964 in the 10/374,780 US patent application
  misc_feature: The sequence is a functional homolog of SEQ ID NO 255 in the 11/479,226 US patent application
  misc_feature: The sequence is a functional homolog of SEQ ID NO 908 in the 11/435,388 US patent application
  misc_feature: The sequence is a functional homolog of SEQ ID NO 1065 in the 10/374,780 US patent application
  misc_feature: The sequence is a functional homolog of SEQ ID NO 1307 in the 10/412,699 US patent application
  misc_feature: The sequence is a functional homolog of SEQ ID NO 986 in the 11/435,388 US patent application
  misc_feature: The sequence is a functional homolog of SEQ ID NO 1072 in the 10/374,780 US patent application
  misc_feature: The sequence is a functional homolog of SEQ ID NO 996 in the 11/435,388 US patent application
  misc_feature: The sequence is a functional homolog of SEQ ID NO 1070 in the 10/374,780 US patent application
  misc_feature: The sequence is a functional homolog of SEQ ID NO 992 in the 11/435,388 US patent application
  misc_feature: The sequence is a functional homolog of SEQ ID NO 1069 in the 10/374,780 US patent application
  misc_feature: The sequence is a functional homolog of SEQ ID NO 988 in the 11/435,388 US patent application
  misc_feature: The sequence is a functional homolog of SEQ ID NO 824 in the 10/412,699 US patent application
  misc_feature: The sequence is a functional homolog of SEQ ID NO 836 in the 10/412,699 US patent application
  misc_feature: The sequence is a functional homolog of SEQ ID NO 1068 in the 10/374,780 US patent application
  misc_feature: The sequence is a functional homolog of SEQ ID NO 984 in the 11/435,388 US patent application
  misc_feature: The sequence is a functional homolog of SEQ ID NO 1064 in the 10/374,780 US patent application
  misc_feature: The sequence is a functional homolog of SEQ ID NO 1306 in the 10/412,699 US patent application
  misc_feature: The sequence is a functional homolog of SEQ ID NO 990 in the 11/435,388 US patent application
  misc_feature: The sequence is a functional homolog of SEQ ID NO 1041 in the 11/479,226 US patent application
  misc_feature: The sequence is a functional homolog of SEQ ID NO 112 in the 10/225,066 US patent application
  misc_feature: The sequence is a functional homolog of SEQ ID NO 20 in the 11/375,241 US patent application
  misc_feature: The sequence is a functional homolog of SEQ ID NO 2052 in the 10/374,780 US patent application
  misc_feature: The sequence is a functional homolog of SEQ ID NO 450 in the 10/412,699 US patent application
  misc_feature: The sequence is a functional homolog of SEQ ID NO 1004 in the 11/435,388 US patent application
  misc_feature: The sequence is a functional homolog of SEQ ID NO 1010 in the 11/435,388 US patent application
  misc_feature: The sequence is a functional homolog of SEQ ID NO 2221 in the 10/666,642 US patent application
  misc_feature: The sequence is a functional homolog of SEQ ID NO 998 in the 11/435,388 US patent application
  misc_feature: The sequence is a functional homolog of SEQ ID NO 1000 in the 11/435,388 US patent application
  misc_feature: The sequence is a functional homolog of SEQ ID NO 2223 in the 10/666,642 US patent application
  misc_feature: The sequence is a functional homolog of SEQ ID NO 1094 in the 10/225,066 US patent application
  misc_feature: The sequence is a functional homolog of SEQ ID NO 386 in the 10/374,780 US patent application
  misc_feature: The sequence is a functional homolog of SEQ ID NO 1073 in the 10/374,780 US patent application
  misc_feature: The sequence is a functional homolog of SEQ ID NO 1006 in the 11/435,388 US patent application
  misc_feature: The sequence is a functional homolog of SEQ ID NO 1008 in the 11/435,388 US patent application
  misc_feature: The sequence is a functional homolog of SEQ ID NO 1002 in the 11/435,388 US patent application
  misc_feature: The sequence is a functional homolog of SEQ ID NO 442 in the 10/412,699 US patent application
  misc_feature: The sequence is a functional homolog of SEQ ID NO 430 in the 10/412,699 US patent application
  misc_feature: The sequence is a functional homolog of SEQ ID NO 995 in the 11/479,226 US patent application
  misc_feature: The sequence is a functional homolog of SEQ ID NO 569 in the 10/374,780 US patent application
  misc_feature: The sequence is a functional homolog of SEQ ID NO 136 in the 10/412,699 US patent application
  misc_feature: The sequence is a functional homolog of SEQ ID NO 325 in the 11/479,226 US patent application
  misc_feature: The sequence is a functional homolog of SEQ ID NO 822 in the 10/412,699 US patent application
  misc_feature: The sequence is a functional homolog of SEQ ID NO 1067 in the 10/374,780 US patent application
  misc_feature: The sequence is a functional homolog of SEQ ID NO 1309 in the 10/412,699 US patent application
  misc_feature: The sequence is a functional homolog of SEQ ID NO 1071 in the 10/374,780 US patent application
  misc_feature: The sequence is a functional homolog of SEQ ID NO 994 in the 11/435,388 US patent application
  misc_feature: The sequence is a functional homolog of SEQ ID NO 271 in the 11/479,226 US patent application
  misc_feature: The sequence is a functional homolog of SEQ ID NO 18 in the 11/375,241 US patent application
  misc_feature: The sequence is a functional homolog of SEQ ID NO 426 in the 10/374,780 US patent application
  misc_feature: The sequence is a functional homolog of SEQ ID NO 458 in the 10/225,066 US patent application
  misc_feature: The sequence is a functional homolog of SEQ ID NO 112 in the 10/412,699 US patent application
  misc_feature: The sequence is a functional homolog of SEQ ID NO 267 in the 11/479,226 US patent application
  misc_feature: The sequence is a functional homolog of SEQ ID NO 178 in the 10/412,699 US patent application
  misc_feature: The sequence is a functional homolog of SEQ ID NO 389 in the 11/479,226 US patent application
  misc_feature: The sequence is a functional homolog of SEQ ID NO 156 in the 10/412,699 US patent application
  misc_feature: The sequence is a functional homolog of SEQ ID NO 164 in the 10/412,699 US patent application
  misc_feature: The sequence is a functional homolog of SEQ ID NO 1754 in the 10/412,699 US patent application
  misc_feature: The sequence is a functional homolog of SEQ ID NO 1978 in the 10/374,780 US patent application
  misc_feature: The sequence is a functional homolog of SEQ ID NO 353 in the 11/479,226 US patent application
  misc_feature: The sequence is a functional homolog of SEQ ID NO 369 in the 11/479,226 US patent application
  misc_feature: The sequence is a functional homolog of SEQ ID NO 40 in the 10/374,780 US patent application
  misc_feature: The sequence is a functional homolog of SEQ ID NO 776 in the 10/225,066 US patent application
  misc_feature: The sequence is a functional homolog of SEQ ID NO 1066 in the 10/374,780 US patent application
  misc_feature: The sequence is a functional homolog of SEQ ID NO 1308 in the 10/412,699 US patent application
  misc_feature: The sequence is a functional homolog of SEQ ID NO 2570 in the 10/374,780 US patent application
  misc_feature: The sequence is a functional homolog of SEQ ID NO 634 in the 10/225,066 US patent application
  misc_feature: The sequence is a functional homolog of SEQ ID NO 832 in the 10/412,699 US patent application
  misc_feature: The sequence is a functional homolog of SEQ ID NO 796 in the 11/435,388 US patent application
  misc_feature: The sequence is a functional homolog of SEQ ID NO 593 in the 10/374,780 US patent application
  misc_feature: The sequence is a functional homolog of SEQ ID NO 782 in the 11/435,388 US patent application
  misc_feature: The sequence is a functional homolog of SEQ ID NO 794 in the 11/435,388 US patent application
  misc_feature: The sequence is a functional homolog of SEQ ID NO 1074 in the 10/412,699 US patent application
  misc_feature: The sequence is a functional homolog of SEQ ID NO 590 in the 10/374,780 US patent application
  misc_feature: The sequence is a functional homolog of SEQ ID NO 726 in the 11/435,388 US patent application
  misc_feature: The sequence is a functional homolog of SEQ ID NO 112 in the 11/375,241 US patent application
  misc_feature: The sequence is a functional homolog of SEQ ID NO 2398 in the 10/374,780 US patent application
  misc_feature: The sequence is a functional homolog of SEQ ID NO 466 in the 10/412,699 US patent application
  misc_feature: The sequence is a functional homolog of SEQ ID NO 580 in the 10/225,066 US patent application
  misc_feature: The sequence is a functional homolog of SEQ ID NO 184 in the 10/412,699 US patent application
  misc_feature: The sequence is a functional homolog of SEQ ID NO 397 in the 11/479,226 US patent application
  misc_feature: The sequence is a functional homolog of SEQ ID NO 46 in the 10/374,780 US patent application
  misc_feature: The sequence is a functional homolog of SEQ ID NO 590 in the 11/435,388 US patent application
  misc_feature: The sequence is a functional homolog of SEQ ID NO 6 in the 10/225,068 US patent application
  misc_feature: The sequence is a functional homolog of SEQ ID NO 1118 in the 10/225,066 US patent application
  misc_feature: The sequence is a functional homolog of SEQ ID NO 1396 in the 11/479,226 US patent application
  misc_feature: The sequence is a functional homolog of SEQ ID NO 2488 in the 10/374,780 US patent application
  misc_feature: The sequence is a functional homolog of SEQ ID NO 658 in the 10/412,699 US patent application
  misc_feature: The sequence is a functional homolog of SEQ ID NO 116 in the 10/412,699 US patent application
  misc_feature: The sequence is a functional homolog of SEQ ID NO 280 in the 11/479,226 US patent application
  misc_feature: The sequence is a functional homolog of SEQ ID NO 148 in the 10/412,699 US patent application
  misc_feature: The sequence is a functional homolog of SEQ ID NO 2266 in the 10/374,780 US patent application
  misc_feature: The sequence is a functional homolog of SEQ ID NO 341 in the 11/479,226 US patent application
  misc_feature: The sequence is a functional homolog of SEQ ID NO 58 in the 11/375,241 US patent application
  misc_feature: The sequence is a functional homolog of SEQ ID NO 788 in the 11/435,388 US patent application
  misc_feature: The sequence is a functional homolog of SEQ ID NO 792 in the 11/435,388 US patent application
  misc_feature: The sequence is a functional homolog of SEQ ID NO 790 in the 11/435,388 US patent application
  misc_feature: The sequence is a functional homolog of SEQ ID NO 122 in the 10/412,699 US patent application
  misc_feature: The sequence is a functional homolog of SEQ ID NO 126 in the 11/375,241 US patent application
  misc_feature: The sequence is a functional homolog of SEQ ID NO 148 in the 10/286,264 US patent application
  misc_feature: The sequence is a functional homolog of SEQ ID NO 34 in the 10/374,780 US patent application
  misc_feature: The sequence is a functional homolog of SEQ ID NO 438 in the 10/225,066 US patent application
  misc_feature: The sequence is a functional homolog of SEQ ID NO 743 in the 10/666,642 US patent application
  misc_feature: The sequence is a functional homolog of SEQ ID NO 1656 in the 11/479,226 US patent application
  misc_feature: The sequence is a functional homolog of SEQ ID NO 834 in the 10/412,699 US patent application
  misc_feature: The sequence is a functional homolog of SEQ ID NO 1031 in the 11/479,226 US patent application
  misc_feature: The sequence is a functional homolog of SEQ ID NO 1804 in the 10/412,699 US patent application
  misc_feature: The sequence is a functional homolog of SEQ ID NO 2050 in the 10/374,780 US patent application
  misc_feature: The sequence is a functional homolog of SEQ ID NO 444 in the 10/412,699 US patent application
  misc_feature: The sequence is a functional homolog of SEQ ID NO 598 in the 10/225,066 US patent application
  misc_feature: The sequence is a functional homolog of SEQ ID NO 620 in the 11/435,388 US patent application
  misc_feature: The sequence is a functional homolog of SEQ ID NO 1901 in the 11/479,226 US patent application
  misc_feature: The sequence is a functional homolog of SEQ ID NO 310 in the 10/374,780 US patent application
  misc_feature: The sequence is a functional homolog of SEQ ID NO 842 in the 10/225,066 US patent application
  misc_feature: The sequence is a functional homolog of SEQ ID NO 2394 in the 10/374,780 US patent application
  misc_feature: The sequence is a functional homolog of SEQ ID NO 544 in the 10/225,066 US patent application
  misc_feature: The sequence is a functional homolog of SEQ ID NO 999 in the 11/479,226 US patent application
  misc_feature: The sequence is a functional homolog of SEQ ID NO 263 in the 11/479,226 US patent application
  misc_feature: The sequence is a functional homolog of SEQ ID NO 478 in the 11/435,388 US patent application
  misc_feature: The sequence is a functional homolog of SEQ ID NO 54 in the 10/666,642 US patent application
  misc_feature: The sequence is a functional homolog of SEQ ID NO 1680 in the 11/479,226 US patent application
  misc_feature: The sequence is a functional homolog of SEQ ID NO 202 in the 10/666,642 US patent application
  misc_feature: The sequence is a functional homolog of SEQ ID NO 852 in the 10/412,699 US patent application
  misc_feature: The sequence is a functional homolog of SEQ ID NO 1917 in the 10/374,780 US patent application
  misc_feature: The sequence is a functional homolog of SEQ ID NO 428 in the 10/374,780 US patent application
  misc_feature: The sequence is a functional homolog of SEQ ID NO 54 in the 11/375,241 US patent application
  misc_feature: The sequence is a functional homolog of SEQ ID NO 870 in the 10/225,066 US patent application
  misc_feature: The sequence is a functional homolog of SEQ ID NO 1681 in the 10/374,780 US patent application
  misc_feature: The sequence is a functional homolog of SEQ ID NO 2574 in the 10/374,780 US patent application
  misc_feature: The sequence is a functional homolog of SEQ ID NO 278 in the 10/225,066 US patent application
  misc_feature: The sequence is a functional homolog of SEQ ID NO 446 in the 10/412,699 US patent application
  misc_feature: The sequence is a functional homolog of SEQ ID NO 170 in the 10/412,699 US patent application
  misc_feature: The sequence is a functional homolog of SEQ ID NO 1756 in the 10/412,699 US patent application
  misc_feature: The sequence is a functional homolog of SEQ ID NO 1980 in the 10/374,780 US patent application
  misc_feature: The sequence is a functional homolog of SEQ ID NO 750 in the 10/225,066 US patent application
  misc_feature: The sequence is a functional homolog of SEQ ID NO 1056 in the 11/479,226 US patent application
  misc_feature: The sequence is a functional homolog of SEQ ID NO 144 in the 10/374,780 US patent application
  misc_feature: The sequence is a functional homolog of SEQ ID NO 458 in the 10/412,699 US patent application
  misc_feature: The sequence is a functional homolog of SEQ ID NO 756 in the 10/225,066 US patent application
  misc_feature: The sequence is a functional homolog of SEQ ID NO 168 in the 10/225,066 US patent application
  misc_feature: The sequence is a functional homolog of SEQ ID NO 2718 in the 10/374,780 US patent application
  misc_feature: The sequence is a functional homolog of SEQ ID NO 1075 in the 10/412,699 US patent application
  misc_feature: The sequence is a functional homolog of SEQ ID NO 591 in the 10/374,780 US patent application
  misc_feature: The sequence is a functional homolog of SEQ ID NO 116 in the 11/375,241 US patent application
  misc_feature: The sequence is a functional homolog of SEQ ID NO 1648 in the 11/479,226 US patent application
  misc_feature: The sequence is a functional homolog of SEQ ID NO 2566 in the 10/374,780 US patent application
  misc_feature: The sequence is a functional homolog of SEQ ID NO 632 in the 10/225,066 US patent application
  misc_feature: The sequence is a functional homolog of SEQ ID NO 650 in the 11/435,388 US patent application
  misc_feature: The sequence is a functional homolog of SEQ ID NO 826 in the 10/412,699 US patent application
  misc_feature: The sequence is a functional homolog of SEQ ID NO 232 in the 10/225,066 US patent application
  misc_feature: The sequence is a functional homolog of SEQ ID NO 264 in the 10/374,780 US patent application
  misc_feature: The sequence is a functional homolog of SEQ ID NO 534 in the 11/435,388 US patent application
  misc_feature: The sequence is a functional homolog of SEQ ID NO 1914 in the 10/412,699 US patent application
  misc_feature: The sequence is a functional homolog of SEQ ID NO 2174 in the 10/374,780 US patent application
  misc_feature: The sequence is a functional homolog of SEQ ID NO 956 in the 10/225,066 US patent application
  misc_feature: The sequence is a functional homolog of SEQ ID NO 196 in the 10/225,066 US patent application
  misc_feature: The sequence is a functional homolog of SEQ ID NO 2900 in the 10/374,780 US patent application
  misc_feature: Functional homolog of the protein sequence given in SEQ ID NO 96865
  misc_feature: Useful for making plants with enhanced nutritional value
  misc_feature: The sequence is a functional homolog of SEQ ID NO 1688 in the 11/479,226 US patent application
  misc_feature: The sequence is a functional homolog of SEQ ID NO 1852 in the 10/412,699 US patent application
  misc_feature: The sequence is a functional homolog of SEQ ID NO 2094 in the 10/374,780 US patent application
  misc_feature: The sequence is a functional homolog of SEQ ID NO 2178 in the 10/374,780 US patent application
  misc_feature: The sequence is a functional homolog of SEQ ID NO 1015 in the 11/479,226 US patent application
  misc_feature: The sequence is a functional homolog of SEQ ID NO 138 in the 10/374,780 US patent application
  misc_feature: The sequence is a functional homolog of SEQ ID NO 436 in the 10/412,699 US patent application
  misc_feature: The sequence is a functional homolog of SEQ ID NO 60 in the 11/375,241 US patent application
  misc_feature: The sequence is a functional homolog of SEQ ID NO 1566 in the 10/374,780 US patent application
  misc_feature: The sequence is a functional homolog of SEQ ID NO 1563 in the 10/374,780 US patent application
  misc_feature: The sequence is a functional homolog of SEQ ID NO 1916 in the 10/412,699 US patent application
  misc_feature: The sequence is a functional homolog of SEQ ID NO 2176 in the 10/374,780 US patent application
  misc_feature: The sequence is a functional homolog of SEQ ID NO 1541 in the 10/374,780 US patent application
  misc_feature: The sequence is a functional homolog of SEQ ID NO 1635 in the 10/412,699 US patent application
  misc_feature: The sequence is a functional homolog of SEQ ID NO 2696 in the 10/374,780 US patent application
  misc_feature: The sequence is a functional homolog of SEQ ID NO 344 in the 10/225,066 US patent application
  misc_feature: The sequence is a functional homolog of SEQ ID NO 36 in US patent 7193132
  misc_feature: The sequence is a functional homolog of SEQ ID NO 2898 in the 10/374,780 US patent application
  misc_feature: The sequence is a functional homolog of SEQ ID NO 494 in the 10/225,066 US patent application
  misc_feature: The sequence is a functional homolog of SEQ ID NO 1540 in the 10/374,780 US patent application
  misc_feature: The sequence is a functional homolog of SEQ ID NO 1634 in the 10/412,699 US patent application
  misc_feature: The sequence is a functional homolog of SEQ ID NO 1746 in the 10/412,699 US patent application
  misc_feature: The sequence is a functional homolog of SEQ ID NO 1970 in the 10/374,780 US patent application
  misc_feature: The sequence is a functional homolog of SEQ ID NO 452 in the 10/225,066 US patent application
  misc_feature: The sequence is a functional homolog of SEQ ID NO 584 in the 11/435,388 US patent application
MGRIPCCEKDSVKRGQWTPEEDNKLLSYITQYGTRNWRLIPKNAGLQRCGKSCRLRWTNYLRPDLKHGEFTDTEEQTIIKLHSVIGNRWSVIAAQLPGRTDNDVKNHWNTKLKKKLSGMGIDPITHKSFS

SEQ ID NO: 6196 - DNA, 469 bp, Zea mays
  misc_feature: Ceres CLONE 330755-F
  misc_feature: Encodes the peptide sequence at SEQ ID NO. 6197
gagccgctctcgggctctcggcttcgaatcccgacaacctccctccccgaagctgcttagccgccggctgggcctcagacctgcgtcaagcttccggcggcagcccttcgagcatcacaatggcgtccggcggagcggccatctcggcggggcctacaccaccgtcggcgacgacggcgtcgtcggttgagtggcaccagcggccgccgaacccgaagaatcccgtggtgttcttcgacgtgaccatcgggtccatcgccgccggccgcatcaagatggagctcttcgccgacatcgcccccaagaccgcggagaacttccggcagttctgcactggggagcatagaaaaaatgctttgccacaaggttataagggctgccaattccatagagtgatcaaagatttcatgattcaggctggtgacttcttgaagaatgatggtactggatgcacatcaaatctacggta

SEQ ID NO: 6197 - protein, 116 aa, Zea mays
  misc_feature: Ceres CLONE 330755-F
  misc_feature (36)..(115): Pfam Name: Pro_isomerase Pfam Description: Cyclophilin type peptidyl-prolyl cis-trans isomerase/CLD
  misc_feature: SWISSPROT Homolog: EC 5.2.1.8 Peptidylprolyl isomerase
MASGGAAISAGPTPPSATTASSVEWHQRPPNPKNPVVFFDVTIGSIAAGRIKMELFADIAPKTAENFRQFCTGEHRKNALPQGYKGCQFHRVIKDFMIQAGDFLKNDGTGCTSNLR

SEQ ID NO: 6198 - DNA, 418 bp, Zea mays
  misc_feature: Ceres CLONE 330837-F
atggagttctttgtgtcaaatgaacgctagttgaaccctagccggcggatctccgcgggcggcagtcaggagtggaggcgtggtcgcacgggcgaggtcgcaataggagaggctcagagagatggggcggccttacgcggtgaaggggcggaagaagaagcgcaagctcgaggaggcggcggcggcctcggacgctgccccgcccgtcgaagaagcggaggagctgccaccaccaccactagtccacgacggccgccagccatttcgccgcggcttcacttcgtgttcgttcccccaattgcgtctcctccttccaactccacgcgcttcaatcccacaaccgcgtcgccgtcccgatcccctcccctcccctccctttctcttccatataaaaaaccctcaccaggtgcatcaattg

SEQ ID NO: 6199 - DNA, 389 bp, Zea mays
  misc_feature: Ceres CLONE 330882-F
  misc_feature: Encodes the peptide sequence at SEQ ID NO. 6200
aaaagacacccacacagcaagccagcagagcagaaagcagccgcagccccagcccccacaagacgaggcaacaatggcgctagaagcagccaccgccccccgcgcactcctcgccgcgtgcctcgtcctgctggtcctcggcggcggcaccggcccgtcgtcggtgctgcgcggcgccggggcgcaggccggcgggcagtgcctgccgcagctgaaccgcctcctggcgtgccgcgcgtacctggtgcccggcgcgccggaccccagcgcggactgctgcagcgcgctgagcgccgtgtcgcacgagtgcgcctgcagcaccatgggcatcatcaacagcctgcccggccggtgccacctcgcccaagccaactgctccgcttgaagca

SEQ ID NO: 6200 - protein, 103 aa, Zea mays
  misc_feature: Ceres CLONE 330882-F
  misc_feature (43)..(101): Pfam Name: Tryp_alpha_amyl Pfam Description: Protease inhibitor/seed storage/LTP family
MALEAATAPRALLAACLVLLVLGGGTGPSSVLRGAGAQAGGQCLPQLNRLLACRAYLVPGAPDPSADCCSALSAVSHECACSTMGIINSLPGRCHLAQANCSA

SEQ ID NO: 6201 - DNA, 487 bp, Zea mays
  misc_feature: Ceres CLONE 330923-F
  misc_feature: Encodes the peptide sequence at SEQ ID NO. 6202
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggaggcgtcctgtcgtgcgtccgctcgtggggcggcgcgctctcgtccatcacccayctcgt

SEQ ID NO: 6202 - protein, 134 aa, Zea mays
  misc_feature: Ceres CLONE 330923-F
  misc_feature (10)..(130): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
  misc_feature (133)..(133): Xaa is any aa, unknown, or other
MVSSSMDTTSDKRASSMLAPNPGKATILALGHAFPQQLVMQDYVVDGFMKNTNCDDPELKEKLTRLCKTTTVRTRYVVMSDEILKNYPELAQEGLPTMNQRLDISNAAVTQMATEASCRASARGAARSRPSPXS

SEQ ID NO: 6203 - DNA, 480 bp, Zea mays
  misc_feature: Ceres CLONE 330925-F
  misc_feature: Encodes the peptide sequence at SEQ ID NO. 6204
acacaaacctctcctggcacgagatcacgcttctcgttggatcgaacagctagggtttccaagatgttcgggcgcgcgccgaagaagagcgacaacacacggtactacgagatcctcggggtctccaaggacgcgtcccaggatgacctcaagaaagcctaccgcaaggccgccatcaagaaccaccccgacragggcggcgatcccgagaagttcaaggagctagctcaggcttatgaggtcctcagtgatcctgaaaagcgggagatttatgatcaatatggtgaggatgccctcaaggagggaatgggaggtggtggagggatgcacgatccctttgacatattccagtcattctttggtggtggaagcccttttggaggtggtggcagcagtaggggcagaaggcagcgaagggsagaggatgtggttcatcctctaaaggtttctctggaggayttgtacaatggcacatcaaag

SEQ ID NO: 6204 - protein, 139 aa, Zea mays
  misc_feature: Ceres CLONE 330925-F
  misc_feature (13)..(71): Pfam Name: DnaJ Pfam Description: DnaJ domain
  misc_feature (44)..(44): Xaa is any aa, unknown, or other
  misc_feature (119)..(119): Xaa is any aa, unknown, or other
MFGRAPKKSDNTRYYEILGVSKDASQDDLKKAYRKAAIKNHPDXGGDPEKFKELAQAYEVLSDPEKREIYDQYGEDALKEGMGGGGGMHDPFDIFQSFFGGGSPFGGGGSSRGRRQRRXEDVVHPLKVSLEDLYNGTSK

SEQ ID NO: 6205 - DNA, 447 bp, Zea mays
  misc_feature: Ceres CLONE 330976-F
  misc_feature: Encodes the peptide sequence at SEQ ID NO. 6206
gacgattccgatcccctcccgtcccgtccatcccgtctcggtctcgccctccacgccggcgacggagaaggggccgtgcagcgcaggcgacgcccacaacgaatccgtccccccgcgccggtttcgcccagccccgcggcgacgcgccaggattgaaggaggcatgaaaaggtggacatcgttgctatagccatttgattactggaaatggtgttggtggtaaagcagcaccgctgcacacactctgcgagctgcgtttgcatcaagggccacctcagtgaggatgctctgttcctcgtcttccgccacatgaactggaacccgaggctgattgctatcttgtcgtgtgtgtgcaagtggtttgatgaggttgccaagcaggtgctgtggaaggagttctcatgcaagggctccaaagatgatgctggatttgcattcaggtggcag

SEQ ID NO: 6206 - protein, 80 aa, Zea mays
  misc_feature: Ceres CLONE 330976-F
MVLVVKQHRCTHSASCVCIKGHLSEDALFLVFRHMNWNPRLIAILSCVCKWFDEVAKQVLWKEFSCKGSKDDAGFAFRWQ

SEQ ID NO: 6207 - DNA, 498 bp, Zea mays
  misc_feature: Ceres CLONE 331018-F
  misc_feature: Encodes the peptide sequence at SEQ ID NO. 6208
aaaaccggatagaccaacccttatcctcgagcccaaactgcggtagcgaaaacgcgagcgctgcggaacaacgatggcgacgatgtctcttgccgcggcgtcacccctcgcctccattccccgcggcatcgccgctcaggctccttgcgcggcattcctgtccatccgcttaggtggcgcgacggcgacgcggttcgctggactggcggtggcctcgcagccagcggagcgtcgcgccgcggcgatggtcgcgatggcgaagagggagcaggagctggaggagatccgggccatgacgacggaacagatggaagaggaggtggtagacctcaagggggagcttttcctgctccgccttaagcgctcggcgcgccaggagttcaagaacagcgagttcagcccgcatgcgcaagcaggattgctcgtatgctaaccgtgaaaagagagcgggaaattgaacaaggaaatcaataaaagattgtctaggaagcttgatag

SEQ ID NO: 6208 - protein, 119 aa, Zea mays
  misc_feature: Ceres CLONE 331018-F
  misc_feature (68)..(113): Pfam Name: Ribosomal_L29 Pfam Description: Ribosomal L29 protein
MATMSLAAASPLASIPRGIAAQAPCAAFLSIRLGGATATRFAGLAVASQPAERRAAAMVAMAKREQELEEIRAMTTEQMEEEVVDLKGELFLLRLKRSARQEFKNSEFSPHAQAGLLVC

SEQ ID NO: 6209 - DNA, 402 bp, Zea mays
  misc_feature: Ceres CLONE 331025-F
  misc_feature: Encodes the peptide sequence at SEQ ID NO. 6210
gtctcacctgtaatttcgtccaagccaggcttcccttgccctaggattgcgccgccgcggatccaaacggcttctccctgcccgacggccgcgatgtacaacggcatcaggctgcagaccgcgcgggggtcgggcaccaacggttacgcgcagagcaacacgtycttcgtcaagccccgctccaccacatttggcgggggttcgggcgggccccacaagccgctgccccacgacgtcgccggcgcggatggcggcgggatgcgaaagcccaacaaggagatcctcgagcacgaccgcaagcgccaagtcgagctcaagctgcacgtgctcagggacgcgctcgaggagcacggcaacaccgaagacgagatcgaggagcgcgtcgcggaggcgcgcaaggcc

SEQ ID NO: 6210 - protein, 103 aa, Zea mays
  misc_feature: Ceres CLONE 331025-F
  misc_feature (57)..(101): Pfam Name: cwf21 Pfam Description: cwf21
  misc_feature (24)..(24): Xaa is any aa, unknown, or other
MYNGIRLQTARGSGTNGYAQSNTXFVKPRSTTFGGGSGGPHKPLPHDVAGADGGGMRKPNKEILEHDRKRQVELKLHVLRDALEEHGNTEDEIEERVAEARKA

SEQ ID NO: 6211 - DNA, 450 bp, Zea mays
  misc_feature: Ceres CLONE 331044-F
  misc_feature: Encodes the peptide sequence at SEQ ID NO. 6212
tccttttccgcttctgcgcgaaaaataaaaaaaaaacgaagcgaaagcgaggctgctgtctcacggctgcggctgcggctgcggcggttcgggctcctcctccagactccagggatggccgccggtgcgggaggcggcgaactggaggcgctggagggcgtgcgctccatcgtgctcaagccgtcggagtcgctcgacgagtcgcggttcacgaggatcgccggcgccgacttcaacgacccggccgtcggactcgaggggctgctcgcctcgctcgcgtccaccgggttccaggcatccaacctcggcgacgccatcgacgtcgtcaaccagatgttagactggaggttgtcgcatgagaagcccagcgaggattgtgatgaagctgaacttgaccctaaatatagagcatctgtgaagtgcaagatatttctgggctttcacctcgaa

SEQ ID NO: 6212 - protein, 112 aa, Zea mays
  misc_feature: Ceres CLONE 331044-F
  misc_feature: SWISSPROT Homolog: EC 2.5.1.46 Deoxyhypusine synthase
  misc_feature: The sequence is a functional homolog of SEQ ID NO 2 in the 6,538,182 US patent
  misc_feature: The sequence is a functional homolog of SEQ ID NO 6 in US patent 7217866
MAAGAGGGELEALEGVRSIVLKPSESLDESRFTRIAGADFNDPAVGLEGLLASLASTGFQASNLGDAIDVVNQMLDWRLSHEKPSEDCDEAELDPKYRASVKCKIFLGFHLE

SEQ ID NO: 6213 - DNA, 485 bp, Zea mays
  misc_feature: Ceres CLONE 331076-F
  misc_feature: Translation starting site: 222
  misc_feature: SWISSPROT Homolog: EC 2.7.11.1 Non-specific serine/threonine protein kinase
atacataggtgccggactcgtcccagccgagcgagcaagaggccctcctcctcaagcttcgaatcctccccttccgcactttccctccccctcctcctcctcccctttccagtccccaccccagcgaagcttccaaagccgccccaaccccaacggccgcccggcacgatcgagcagacagctgccgcggccctccccgccccgcacgcgacctcggagccatggagaagtacgagctgctgaaggacatcggcgccggcaacttcggcgtggcgcggctcatgaggaacaaggataccaaggagctggtcgccatgaagtacatcccccggggccaaaagatcgacgagaatgtggcgagggagatcatcaaccaccgctcgctgcgccaccccaacatcatccggtcaaggaggtggtgctgacgccgacgcacctggcgatcgtgatggagtacgccgccggcggcgagctgttcgaccgga

SEQ ID NO: 6214 - DNA, 126 bp, Zea mays
  misc_feature: Ceres CLONE 331183-F
ctcttcgcttctaactccgctgggccaccagtttgaccgccgcctcccttcccctccgctactgctcctccccaccccactcccccgcagagcgcggcgacggcggcgaggtcgtaccccacatcg

SEQ ID NO: 6215 - DNA, 385 bp, Zea mays
  misc_feature: Ceres CLONE 331222-F
  misc_feature: Encodes the peptide sequence at SEQ ID NO. 6216
  misc_feature (108)..(108): n is a, c, t, g, unknown, or other
  misc_feature (159)..(159): n is a, c, t, g, unknown, or other
  misc_feature (347)..(347): n is a, c, t, g, unknown, or other
tcgaaaaacaatcaaatagctccaggactctaacccaaagarctgagcgagccaaatcgtcgaacagatggaagccatggacacggaaccgtcctcccctgcgccggnagcagcsstcaatctgcctcctccgccgtaccatcactgcccagctccagngatgaggttgcagcgacgccgcagccgaagccgaagcaatcaaccgcggggccggggctgaggacaccctcgccgccgccgtcggttcaggtgtccgggtactctctacacgacctgctgctgctgtccccgccacccccgagctcacgccgccaccggtcgagtacgcgtggggcagctgggacgancgtggacgagagcctggagattgttgcggtggcgggga

SEQ ID NO: 6216 - protein, 52 aa, Zea mays
  misc_feature: Ceres CLONE 331222-F
  misc_feature (14)..(14): Xaa is any aa, unknown, or other
  misc_feature (36)..(36): Xaa is any aa, unknown, or other
  misc_feature (38)..(38): Xaa is any aa, unknown, or other
EKQSNSSRTLTQRXERAKSSNRWKPWTRNRPPLRRXQXSICLLRRTITAQLQ

SEQ ID NO: 6217 - DNA, 406 bp, Zea mays
  misc_feature: Ceres CLONE 331309-F
  misc_feature: Encodes the peptide sequence at SEQ ID NO. 6218
aaaccgatcgagcctcgacgagcgagtcgaggactcatcctagctagctaagctgtccgacagcgcagcagaccgatacgagtacgacgatgatgagtagcaccggcggcgagagcaagctggagagccygctgctgggcctgcccgcgccgggctcgtcggccggcagcgggcacagccacggcgaggcggtgagcgggcagctggagagcatcctcagcgacgcctccctgccgtggaggcggcggatgctgtcggcgtccatggtggagatgcggctgctcgtgcgcctgkccgcgcccgccgtgctcgtctacatgatcaactacctcatggtccatgtccacgcagatcttctcgggacacctcggcacgctcgagctggccgccgcgtcgcttcggcaac

SEQ ID NO: 6218 - protein, 105 aa, Zea mays
  misc_feature: Ceres CLONE 331309-F
  misc_feature (14)..(14): Xaa is any aa, unknown, or other
  misc_feature (69)..(69): Xaa is any aa, unknown, or other
MMSSTGGESKLESXLLGLPAPGSSAGSGHSHGEAVSGQLESILSDASLPWRRRMLSASMVEMRLLVRLXAPAVLVYMINYLMVHVHADLLGTPRHARAGRRVASA

SEQ ID NO: 6219 - DNA, 441 bp, Zea mays
  misc_feature: Ceres CLONE 331351-F
  misc_feature: Encodes the peptide sequence at SEQ ID NO. 6220
atcgattcatccagcagaagcaagcatcacacaaaaccgatcaatctcgcagagggagaaccaaccaatccatcatctgtctcgactctctcgcgtctccgccggatccaaacaagaaaaaaagtgcccaccagagagctcccggtcatggcgacgacgcggccgctggagctgacgctgatctcggccaaggacctcaaggacgtgaacctgctgtccaagatggaggtctacgccgtggcgtcgctctccggcgacccccggtcgcggcagcgggtccaggccgaccgcgccggcggccgcaaccctacctggaacgccacgctccgcttcgccgtcccggcaaccggcgcctcctcctccctccacatcctcctccgcgccgagcgsgccctcggcgaccgcgacgtcggcgaggtccacatcccgctctccgagctc

SEQ ID NO: 6220 - protein, 98 aa, Zea mays
  misc_feature: Ceres CLONE 331351-F
  misc_feature (7)..(92): Pfam Name: C2 Pfam Description: C2 domain
MATTRPLELTLISAKDLKDVNLLSKMEVYAVASLSGDPRSRQRVQADRAGGRNPTWNATLRFAVPATGASSSLHILLRAERALGDRDVGEVHIPLSEL

SEQ ID NO: 6221 - DNA, 369 bp, Zea mays
  misc_feature: Ceres CLONE 331376-F
  misc_feature: Encodes the peptide sequence at SEQ ID NO. 6222
acaggtcgcaacaaccccgacgagcaaacccacccatttgccaccaaccccgacgagcggcgatgaccggcacggtgtccaagctggcggcgccccgtccggcagcaccgccgctccggccggcgtccctccgcactgccgccctcgccttcgccccctccccgcgccgggtccgcgtctccgtcgccgggcgagccaggagccccatcattgcgatggcttcggccaaggaaggaaatggtgcaccgaccaagaggactgcgcttcatgatctttacgagctccagggcctgtccccgtggtacgacaacctatgccgccctgtcacagacttgctgcccattatcgccagcggcgtccgtggagtca

SEQ ID NO: 6222 - protein, 102 aa, Zea mays
  misc_feature: Ceres CLONE 331376-F
MTGTVSKLAAPRPAAPPLRPASLRTAALAFAPSPRRVRVSVAGRARSPIIAMASAKEGNGAPTKRTALHDLYELQGLSPWYDNLCRPVTDLLPIIASGVRGV

SEQ ID NO: 6223 - DNA, 468 bp, Zea mays
  misc_feature: Ceres CLONE 331382-F
  misc_feature: Encodes the peptide sequence at SEQ ID NO. 6224
aaaaaaacgcgcagcgcacacaaacacacaccagcccagctccgagagatcatccggcggccggcgagatgagccgcggcacgggcgcgggttatgaccgccacatcaccattttctcccctgagggacgcctgtaccaagtcgagtacgcgttcaaggcggtgaagtcggcgggtgtcacgtcgatcggcgtccgcggcgcggactccgtctgcgtcgtcacccagaagaaagtcccggacaagttgctggatcagacgagcgtgacacacttgttcccgatcaccaagtacgtcggattgcttgccactggcctcacagctgatgcaaggtcattggtttcccaagcaaggaacgaagcacctgagtttcgtttcaaatggggctatgagatgccagttgatgtgttagcaaaatggattgctgacaaagctcaagtttacacgcwacatgcwtacatgagacccc

SEQ ID NO: 6224 - protein, 133 aa, Zea mays
  misc_feature: Ceres CLONE 331382-F
  misc_feature: SWISSPROT Homolog: EC 3.4.25.1 Proteasome endopeptidase complex
  misc_feature (127)..(127): Xaa is any aa, unknown, or other
MSRGTGAGYDRHITIFSPEGRLYQVEYAFKAVKSAGVTSIGVRGADSVCVVTQKKVPDKLLDQTSVTHLFPITKYVGLLATGLTADARSLVSQARNEAPEFRFKWGYEMPVDVLAKWIADKAQVYTXHAYMRP

SEQ ID NO: 6225 - DNA, 398 bp, Zea mays
  misc_feature: Ceres CLONE 331413-F
  misc_feature: Encodes the peptide sequence at SEQ ID NO. 6226
attcatcagacggactcacagctcgcatcacctgaaccacttgacaaccagccagctagctaaccaaccggcggagccaagaacaagcaagagacaacttgccccgtccagacagcatgtgcaactccaacgtcaagtccgcgggcgtcgcccagatcgacggccgcccggtgctgcagccgggcgggcaaccgcgtggcggcgccggacgccgcccgcccgctcaagaagtccctgcacaagtccttctccatgccgccttcctacgacaacaatgccaccgtggcctcccgtcccgtccctgccgagaacacccgtgcggcggcggcggcttctctgctgcctcctacgacgccggcggccccggccgccgcgagggcgaccaaggcggcgggcgc

SEQ ID NO: 6226 - protein, 48 aa, Zea mays
  misc_feature: Ceres CLONE 331413-F
MPPSYDNNATVASRPVPAENTRAAAAASLLPPTTPAAPAAARATKAAG

SEQ ID NO: 6227 - DNA, 410 bp, Zea mays
  misc_feature: Ceres CLONE 331438-F
  misc_feature: Encodes the peptide sequence at SEQ ID NO. 6228
atcgcctccaccgctctctcttcctctgctcttctctgcctgcctgagctcaccgcacctcgcctcctcaccgcgtttcctccgttaatccggtagaaaatggccgatgccgaggatatccagcccctcgtctgcgacaacggaactggcatggtcaaggctgggttcgctggcgacgacgccccgagggccgtcttccccagcatcgtggggcgcccgcgccacactggtgtcatggtcgggatggggcagaaggacgcctacgtcggtgacgaggcgcagtccaagaggggtatcctgaccctcaagtaccccatcgagcacgggatcgtcagcaactgggacgacatggagaagatctggcatcacaccttctacaacgagctccgcgtggctcccgaggagcaccc

SEQ ID NO: 6228 - protein, 103 aa, Zea mays
  misc_feature: Ceres CLONE 331438-F
  misc_feature: SWISSPROT Homolog: EC 2.7.10.2 Non-specific protein-tyrosine kinase
MADAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEH

SEQ ID NO: 6229 - DNA, 491 bp, Zea mays
  misc_feature: Ceres CLONE 331485-F
  misc_feature: Translation starting site: 234
  misc_feature: SWISSPROT Homolog: EC 6.3.2.19 Ubiquitin--protein ligase
agagcagagaacgcaggcagaggcaccataccagtcaaccaccgcttcgttctcctcccacaccgctcgccttcgcctccccatcttctatcatccccgagctccagttctccacacctcacgtctataaataataaataaggcgcccgcccatcaattcgtgtcaccgcgtcccgagagcgcaaatcattccgcgcgacgcaaaaaccctagcctagccaccgatccctctcatggcaaccaccaccacccaggcgagcctcctcctccagaagcagctaagagatctcgcgaagcaccccgtggatgggttctctgctgggctggtcgacgacagcaatgtcttcgagtggcaggtcaccatcatcggacgcctgacaccctatatgatggaggttacttcaatgcaataatgagcttcccacaaaattacccaaacagccgccatcagtcagatttacctctgaaatgtggcatccaaatgtctatcc

SEQ ID NO: 6230 - DNA, 420 bp, Zea mays
  misc_feature: Ceres CLONE 331499-F
  misc_feature: Encodes the peptide sequence at SEQ ID NO. 6231
atcagtcagtcattcatgccgcgtgcgtgaccatttctgtgcgttcgcaggtggtcgtctgggtggcgacgccggcgatgatacgcgccgggtcgacgaccgacgtcatgatcgtgctgctgacggcgttcctgctggagtacctgcccaagatctaccacgccgtccgcgtcctgcgccggatgcagggcgtctccggctacctcttcggcaccatctggtgggggatcgcgctcaacctcatggcctacttcgtcgccgctcacgcggtgggcgcgtgttggtacctgctcggcgcgcagcgggccaccaagtgcctcagggagcagtgcgcccaggccgggagcgggtgcgcgccctgggcgctggcgtgcgcggagccgctctactacggcgccaccgcyagcagcgtgggggcgc

SEQ ID NO: 6231 - protein, 139 aa, Zea mays
  misc_feature: Ceres CLONE 331499-F
QSVIHAACVTISVRSQVVVWVATPAMIRAGSTTDVMIVLLTAFLLEYLPKIYHAVRVLRRMQGVSGYLFGTIWWGIALNLMAYFVAAHAVGACWYLLGAQRATKCLREQCAQAGSGCAPWALACAEPLYYGATASSVGA

SEQ ID NO: 6232 - DNA, 468 bp, Zea mays
  misc_feature: Ceres CLONE 331513-F
  misc_feature: Translation starting site: 146
  misc_feature: SWISSPROT Homolog: EC 1.11.1.7 Peroxidase
atcgcgccgcttccgcccgctggccgctggccgtcagctctcgcgcgctaccggctgcgggataaggcaagcttgtcgctcgccttggtggtgtgcttccagttccagccaccagcgctagcttcctctgcgttgcacgtcggaaatggattcctctagcagaggcatccgcttcgtcgtccacagccgcgcgctgctgctgctgctgctcgtcgcgtcgtcgtccctcgtcggcacgtcgcgtggcagggaggcgcagccgctgcccgcggcggcggccacggccctcggcagcaggcggtcgccggagcggcacggcctggcgctggacttctacgccaggacgtgccccgctgtcgaccagatcgtcgccaacgtcaccgccgcccagtacagggacttccccgccgccggacccgccgtgctccgcctcttcaccacgactgcttcgtcgaagggtgtgacgcg

SEQ ID NO: 6233 - DNA, 386 bp, Zea mays
  misc_feature: Ceres CLONE 331521-F
  misc_feature: Encodes the peptide sequence at SEQ ID NO. 6234
gcatcgaacaccaatggcattcttgcattgaaggaaccatccctccacctccacctcccgagagcgagcggccggacagggtttcggttcggcatggctgccccggcggcgctccgagtggtgatcctcgccgcggtactccttctcccgttcctcagcgtgccgggcgccgaggcacagaccaagaagttttgcctcacgcagttcgccatcgccagccaggcctgcgccatcctaccacccactagtcccgagcaccaccaccaccatcacgacgacgaggacaatgacgaggacaacgacgaagatgaggacgaagacgaggacaatgatgaagatgaagacgaggacgaggacaatgacgacgatagcggcggtggtggcga

SEQ ID NO: 6234 - protein, 97 aa, Zea mays
  misc_feature: Ceres CLONE 331521-F
MAAPAALRVVILAAVLLLPFLSVPGAEAQTKKFCLTQFAIASQACAILPPTSPEHHHHHHDDEDNDEDNDEDEDEDEDNDEDEDEDEDNDDDSGGGG

SEQ ID NO: 6235 - DNA, 460 bp, Zea mays
  misc_feature: Ceres CLONE 331550-F
accgatacagcacaccgtccatctctcccctccccctcgcaccgccgcgcggacacgaacacgcgagccaccgaacaggtccgggcccgatcgcaccgaccagccgcgcccgcggggcggggaggtggatccagtccaggggtgggctcctcttcaccgccgccgatggacttgggcctcagcgtcgcgkggtaggaccggcagcggaggaggagggggctggagagggagcggcggcggcggcgcgtccgcggcggcgtggacccggctcgtcagctctggcgtggaggacgagctggtggccgcgtcgggaggaggaggaggaggtggtggtggacgcgctggggcgagagccggaggcctgccgctggggccactttttggaggcctgcttcctctgccggaagccctccccagcaaccgcgacatatttatgtacaggggtgacatcccgttctgc

SEQ ID NO: 6236 - DNA, 412 bp, Zea mays
  misc_feature: Ceres CLONE 331580-F
  misc_feature: Encodes the peptide sequence at SEQ ID NO. 6237
  misc_feature (208)..(208): n is a, c, t, g, unknown, or other
ctttgtgttcctgctcctgccgatgataggtgtttcagttcatcgggtgcgtgcacgtcagttcgttccagtgcgagcacacacacacactttgatcaggcaggcttaccacgtacgtttcttcagtgccttccttaagaagcggggcgacgatcacaaagaaggtgctcctgcagatcttctgctcctccatcttcggggcaacgcngaaccaggtgctgttcgtcgtggggctcaagtccacsagcgcgaccgtggcgtgcgcgctcaccaacacgctgccggcgctgaccttcgtgatggcggcggcgctcaagatggagccggtgcggccgggcacggcggcggggcaggccaagctggtgggcacggcggtgtgcgtgggcggatccatgctcatacccttctacaa

SEQ ID NO: 6237 - protein, 37 aa, Zea mays
  misc_feature: Ceres CLONE 331580-F
MAAALKMEPVRPGTAAGQAKLVGTAVCVGGSMLIPFY

SEQ ID NO: 6238 - DNA, 388 bp, Zea mays
  misc_feature: Ceres CLONE 331599-F
  misc_feature: Translation starting site: 200
ttcttaaaaatccaatttgaaatctgtccgtcgatacgaactctaccaacgagagagatttgtgttcgtgttcggtcagtcttggtacaccagttccacccaccaccagagaaagcccatccccgttactaataagtcccgtccaaagctcgacaccgcaccgcaccgcatcgaccagctacacgaatcagacggcgtcatggccggcacgtgcgcccacgtcgagttcctccgcgcgcagcggcttgggcgctggtgctggccgccgtgggcctgctcgtggctgtccgcgccgctgcccgcttcgcgctctgggtctacgccgcgttcctccgcccggggaagcccctgcgccgccgctacggcgcctgggccgtcgtgacgggcg

SEQ ID NO: 6239 - DNA, 154 bp, Zea mays
  misc_feature: Ceres CLONE 331645-F
acaactcgcagatcgagtccaagcattcaccggaggatcccaaatcacactctccagtaaccgtccgcttctccagccgcytctctagccgagtctatctcctcctcctccgccgccgckgcaactatcctaatggctcgcttcgccgtaacca

SEQ ID NO: 6240 - DNA, 521 bp, Zea mays
  misc_feature: Ceres CLONE 331657-F
  misc_feature: Encodes the peptide sequence at SEQ ID NO. 6241
gtcctattcctcggagagggagaagccgccgccgcagcaatcacagcagcccggagaaagcccaggtccgacaagatgcagatcttcgtgaagacgctgacagggaagaccatcaccctcgaggtcgagagcagcgacaccatcgacaatgtcaaggccaagatccaggacaaggaagggatcccgccggaccagcagcggctgatctttgccgggaagcagctggaggatggccgcacccttgcggactataacatccaaaaggagtctacgcttcacctcgtgcttaggctccgcggtggcatcattgagccctcgctgcaggcgctcgctcgcaagtacaaccaggacaagatgatctgccgcaaatgctatgcacgactgcaccctagggctgtcaactgccgcaagaagaagtgtggtcacagcaaccagctgagggccaagaagaagatcaagaactgaggtgctgctcctagtcagtttcatggacaatgttgggctgtaattgctgtgtggtt

SEQ ID NO: 6241 - protein, 129 aa, Zea mays
  misc_feature: Ceres CLONE 331657-F
  misc_feature (6)..(74): Pfam Name: ubiquitin Pfam Description: Ubiquitin family
  misc_feature (77)..(128): Pfam Name: Ribosomal_L40e Pfam Description: Ribosomal L40e family
  misc_feature: SWISSPROT Homolog: EC 3.1.2.15 Ubiquitin thiolesterase
MQIFVKTLTGKTITLEVESSDTIDNVKAKIQDKEGIPPDQQRLIFAGKQLEDGRTLADYNIQKESTLHLVLRLRGGIIEPSLQALARKYNQDKMICRKCYARLHPRAVNCRKKKCGHSNQLRAKKKIKN

SEQ ID NO: 6242 - DNA, 455 bp, Zea mays
  misc_feature: Ceres CLONE 331676-F
  misc_feature: Encodes the peptide sequence at SEQ ID NO. 6243
ctttttaatttagtgcacgatttgttgcatcgtagccaactagcaacgacaacccagctagtgattcggttgccgcccatggcttacttgctcaagagcaggagtgaaccagtgcagcagctgctggtaccggcgtcttcagaagaacagcagagaaggbgtaaatgaggtccgggagctccttggcgatctgccgacagagatgccgaacttcctttctgatgccactatccgccggttcctccgagcaagaaactggagtacgatgaaagctaccaagagcctcaaagaagctaccagttggcgacgtcagtacaagccagagaaaattcgttgggaaagcattgccgactgtgagaatgaggctaggagagcctacatacctgactaccttgacaagaaaggaagaatggtcttcgtaacacttccaacaataaagtccccccaaaaaaaaa

SEQ ID NO: 6243 - protein, 84 aa, Zea mays
  misc_feature: Ceres CLONE 331676-F
MPNFLSDATIRRFLRARNWSTMKATKSLKEATSWRRQYKPEKIRWESIADCENEARRAYIPDYLDKKGRMVFVTLPTIKSPQKK

SEQ ID NO: 6244 - DNA, 1206 bp, Zea mays
  misc_feature: Ceres CLONE 331716
  misc_feature: Encodes the peptide sequence at SEQ ID NO. 6245
gttatccagtccagtatcctcgacggtcgacgccggcgcgagcagcaaatggccaccgcggcggcgacgatgaccatggcgacgcaccacccccgcgcccgcgcacccctccgcgtctgcgccgcctgggacatgaacccgggagccgccaccgtggccacgcccaagccctccaaggccaaggccaagccgccgcccgcgaccacaaccccggcccgcccgcctcctctgacccacgccgatctcttcgcgcgctccagcgaggcgcaaggaggggtgaagaagagcacatatatgggctttgagaaatggtggttgccacctgcgccagtggtgaagaaaccccgatcgctctacagtgcggtgtcactggcttacttgggagactgcatatatgaactttatgctcggaggcacttcttctttccacctctgagcatcaatgagtacaacaaacgtgtgatggatgttgtgaagtgtgagtcacaggaccttttgttgaacaagcttcttggagaagattttctaactgaagaagaaagggacatacttcgttgggggcggaatattgttagcagcaaaactcgcaccaggaagcgtgcaggaattgctgtctacaaccgggcatcttcactcgaaacactaattggatatctttacctcacaaatttcaaacggttggaacaactgatgtttcaattgggcttcacaagtggtgcctcatcacagcatattgcagacgctgcgctcaagtttccagaaaacaacccccgcttcggccacacctccacaacctgcaacacagtgaacaggtctgaggtgtaacggtattggatcgtgctcccacaaaggttatctttagtcttcgaccctaacgacggagaaaggacgcaagagtcacagcgtattcagatgcaatagcgaggctgggagcagatggttagcgaacaccgtattcatcagcatgagcaacatagatacgcacaaactctggagatacgcgaaaattaagactctgaatgtctgggctgacctggggcttgcgagtaggatagcttgatgtttgcaaagaagctctgagtgtgggagataggcccgacttggggtgttgtaatcgacctaaattcgtgtaggtaattaaccacttcatgttacttgttgcaaaaaaaaaactgtgatgattctgcttgaaaaaaaaaaaaaaaa

SEQ ID NO: 6245 - protein, 258 aa, Zea mays
  misc_feature: Ceres CLONE 331716
MATAAATMTMATHHPRARAPLRVCAAWDMNPGAATVATPKPSKAKAKPPPATTTPARPPPLTHADLFARSSEAQGGVKKSTYMGFEKWWLPPAPVVKKPRSLYSAVSLAYLGDCIYELYARRHFFFPPLSINEYNKRVMDVVKCESQDLLLNKLLGEDFLTEEERDILRWGRNIVSSKTRTRKRAGIAVYNRASSLETLIGYLYLTNFKRLEQLMFQLGFTSGASSQHIADAALKFPENNPRFGHTSTTCNTVNRSEV

SEQ ID NO: 6246 - DNA, 508 bp, Zea mays
  misc_feature: Ceres CLONE 331778-F
  misc_feature: Translation starting site: 163
aagcggaactcgctgcactgcttggaatccaacgagccaatcattcaaatcctccccggaaccgcgttgagcagggcacggtcgaccggatctagggtgagggtccgtcgccgaagaaactcccaggcggtcacgaggaggcggcgggggagggcggaggagatggcctcggaggagatgacggcgacggaggtggctgcgctgctggatctgaagccgcacccggagggcggcttctacaccgagaccttccgcgacgygctccatcacgctcaccacctcccagctcccgccccactacaaggtaaaccgtgctgttagcaccgcaatttatttcctacttcccgcagggagtgtttcccgtctccaccgcattccttgtgctgaaacctggcacttctacaagggagagcctctcacggtcttcgagcttcacgacgatggtcacattgaccttactgtcattggcccacaccttgaggcaggccagcgccccaagtataccgtg

SEQ ID NO: 6247 - DNA, 513 bp, Zea mays
  misc_feature: Ceres CLONE 331791-F
  misc_feature: Encodes the peptide sequence at SEQ ID NO. 6248
atccccctttctgctcctgtgctgcgtccaccagcctcgtcgttaggacgtaaggtaagacacccaggggcgagccagtgagtacagagagtagccttacgtagcgaagctcagagcaagcgagggtacggtcaaggggggtgatggcgctgtctcgacgtatggcggctcccgtcctcgtcctcatgctcctcctcgtcgccacagagctggggacgaccaaggtggcggaggcgaggcactgcctgtcgcagagccaccggttcaagggcctgtgcatgagcagcaacaactgcgccaacgtgtgccagaccgagaacttccccggcggcgagtgcaaggcggarggcgccacgcgcaagtgcttttgcaagaagatatgctagtagtagcctcggctttgctggcgttgggcggcacaggcaggtcgtcggcacgaaacgcaattcaagcatatatatcggtcctcctcctgcgttgcgctgtctaactcgatcccgttttctctttcga

SEQ ID NO: 6248 - protein, 80 aa, Zea mays
  misc_feature: Ceres CLONE 331791-F
  misc_feature (32)..(80): Pfam Name: Gamma-thionin Pfam Description: Gamma-thionin family
MALSRRMAAPVLVLMLLLVATELGTTKVAEARHCLSQSHRFKGLCMSSNNCANVCQTENFPGGECKAEGATRKCFCKKIC

SEQ ID NO: 6249 - DNA, 496 bp, Zea mays
  misc_feature: Ceres CLONE 331803-F
  misc_feature: Encodes the peptide sequence at SEQ ID NO. 6250
gagaaacagcaaagaaaaacacaagacctcctattcaccatgccgaccgaagagggttccgacggcggtggcggcgccggagccggagccggggagaagaagagctcgcaggcgcccgcaaagcctggagcgtgcggcgccgcaaagttcctcgcggggttgccgtcgcgcggcaacttctcttccggctccgccccctccaatctgggagggttcagggtttacgtctgcgagcacagcacagatcccccagaaggacaagttataaagacggattcaacgaatatstttaatcaggcatctccagttgaacaagcagaagactgagggcaaagatgtggattccagaactgtcggcgaaaacaacagagggaaaagatctgctgccagaagtttggatgtcaacaattcagcaaagaaggctaacttgggtacttcatctggatcatcagcctatgaggaaatttctggcttttcacaacacacactgcagtca

SEQ ID NO: 6250 - protein, 95 aa, Zea mays
  misc_feature: Ceres CLONE 331803-F
  misc_feature (83)..(83): Xaa is any aa, unknown, or other
MPTEEGSDGGGGAGAGAGEKKSSQAPAKPGACGAAKFLAGLPSRGNFSSGSAPSNLGGFRVYVCEHSTDPPEGQVIKTDSTNXFNQASPVEQAED

SEQ ID NO: 6251 - DNA, 539 bp, Zea mays
  misc_feature: Ceres CLONE 331845-F
  misc_feature: Translation starting site: 215
  misc_feature (463)..(463): n is a, c, t, g, unknown, or other
gggtttattcgctcctcccgcccgccgccgtcgccgcctcctctccccagcacccggagctcgcccgaccgccgctcaccatgatcatccccaagaagaaccgcaatgagatctgcaagtacctcttcaaggagggcgtgctgtatgccaagaaggactacaacctggcgaagcacccgcagatcgatgtgcccaacctccaggtgatcatctcatgcagagctttaagtccaaggagtatgttagggagaccttctcctggcagtactactactggtatctcaccaacgatggcattgagcacctacgcaactacctgaacctcccgtctgagatcgtgcctgccacgctcaagaagtctgccaagccaccbtggccgcccatttggctctggccctcctggtgaccgcccaaggggcccaggtcgttttgacggcgacaggccaaggtttggtgacagggnatgggtaccgtggtggtcctcgtggtgctcctggtgacttttgggtgggcgatagagtggagctcctgctgagttc

SEQ ID NO: 6252 - DNA, 538 bp, Zea mays
  misc_feature: Ceres CLONE 331896-F
  misc_feature: Encodes the peptide sequence at SEQ ID NO. 6253
ctagccgcctgcctctcctcctccagagctcgtcgccaccggccaccgccaccctcgatcacgccgtccgtcgaggtaaggtcagcatggtgagggtcagtgtgctcaacgatgcgctcaagtccatgtacaacgctgagaagatcggcaagaggcaggtcatgatcaggccgtcgtccaaggtcatcatcaagttcctgacggtcatgcagcgccacggctacattggagagttcgagtacgttgatgaccaccgatcgggcaagatcgtggtcgaactcaacgggaggctgaacaagtgcggcgtcatcagccctcgctttgatatcggcgtgaaagacattgagggatggactgcaaggctgctcccgtccaggcagttcggwtacatcgtcctcacaacttcggcaggcatcatggaccacgaggaggcccgccggaagagcgtaggaggcaaggttctaggtttcttctattgaagaagctgagaatctttgttatggcctgcctgcctgtcttactctctcagactagagta

SEQ ID NO: 6253 - protein, 130 aa, Zea mays
  misc_feature: Ceres CLONE 331896-F
  misc_feature (5)..(130): Pfam Name: Ribosomal_S8 Pfam Description: Ribosomal protein S8
MVRVSVLNDALKSMYNAEKIGKRQVMIRPSSKVIIKFLTVMQRHGYIGEFEYVDDHRSGKIVVELNGRLNKCGVISPRFDIGVKDIEGWTARLLPSRQFGYIVLTTSAGIMDHEEARRKSVGGKVLGFFY

SEQ ID NO: 6254 - DNA, 478 bp, Zea mays
  misc_feature: Ceres CLONE 331920-F
  misc_feature: Encodes the peptide sequence at SEQ ID NO. 6255
accaaaaccaaatccagaactctccctgggaatttggtggccgatttgccgccgcgtgggtgtggtggggcatgcgccgaacgactcctgcgtcggagctcaagcgcctcggggtctccagcaatggtatgaccatyatcggagctcgctgctcgtggatggtggcgaggcaacgtcgccagctccatcctcgtcacacccgcgcgtgaggacacgtgtcacctgaagaccatcctgatacctggaatctcaagtcccaggtcaagagcaggtaccacaggatgaggcgcatggaggatgctgtgacgagttcgtgagaggtctaggccgtcgtctcccagtcaactttgggttgctggaccgttgtctccatataatgtaattatttatttattttgtacaaaactccgattatatagtaaagatgtgacattcgatcctgtgccatgatttcatcatatgtgtgagacttggtccc

SEQ ID NO: 6255 - protein, 68 aa, Zea mays
  misc_feature: Ceres CLONE 331920-F
QNQIQNSPWEFGGRFAAAWVWWGMRRTTPASELKRLGVSSNGMTIIGARCSWMVARQRRQLHPRHTRA

SEQ ID NO: 6256 - DNA, 424 bp, Zea mays
  misc_feature: Ceres CLONE 331936-F
  misc_feature: Encodes the peptide sequence at SEQ ID NO. 6257
actctctcccctcaacacactctccttctttctctgtcccgtctcttccactggctcctgccccaggcggcgctgcagcccagcgcggcgaccagcgcccgcgcgaggtgagccgcggtcgagcccctggcgcctggcggccctgtcccctggccagccacggcgtgacgcccatcctcacccctgcgtgcggccagccccgacggcgctgcatggaagcgcggcgcggcagccgggtcggccggccagcgagcctgcgcacccccgtcctcgccagcgtccaagctcgcctcgtcggagtcgccgttcgtcaccgtgactgcgattcatttccgagcttcgaggaatcgacagtcaagcttcggcgaccaagagatcggaactcttcgagttctacaaggctgaagaccctgagcatctgatg

SEQ ID NO: 6257 - protein, 69 aa, Zea mays
  misc_feature: Ceres CLONE 331936-F
MEARRGSRVGRPASLRTPVLASVQARLVGVAVRHRDCDSFPSFEESTVKLRRPRDRNSSSSTRLKTLSI

SEQ ID NO: 6258 - DNA, 524 bp, Zea mays
  misc_feature: Ceres CLONE 331938-F
  misc_feature: Encodes the peptide sequence at SEQ ID NO. 6259
attcgtcttgctccagccgccgtcggatcggatccgatccaaagcaagcagcagcagccggctccgcctcccgcagcagcacaccccgtccgtcaccagaggaagaggaagaggaggatgtcggggtcgaaggtgtacacccttgaggaggtggccaagcacaacaccaaggatgactgctggctcgtcatcggcggcaaggtgtacaatgtgaccaagtttctggaggaccaccctggaggtgatgatgtcctgctgtcttccactgccaaggatgctaccgatgatttcgaagatgtggggcacagcaccaccgcccgtgcaatgatggacgagtacctcgtcggtgagattgatgcggccacgatacccagtaaggtgaagtacacgccccccaagcagccgcactacaaccaggataagaccccggagttcgtcatcaagatcctccagtttttggtcccccctggcaatactgggctggctgttgctgtaaggatctacaccaagtcggaatctgccta

SEQ ID NO: 6259 - protein, 135 aa, Zea mays
  misc_feature: Ceres CLONE 331938-F
  misc_feature (6)..(80): Pfam Name: Cyt-b5 Pfam Description: Cytochrome b5-like Heme/Steroid binding domain
  misc_feature: SWISSPROT Homolog: EC 1.7.1.1 Nitrate reductase (NADH)
MSGSKVYTLEEVAKHNTKDDCWLVIGGKVYNVTKFLEDHPGGDDVLLSSTAKDATDDFEDVGHSTTARAMMDEYLVGEIDAATIPSKVKYTPPKQPHYNQDKTPEFVIKILQFLVPPGNTGLAVAVRIYTKSESA

SEQ ID NO: 6260 - DNA, 512 bp, Zea mays
  misc_feature: Ceres CLONE 331949-F
  misc_feature: Encodes the peptide sequence at SEQ ID NO. 6261
aaccagcaccactcatccgtcgccccacggaagtctcggcggcgccggcgtgcttgtgatctcaacccaagtcgtgcctccgctccggtcacccgtcgctccacgcaaccatgtcgaggaggaagaccagggagcccaaggaggagaacgtcacccttggacccactgtccgtgaaggagagtatgtctttggtgttgctcacatctttgcatccttcaatgacaccttcattcatatcactgatttgtctgggagggaaactctggttcggatcaccggtggcatgaaggtgaaggctgaccgtgacgagtcgtcaccttacgctgctatgcttgctgctcaagatgtcgcacagcgctgcaaggagcttggcattactgcactgcacattaagcttcgtgccaccggaggcaacaagaccaagacccctggacctggtgccagtctgccctcagggcgcttgctcgttccgggatgaaaatcggacgcattgaggacgttaccccggtcc

SEQ ID NO: 6261 - protein, 122 aa, Zea mays
  misc_feature: Ceres CLONE 331949-F
  misc_feature (28)..(117): Pfam Name: Ribosomal_S11 Pfam Description: Ribosomal protein S11
MSRRKTREPKEENVTLGPTVREGEYVFGVAHIFASFNDTFIHITDLSGRETLVRITGGMKVKADRDESSPYAAMLAAQDVAQRCKELGITALHIKLRATGGNKTKTPGPGASLPSGRLLVPG

SEQ ID NO: 6262 - DNA, 493 bp, Zea mays
  misc_feature: Ceres CLONE 331985-F
  misc_feature: Encodes the peptide sequence at SEQ ID NO. 6263
agggtttatctcacgccgcaacctccctcgagcccgagcaaacaagggcggacgcggagcggcggcggagcggagatggcggagaagaagcgaggagccggcactcgcaaggatgaagtggtgacacgcgagtacaccatcaacctccacaaacgcctccacggatgcaccttcaagaakyaaggcaccaaatgccatcaaggagatcaggaagttcgctcagaaggccatgggtactactgatgtccggattgacgtgaagctcaacaagcacatctggagcagtggtatccgcagtgtgccgaggcgtgtccgtgtcagaattgcccgcaaccggaacgatgaggaagacgccaaggaggaactctactccctggtcacagtagctgagatcccaccggagggtctcaaaggtttgggaactaaggttgttgaggatgaggattaaagccctgtataccatgagataaatttgagaatgttgcttcagctt

SEQ ID NO: 6263 - protein, 72 aa, Zea mays
  misc_feature: Ceres CLONE 331985-F
  misc_feature (1)..(54): Pfam Name: Ribosomal_L31e Pfam Description: Ribosomal protein L31e
MGTTDVRIDVKLNKHIWSSGIRSVPRRVRVRIARNRNDEEDAKEELYSLVTVAEIPPEGLKGLGTKVVEDED

SEQ ID NO: 6264 - DNA, 469 bp, Zea mays
  misc_feature: Ceres CLONE 332076-F
  misc_feature: Encodes the peptide sequence at SEQ ID NO. 6265
gtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggcggcggctacggcggtggcaaccgtg

SEQ ID NO: 6265 - protein, 123 aa, Zea mays
  misc_feature: Ceres CLONE 332076-F
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGYGGGRGGGGYGGGGRRDGGGGYGGGNR

SEQ ID NO: 6266 - DNA, 514 bp, Zea mays
  misc_feature: Ceres CLONE 332097-F
  misc_feature: Encodes the peptide sequence at SEQ ID NO. 6267
atctgagttcctgattgttgtattccagtttcttctgtgagttttgtgggatcgcgaggaagaactagaaggatgtcgtgctgcggaggcaactgcgggtgcggcgccggctgcaagtgcggcagcggctgcggagggtgcaagatgtacccggacatggctgagcaggtgaccaccactacccagactctcatcatgggtgttgcaccgtccaagggcgggttcgaggcggccgccggagctgagaacggcgggtgcaagtgcggcgccaactgcacctgcgacccctgcacctgcaagtgagacgacggcgatgacgctgcagggcgtcatgggatcggaaggactcttttatcttaagctctagtataatattctagcagtgtcgtttgtgttttgttcgagtcagtcagacagtcagccgcgtgccatgggccatggcatagcatgccattgcctcgctctatctgctccatcgcctttttctagtggtggtactgatgggggaacgaat

SEQ ID NO: 6267 - protein, 76 aa, Zea mays
  misc_feature: Ceres CLONE 332097-F
  misc_feature (1)..(75): Pfam Name: Metallothio_2 Pfam Description: Metallothionein
MSCCGGNCGCGAGCKCGSGCGGCKMYPDMAEQVTTTTQTLIMGVAPSKGGFEAAAGAENGGCKCGANCTCDPCTCK

SEQ ID NO: 6268 - DNA, 507 bp, Zea mays
  misc_feature: Ceres CLONE 332120-F
  misc_feature: Encodes the peptide sequence at SEQ ID NO. 6269
agttctccattttcgagcgcagaagcgagagagatccggagcagccgcagtcccaccgaccccgccgccggtcgccctccatctcctcgccgctgcctctcgtttctcttttcaataatcaagatgagccgtggtggtagtgccggtggtggtcaaagttctctggattatctctttggaagcggtgagccccccaaaccagcagtggcaccagctgcaagtgctccacctgttgagaaaccatctgctgcaaagactgatgcggccaagcaggttgctgctggggttaccagccaaaccaataactaccacagggctgatggtcagaacactggcaacttccttacggaccgtccttcaaccaaggtccacgctgctcctggcggtggctcttccctgggctacctgttcggtggcaactgatgcccgtgctggtgcgctcaccaaagttatcctcccctgcctgctgcgtgctatgtctgaatcgtgaacaaccgttgtcatttc

SEQ ID NO: 6269 - protein, 99 aa, Zea mays
  misc_feature: Ceres CLONE 332120-F
MSRGGSAGGGQSSLDYLFGSGEPPKPAVAPAASAPPVEKPSAAKTDAAKQVAAGVTSQTNNYHRADGQNTGNFLTDRPSTKVHAAPGGGSSLGYLFGGN

SEQ ID NO: 6270 - DNA, 540 bp, Zea mays
  misc_feature: Ceres CLONE 332150-F
  misc_feature: Encodes the peptide sequence at SEQ ID NO. 6271
agagcagagctgcctccagacgagacgaggaggacgcggcgccgttcgggcttggcagcaaccagcgtctagcgcagtgcccttctgtctcctatctccccggagtccccgctgcccagcccggtctcactttccagtctccgagactccgagtctcgctcgcaccccgtcccctccagcctgtgctctgggttggagggaggtgagctgcgagggagcgcggagggggcgaggagatggaggcagattcggcgaggaagagacttgcattgctggccctgcttctcctggcggcgcccgtccgcccggcctcggcggctccggtggaggatggcctgctcagcaatggtgactttgagacagcaccaagtggtggttttgtaaaatctgcttctgttgctgagggtgcatcgtcaatccctggttggacgatcaacggcacggttgaactcatttcagcaggccaacaccagggtggcatgatcctgattgttccacagggggaccatgcagtaaggctagggaatgatgctagcgttg

SEQ ID NO: 6271 - protein, 101 aa, Zea mays
  misc_feature: Ceres CLONE 332150-F
MEADSARKRLALLALLLLAAPVRPASAAPVEDGLLSNGDFETAPSGGFVKSASVAEGASSIPGWTINGTVELISAGQHQGGMILIVPQGDHAVRLGNDASV

SEQ ID NO: 6272 - DNA, 494 bp, Zea mays
  misc_feature: Ceres CLONE 332182-F
  misc_feature: Encodes the peptide sequence at SEQ ID NO. 6273
gctccgtttcgccgcatagccgagaggaagcaggcggcggcgagaatccagtagaacgcgagcagacggcggcgatggcatggcgggcgagcctgtctcggagtgtaaaggagatacgcgtcctcttctgccagtcctcccccgctagcgcccccgcccgggagttcgtgaagaagaactatggtgacatcaaggcccgcaacccctccctccccttccttgtccgcgagtgctccggtgtccagccccagctctgggcgcgctacgatatgggtgtggagagatgcgtgaacttggatggtctgacggaagcacagattgataagaagctggaggaacttgaggaaatggaggaggaggccgccgcgctccgcgagatgcaggccaaggttgccaaggagatgcaaggtgtagatcccaatgcaaccacatctgaaaacaaagaggagatggattctcgctcagtattcattggraatgttgactatgcgtgc

SEQ ID NO: 6273 - protein, 140 aa, Zea mays
  misc_feature: Ceres CLONE 332182-F
  misc_feature (20)..(93): Pfam Name: L51_S25_CI-B8 Pfam Description: Mitochondrial ribosomal protein L51 / S25 / CI-B8 domain
MAWRASLSRSVKEIRVLFCQSSPASAPAREFVKKNYGDIKARNPSLPFLVRECSGVQPQLWARYDMGVERCVNLDGLTEAQIDKKLEELEEMEEEAAALREMQAKVAKEMQGVDPNATTSENKEEMDSRSVFIGNVDYAC

SEQ ID NO: 6274 - DNA, 527 bp, Zea mays
  misc_feature: Ceres CLONE 332233-F
  misc_feature: Encodes the peptide sequence at SEQ ID NO. 6275
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggaggcgtccctgtcgtgcgtccgctcgtggggcggcgcgctctcgtccatcacccacctcgtgtacgtctcgtcgagcgaggcgcgcttcccgggcggcga

SEQ ID NO: 6275 - protein, 147 aa, Zea mays
  misc_feature: Ceres CLONE 332233-F
  misc_feature (10)..(147): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MVSSSMDTTSDKRASSMLAPNPGKATILALGHAFPQQLVMQDYVVDGFMKNTNCDDPELKEKLTRLCKTTTVRTRYVVMSDEILKNYPELAQEGLPTMNQRLDISNAAVTQMATEASLSCVRSWGGALSSITHLVYVSSSEARFPGG

SEQ ID NO: 6276 - DNA, 539 bp, Zea mays
  misc_feature: Ceres CLONE 332337-F
  misc_feature: Translation starting site: 120
  misc_feature: Pfam Name: DUF617 Pfam Description: Protein of unknown function, DUF617
atcaaatactcccgccgcgcgcgcgcgcactcgccctaggaacctcccattactgccatcacgcgcacaccggcacacgcacgctacgcccgatcgagcgagcctatcccacacccaccatggcgagagccttccgcgccgtccccgctgcccctgccgagctcgaggagcgcggccgcggcggcgacgagcggcggcgggagagggaacttcccgtggctcacgaagaagcagggctcgtcgtcgtcgagcaagccatcgccgagcggcggcggccaggagagcaagggcgacgagcacgagggggcgagcggcgccgggtccgtcgagcagtctccctcgccgtctccgtcgccgtcgaggaggcgcgcggacgcgctggcgcggctgcgggcgctgttcctggcggcgatcacgcaccggcggcggcggcggcagctggggtcgtgcgtgacgggcaccatcttcgggcggcsgcgcgggcgcgtgcacgtcgcgctgcagacggacccgcgctcgcgcccgtgctgctggtggag

SEQ ID NO: 6277 - DNA, 524 bp, Zea mays
  misc_feature: Ceres CLONE 332403-F
  misc_feature: Encodes the peptide sequence at SEQ ID NO. 6278
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggaggcgtccctgtcgtgcgtccgctcgtggggcggcgcgctctcgtccatcacccacctcgtgtacgtctcgtcgagcgaggcgcgcttcccgggcgg

SEQ ID NO: 6278 - protein, 146 aa, Zea mays
  misc_feature: Ceres CLONE 332403-F
  misc_feature (10)..(146): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MVSSSMDTTSDKRASSMLAPNPGKATILALGHAFPQQLVMQDYVVDGFMKNTNCDDPELKEKLTRLCKTTTVRTRYVVMSDEILKNYPELAQEGLPTMNQRLDISNAAVTQMATEASLSCVRSWGGALSSITHLVYVSSSEARFPG

SEQ ID NO: 6279 - DNA, 457 bp, Zea mays
  misc_feature: Ceres CLONE 332404-F
  misc_feature: Translation starting site: 257
  misc_feature: SWISSPROT Homolog: EC 2.6.1.1 Aspartate transaminase
atatcccatcctgatctctcctcccttcttcagtgcagcagcaggccagcagctacgccacccgccccacycctgcctccgatccgctgcttactcgccacccgtgagatggccaccgccgccgccttctccgtctcctcgccggcggcctccgccgtcgccgcgcgatccaaggtgtttggaggaggagttaaccaggcgagaactagractggctgccgcgtcggcatcacgcggaagaacysttggccgtgtcatgatggcccttgcagtggatgtttctcgttttgaaggabtgccaatggctcctccagacccaattcttggggtttctgaggcctttaaagcagataaaagcggagcctgaagctcaatcttggtgttggtgcctataggacagaagagctgcagccatacgtgstcaatgtagtcaagaaggctgaaaatcttatgttgg

SEQ ID NO: 6280 - DNA, 515 bp, Zea mays
  misc_feature: Ceres CLONE 332451-F
  misc_feature: SWISSPROT Homolog: EC 2.7.11.7 [Myosin heavy-chain] kinase
atcggtccaccgagccacaccgtcaccacaccaccgtctcgcggagaaactcctccaaaacccccaaaccctttcaatcggcggcaatggcggcgccggcggcgacgatgcctcggcatccccaggctacgtcctccgctccacacttgaggggcaccgccgcgccgtatcaaccgttaagttctccccggatggccgccttctcgcctccgcctccgccgacaagcttcttcgcgtgtggtcttcctccgatctcacccccgttgcggagctcgagggccatggagagggtgtctcagacctctctttctcccccgacggccgcctccttgcctccgcctccsgatgatcgcaccgtccgcatctgggacctcgccgtcggcggaggggcccgcctcgtcaagacgctcacgggccacaccaactacgccttctgcgtctccttcagcccccatggcaacgtcctcgcctccgggtcctttgacgagacggtgccgcgtgtgggaggtcaggtc

SEQ ID NO: 6281 - DNA, 489 bp, Zea mays
  misc_feature: Ceres CLONE 332525-F
  misc_feature: Encodes the peptide sequence at SEQ ID NO. 6282
aacacaaccaagctcgatccatctcactctccgctggtcgctcactcttgcagctccacccttcactcagtcttagtctcttattagctctaggctctagctagccgcgccactccttcgtgtagccatcagccttctcatcgccaccaatggccactgccgaggtccagaccccgaccgtcgtggcggccgaggaagcgcccgtggtggagaccccgccgccggccgtcgtgcccgaggagtctgcccccgccgaggccgaggccgaggccgaggctgctgctcctgctgatcccgaggagcttcccgcggccgagcagcaggcagccgccgaggcggaggccgcggctcctgctggtgccgaggagcccgtcgcggccgaaccggccgccgaggcggaggctgctgctcctgctggtcccgaggagactccstgcggtcgagcaggaggcagccgccgaggaggaggctgctgctgctcctcctgct

SEQ ID NO: 6282 - protein, 113 aa, Zea mays
  misc_feature: Ceres CLONE 332525-F
MATAEVQTPTVVAAEEAPVVETPPPAVVPEESAPAEAEAEAEAAAPADPEELPAAEQQAAAEAEAAAPAGAEEPVAAEPAAEAEAAAPAGPEETPCGRAGGSRRGGGCCCSSC

SEQ ID NO: 6283 - DNA, 426 bp, Zea mays
  misc_feature: Ceres CLONE 332532-F
  misc_feature: Encodes the peptide sequence at SEQ ID NO. 6284
aaaaaacaagcttgctactgtgatttctcgtccgagcagcggcggaggagagagagagaccatggccgaccacaaggaggagcctgtgccggagtctgtgatggacaagatcaccgagaagttccacggcggggactcgtcgtcgtcgtcgtctgactcggacgacgagaagaaggggtcctcgttggcgtcggcggcggaagccatgaaggccaagatctaccgccttttcggccgggagaggcccgtccactccgtcctcggcggcggcaagcctgccgatcttatcctatggaggaacaggaagatctctggcggggtacttgctggtgccacggccatctggctcctattcgaggtcatggagtaccatctcctcaccttggtgtgccactgtctcatcctctcgctggccatcctcttcta

SEQ ID NO: 6284 - protein, 121 aa, Zea mays
  misc_feature: Ceres CLONE 332532-F
MADHKEEPVPESVMDKITEKFHGGDSSSSSSDSDDEKKGSSLASAAEAMKAKIYRLFGRERPVHSVLGGGKPADLILWRNRKISGGVLAGATAIWLLFEVMEYHLLTLVCHCLILSLAILF

SEQ ID NO: 6285 - DNA, 479 bp, Zea mays
  misc_feature: Ceres CLONE 332575-F
  misc_feature: Encodes the peptide sequence at SEQ ID NO. 6286
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggaggcgtccctgtcggtgcgtccgctcgtggggcggcgcgctcttgtccatca

SEQ ID NO: 6286 - protein, 131 aa, Zea mays
  misc_feature: Ceres CLONE 332575-F
  misc_feature (10)..(130): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MVSSSMDTTSDKRASSMLAPNPGKATILALGHAFPQQLVMQDYVVDGFMKNTNCDDPELKEKLTRLCKTTTVRTRYVVMSDEILKNYPELAQEGLPTMNQRLDISNAAVTQMATEASLSVRPLVGRRALVH

SEQ ID NO: 6287 - DNA, 470 bp, Zea mays
  misc_feature: Ceres CLONE 332581-F
  misc_feature: Encodes the peptide sequence at SEQ ID NO. 6288
accagaagctcactcgctgctcgttgccggctgcccccgcccactccaccgctgatatttgtcatcgtctcgttcctgccctcggccctccccaactccagcaggcagatcagatacatccattcgcggaccggaaggaaaggaaagggttgaaccatgagcgccgtggctgtttcgtcgtcgctgaacccggacgcgccgctcttcatcccggcggcgctgctgcaggtggaggacttctcgccgcagtggtgggacctcatcaccaccactgcctggttccgcgaccactggtcccgcgagcgcgcccacctggacgagatggccgagcagatcgacgcggccggcctccccgacgacgaagacctcttctacgacgaccagcccgagcagggccccgtcgctgccgcccttaagacagattcggtgctcaaggcgctgaacatgacctccccgaagggcggcggcga

SEQ ID NO: 6288 - protein, 104 aa, Zea mays
  misc_feature: Ceres CLONE 332581-F
MSAVAVSSSLNPDAPLFIPAALLQVEDFSPQWWDLITTTAWFRDHWSRERAHLDEMAEQIDAAGLPDDEDLFYDDQPEQGPVAAALKTDSVLKALNMTSPKGGG

SEQ ID NO: 6289 - DNA, 494 bp, Zea mays
  misc_feature: Ceres CLONE 332598-F
  misc_feature: Encodes the peptide sequence at SEQ ID NO. 6290
aggatgaatcggaagagagaatcctaccaaacctagctaccaactcgatcgtcgtcatcacgctcgaccgcacaactccaccgatgccggcgcccctgctgccgccgccaccgcggtaccggcggggaacgggcagaccgtgtgcgtgaccggcgcggccgggtacatcgcctcgtggttggtgaagctgctgctcgagaagggatacactgtgaagggcaccgtcaggaacccagatgacccgaagaacgcgcacctcaaggcgctggacggcgccgccgagcggctgatcctctgcaaggccgatctgctggactacgacgccatctgccgcgccgtgcagggctgccagggcgtcttccacaccgcctcccccgtcaccgacgacccggagcaaatggtggagccggcggtgcgcggcaccgagtacgtgatcaacgcggcggcggaggccggcacggtgcggcgggtggtgttcacgtcgtccatcggcg

SEQ ID NO: 6290 - protein, 32 aa, Zea mays
  misc_feature: Ceres CLONE 332598-F
  misc_feature: SWISSPROT Homolog: EC 1.1.1.219 Dihydrokaempferol 4-reductase
MVEPAVRGTEYVINAAAEAGTVRRVVFTSSIG

SEQ ID NO: 6291 - DNA, 508 bp, Zea mays
  misc_feature: Ceres CLONE 332658-F
  misc_feature: Encodes the peptide sequence at SEQ ID NO. 6292
atagtctcctaattcttcatcttcaacctctagctgattgatctctggtatttaccactctttccttccttccttccttcaattctaaataccacaaatcaaagttgctttgcgatggtgagcagcagcatggacacgacgagtgacaagcgtgcgtcatccatgctggcccctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcccaggaggggctgccgacgatgaaccagcgtctggacatctcgaacgcggcggtgacgcagatggcgacggaggcgtccctgtcgtgcgtccgctcgtggggccggcgcgctctcgtccatt

SEQ ID NO: 6292 - protein, 131 aa, Zea mays
  misc_feature: Ceres CLONE 332658-F
  misc_feature (10)..(130): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MVSSSMDTTSDKRASSMLAPNPGKATILALGHAFPQQLVMQDYVVDGFMKNTNCDDPELKEKLTRLCKTTTVRTRYVVMSDEILKNYPELAQEGLPTMNQRLDISNAAVTQMATEASLSCVRSWGRRALVH

SEQ ID NO: 6293 - DNA, 512 bp, Zea mays
  misc_feature: Ceres CLONE 332666-F
  misc_feature: Encodes the peptide sequence at SEQ ID NO. 6294
accgcacacacatacacaagcacaagcacaagcactctagcaatggcttctgaggttgtccgccctagcgacgccgagctactgcaggcacaagccgacatatggcggctcagcctctcctacctcacgcccctgtcactgaagtgcgccgtggtgcttggcatccctagggcgatctaccgccatggcggggctgcctcagccgctgagctgatcacggcgctgtctctcccctccgctaagctaccgttcctccgccgcctgctgcggctcctagccgcgtcgggcgtgttcaccgtcgacaggcagagcacggaggaggagaggtaccgcatcagccccgtctcctacctcctggtggaaggcatccctcacgaggaccacatgaaccacacctctttcgtgctcacctgcacctcgtcgcgctacatcgagccggcaatagggctggccgagtggttcaggaaggacacggccacgtcaccgttcgaggagctgcacggggcgactct

SEQ ID NO: 6294 - protein, 156 aa, Zea mays
  misc_feature: Ceres CLONE 332666-F
  misc_feature (31)..(79): Pfam Name: Dimerisation Pfam Description: Dimerisation domain
  misc_feature: SWISSPROT Homolog: EC 2.1.1.146 (Iso)eugenol O-methyltransferase
MASEVVRPSDAELLQAQADIWRLSLSYLTPLSLKCAVVLGIPRAIYRHGGAASAAELITALSLPSAKLPFLRRLLRLLAASGVFTVDRQSTEEERYRISPVSYLLVEGIPHEDHMNHTSFVLTCTSSRYIEPAIGLAEWFRKDTATSPFEELHGAT

SEQ ID NO: 6295 - DNA, 467 bp, Zea mays
  misc_feature: Ceres CLONE 332703-F
aagaacactcctagctagctgaagatctcgagtgcaacgcaacgttggcgcttggcggccagtagtagcagctaatttagcgtcgctccttcctagacgagagatcgagaaaccatggccaagctccaagtcactcctggcgccgcgttcacccgagtgcaatgaactcaacttccagggcctgtacctgtaccacacgcccctgggccccaaggccaaccaagctgcgatcgtagagagcaaggccaagatcggcatcggtgccaccgtggttaacaactgggcagtgtatgacgggccagggccaggcgctaagctcgtcggccgtgcgcagggcttgcacatcctagccggcaactgggtcaactcattcaccctggtgttcgaggatgaaaggttcagtgggtccacgcttgaagtgaggggcataacggttgaaactggcgagtgggctgttgttgggggca

SEQ ID NO: 6296 - DNA, 508 bp, Zea mays
  misc_feature: Ceres CLONE 332721-F
  misc_feature: Encodes the peptide sequence at SEQ ID NO. 6297
ctaatccccacgaaaaccctaaacccccctacccggcggcggctacaagctcttcgtcggttcagcaccatgaggccaccggctagaggaggacgtggtgggaggggtggcaggttcgatggcggcrgccgtgggggcggcggcggcggccgtgggtttggcggtggtagargcgggagaggggacaggsgagggagaggtggcaggacccccagaggcggccgtggcggcrgtggaaggcgtcgccgcggcggtggcatgaagggcgggagcaaggccgtcgtgrtggcgcacaagcacgccggtgtcttcatctccaagtccaaggaggatgcgctctgcaccaagaacatggtcccgggagagtccgtgtacggagagaagcgtgtctccgttcaggtgcacgattgcttattcttgtcctgttttatcttctccttttattattgtattggtattgcttgtgttttctgtaccgagaatgagctgacctgttgtagataggcga

SEQ ID NO: 6297 - protein, 144 aa, Zea mays
  misc_feature: Ceres CLONE 332721-F
  misc_feature (20)..(20): Xaa is any aa, unknown, or other
  misc_feature (35)..(35): Xaa is any aa, unknown, or other
  misc_feature (41)..(41): Xaa is any aa, unknown, or other
  misc_feature (55)..(55): Xaa is any aa, unknown, or other
  misc_feature (73)..(73): Xaa is any aa, unknown, or other
MRPPARGGRGGRGGRFDGGXRGGGGGGRGFGGGRXGRGDRXGRGGRTPRGGRGGXGRRRRGGGMKGGSKAVVXAHKHAGVFISKSKEDALCTKNMVPGESVYGEKRVSVQVHDCLFLSCFIFSFYYCIGIACVFCTENELTCCR

SEQ ID NO: 6298 - DNA, 442 bp, Zea mays
  misc_feature: Ceres CLONE 332762-F
  misc_feature: Encodes the peptide sequence at SEQ ID NO. 6299
ccatcactcgcgcgccggcgccgctcacacgcccatttccaccccacaagacccacacggaatcccggcaccctacctctccaacacgcaccggcatcatggccgtggcttcgacctcgcmrctatccgccaagcccgccacggcccctcgccgcccgctccggtgtccgggttcctcgctctccccgcccgccgcggccgcgcaacgcgcctcggctccgcygccgcgtggaggaggcttcgcgtggaggcgatctggaagcagcaggagaagcagcgggcagaggtgtccgtcgaggaacccgcccccgtcagggaggccgccgcgcccctggacggagtcggagctgacgaccccatggttccttcctcggacgagagctgggtggtcaggctcgagcagtcggtcaayattttccttcacggaatcggtgattatact

SEQ ID NO: 6299 - protein, 147 aa, Zea mays
  misc_feature: Ceres CLONE 332762-F
  misc_feature (41)..(41): Xaa is any aa, unknown, or other
HHSRAGAAHTPISTPQDPHGIPAPYLSNTHRHHGRGFDLAXIRQARHGPSPPAPVSGFLALPARRGRATRLGSAAAWRRLRVEAIWKQQEKQRAEVSVEEPAPVREAAAPLDGVGADDPMVPSSDESWVVRLEQSVNIFLHGIGDYT

SEQ ID NO: 6300 - DNA, 506 bp, Zea mays
  misc_feature: Ceres CLONE 332778-F
  misc_feature: Encodes the peptide sequence at SEQ ID NO. 6301
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggaggcgtccctgtcgtgcgtccgctcgtggggcggcgcgctctcgtccatcacccacctcgtgtacgtctcgtcgagcga

SEQ ID NO: 6301 - protein, 140 aa, Zea mays; identical to SEQ ID NO: 5477
  misc_feature: Ceres CLONE 332778-F
  misc_feature (10)..(140): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase

SEQ ID NO: 6302 - DNA, 497 bp, Zea mays
  misc_feature: Ceres CLONE 332831-F
  misc_feature: Encodes the peptide sequence at SEQ ID NO. 6303
aatctatccagtcgcatctccctctccgaaatcaaggtagcgtacaccgctgcagtttctagagccctctctgccactcgtgatcccactagtcacaatgcctgccctcgccaagcccgcctcccgcaccgccaagcccgccgcggctccgaagccgaagcctgccgccgccaagccgaaggcggccaccgctggtgcctcccacccgccttacttcgagatgatcaaggaggctatcacggcgctcaaggagaggaccggctccagctcgcaagcgatcgccaagtatgtgggggacaagcacggcgcgtctctgccggccaacttcaagaagatgctttccatccagctccgtgggtccgcagccaagggcaagctcgtgaaggtcaaggcttcgtacaagctctcggacgccgccaagaaggcatcccccaagaccaaggctaagcccggcaaaggccgccgctgccaagaccaccgcccccaagccggccaag

SEQ ID NO: 6303 - protein, 133 aa, Zea mays
  misc_feature: Ceres CLONE 332831-F
  misc_feature (35)..(105): Pfam Name: Linker_histone Pfam Description: linker histone H1 and H5 family
MPALAKPASRTAKPAAAPKPKPAAAKPKAATAGASHPPYFEMIKEAITALKERTGSSSQAIAKYVGDKHGASLPANFKKMLSIQLRGSAAKGKLVKVKASYKLSDAAKKASPKTKAKPGKGRRCQDHRPQAGQ

SEQ ID NO: 6304 - DNA, 569 bp, Zea mays
  misc_feature: Ceres CLONE 332832-F
  misc_feature: Encodes the peptide sequence at SEQ ID NO. 6305
aacctctagctgattgatctctggtttaccactctttccttccctccttcaattctaaataccacaaatcaaagttgctttgcgatggtgagcagcagcatggacacgacgagtgacaaacgtcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggaggcgtccctgtcgtgcgtccgctcgtggggcggcgcgctctcgtccatcacccacctcgtgtacgtctcgtcgagcgaggcgcgcttccccgggcggcgacctgcacctggcgcgcgcgctggggctgagccggagttcgcg

SEQ ID NO: 6305 - protein, 146 aa, Zea mays
  misc_feature: Ceres CLONE 332832-F
  misc_feature (1)..(143): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MLAPNPGKATILALGHAFPQQLVMQDYVVDGFMKNTNCDDPELKEKLTRLCKTTTVRTRYVVMSDEILKNYPELAQEGLPTMNQRLDISNAAVTQMATEASLSCVRSWGGALSSITHLVYVSSSEARFPGRRPAPGARAGAEPEFA

SEQ ID NO: 6306 - DNA, 518 bp, Zea mays
  misc_feature: Ceres CLONE 332838-F
  misc_feature: Encodes the peptide sequence at SEQ ID NO. 6307
atatgttgggctcagggctcacagggcagacagcaacggcatgccggccgatccgccatcgtccggtcccatcggcgtccgtgctagctacggtgctataggtcctagctaataattccatcgcatggcatccgtgcaggcgacaagtcgatgatccggaagcggtacatgcacctgacggaggagttcctgtcggagaacccgagcatgtgcgcgtacatggcgccgtcgctggacgcgcggcaggacgtggtggtgacggaggtgccgaagctggggaaggcggcggcgcagaaggcgatcaaggagtgggggcagcccaagtcgcggatcacgcacctggtgttctgcaccacgtcgggggtggacatgccgggcgccgactaccagctgaccaaggcgctgggcctgcggccctccgtgaaccgcctgatgatgtaccagcaggggtgcttcgcgggcggcacggtgctgcgcgtggccaaggacctggcggagaacaaccgcggggcgagggt

SEQ ID NO: 6307 - protein, 122 aa, Zea mays
  misc_feature: Ceres CLONE 332838-F
  misc_feature (1)..(122): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MIRKRYMHLTEEFLSENPSMCAYMAPSLDARQDVVVTEVPKLGKAAAQKAIKEWGQPKSRITHLVFCTTSGVDMPGADYQLTKALGLRPSVNRLMMYQQGCFAGGTVLRVAKDLAENNRGAR

SEQ ID NO: 6308 - DNA, 489 bp, Zea mays
  misc_feature: Ceres CLONE 332845-F
  misc_feature: Encodes the peptide sequence at SEQ ID NO. 6309
gtgctttcttagaggtgggttggcttctcctccccctccggttcgggttcgggttcgtgaggttctccggggttcggtttcgtgggtgagcggatcgagatggcggcggcggctacggcggtggcggcggcggctacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggcggcggctacggcggtggcggcggcggctacggtggcggcggcggctacggtggtggtggcggc

SEQ ID NO: 6309 - protein, 130 aa, Zea mays
  misc_feature: Ceres CLONE 332845-F
  misc_feature (12)..(75): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAAAATAVAAAATDDHSLHNAFSTYGEVLESKIILDRETQRSRGFGFVTFSTEEAMRNAIEGMNGKELDGRNITVNEAQSRGGRGGGGGGYGGGRGGGGYGGGGRRDGGGGYGGGGGGYGGGGGYGGGGG

SEQ ID NO: 6310 - DNA, 177 bp, Zea mays
  misc_feature: Ceres CLONE 332851-F
gaaaatagcagaagaatccagaggcgactccaggtttgttggcgatgctgcgagcgggaggcaggcggctcctcgccccggggctccgtcggctcggcctgggcacaggcctccggsaggcgggccctgcggcgcggcggcgagggtgagggcgtaccacgagcgggtggtggacca

SEQ ID NO: 6311 - DNA, 238 bp, Zea mays
  misc_feature: Ceres CLONE 332852-F
  misc_feature (203)..(203): n is a, c, t, g, unknown, or other
gtttcatatgaaaaatatttcgttgtcgttaggcttaggccatgcgcatttgaggcttctgagctatggtttatggaaagcttgccggcctttgacgctggaaggagaaaccagtcagtctccggcgctgcccctccgccgtggccggcgacgggtggaggcagtatgtgagcgagagacagtgggcagccggagacggsgtngtccctctgaaggcctcacgacctgccggcttctg

SEQ ID NO: 6312 - DNA, 187 bp, Zea mays
  misc_feature: Ceres CLONE 332855-F
  misc_feature (54)..(54): n is a, c, t, g, unknown, or other
  misc_feature (55)..(55): n is a, c, t, g, unknown, or other
aaaggccacacacagtcgcactcgcacagccgccaccaccacctggtccacgtnnccggcggcaatgtgggcgcacctggccgtcgcgctgttcatggcgttasstggcttcccccggcccgcggctccgacgtgccttcgttcccgctgtcgcaggcgcagtccccgtccaactcctcgtctccgt

SEQ ID NO: 6313 - DNA, 770 bp, Zea mays
  misc_feature: Ceres CLONE 332860-R
  misc_feature (17)..(17): n is a, c, t, g, unknown, or other
  misc_feature (48)..(48): n is a, c, t, g, unknown, or other
  misc_feature (49)..(49): n is a, c, t, g, unknown, or other
  misc_feature (52)..(52): n is a, c, t, g, unknown, or other
  misc_feature (53)..(53): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
tttttttctttttactntctcctccctttttcaactatattttaaaannaannannnccgattgggtaccgggccccccctcgaggtcgacggtatcgataagcttttttttttttttttttgctgtaggcaactcatcaaaccgcgtccattccaaaagcaactccaaataattgtacaaacatgctgaccccagccatcccagataaacatgcgacttaaaataacagtctatcaaccaagaaaagctatgtagatgactgacgactctgatttcaccgaacacaaacattcatctcggagaaaacacaatgaaaatttgcggggaagctgaaccttggaaacgaaatgaatggaatggcatccatttgacccttgtttgccttcaaccttcactctttatcatccttgttatcatcggatgcaggagcctcctctttctctgcattttcctccttgctgggctctgccactgtcaacttctgtgccaaatcagaagcggcaggggagacttcatcattttctttcctccacgctctttccttggctgttcaactatctcttcaaaacaggtccttggaacttttttgcaattccccgacaggattccaaacagggaaaagcaaaaacatcctccccctttgaaacctcgcccctcgagacgaaattccaagcgccggggcccacccgccccccaaatttggttgcgtcccccggagaagctcccctgggaagtcttaaatctggtcttcccaacccctgaaagtggt

SEQ ID NO: 6314 - DNA, 451 bp, Zea mays
  misc_feature: Ceres CLONE 332877-F
  misc_feature: Encodes the peptide sequence at SEQ ID NO. 6315
  misc_feature (63)..(63): n is a, c, t, g, unknown, or other
accctgctgtctccctccctccttccttccttccccgccactgcgcmgcgagtgcggcgacanagtcacacactcacactccctcgaccgctctcggccccgtccgcgtcgccgcaggcaggaggcaatggcggcgggcgggaatggcgccggcggggacaccagggcggccttcgcgcggatctacaagacgctcaaggaggagctgctcaccgacccggccttcgagttcaccgaggagtcacgccakgattcgaccgcatggttgactacaatgtactcggaggcaagtgtaaccgtggggctctctgtggtcgacagctacaagctgctcaagggcgctgatgctctgggcgaggaggaaacgttccttgcttgcaccctcggctggtgcattgaatggcttcaggctttctttcttgtgcttgatgatatcatggatgactctcac

SEQ ID NO: 6315 - protein, 108 aa, Zea mays
  misc_feature: Ceres CLONE 332877-F
  misc_feature: SWISSPROT Homolog: EC 2.5.1.67 Chrysanthemyl diphosphate synthase
  misc_feature (41)..(41): Xaa is any aa, unknown, or other
MAAGGNGAGGDTRAAFARIYKTLKEELLTDPAFEFTEESRXDSTAWLTTMYSEASVTVGLSVVDSYKLLKGADALGEEETFLACTLGWCIEWLQAFFLVLDDIMDDSH

SEQ ID NO: 6316 - DNA, 437 bp, Zea mays
  misc_feature: Ceres CLONE 332890-F
  misc_feature: Pfam Name: zf-CHY Pfam Description: CHY zinc finger
  misc_feature (367)..(367): n is a, c, t, g, unknown, or other
agcggattgcggagtggcattgggttggcagcacgcccctgcacacggtgacacgggccacggcgcggcgcggcgcggcacggggagcgagcgccgagcrgagcaagcaaccgctgtccgccgggccggccacggcttgccccctgcttcgcgccttcgccggtgcgctcacgcctcacgcaggtgcatgcatcgacctacggtatcctagtctgggatcagaaaagaacacagcaacaacaaagaagaaaggcgcgaskattggacggtgacgccggaccagagcaacacgggtgcgtgcactacaggagggggatscaagataagggcgccgtgctgcggcaagggtatttggttgcaggcactncacaacgaagccaaggactcgctgggaggtcagcgttccacgaccgccacgtgcttccccgtcacgacat

SEQ ID NO: 6317 - DNA, 157 bp, Zea mays
  misc_feature: Ceres CLONE 332910-F
  misc_feature (68)..(68): n is a, c, t, g, unknown, or other
  misc_feature (92)..(92): n is a, c, t, g, unknown, or other
accgcaaacgccaccacgcccacgccwcgccgcgcaccacatctgadacctccagcccgacgccggcnccggcccctgctcgcctgctcgtnacatttcctggtgcccgcyaagccccgcgacctgggctccccagctccatccatcaaccgcctgc

SEQ ID NO: 6318 - DNA, 516 bp, Zea mays
  misc_feature: Ceres CLONE 332914-F
  misc_feature: Encodes the peptide sequence at SEQ ID NO. 6319
gcagtaacactagtcaaattttacgtaacttgcgtggttctcttcctgcgacggaagcaaacactgcccgagacatagacagcgggacgtcgagatggccgacggggaggacgccgccgccgcgcrcmgccgggccgccatcacagactaccgcaagamgctgctcaactgcagggagctagagtcgcgcgtcggcaccgtgagagaaagccttaaaactgcaaagaaggattttaccaagactgaggacgacttaaagtctctgcagagtgtggggcaaataattggagaagtactccgacctcttgataatgaacgctttatcgtgaaggccagcagtggtccccgatacgtggtcggttgccgaagtaaagtggacaaggagaagttgacatctggtactcgtgttgtacttgacatgacgaccttgacaataatgcgcactcttccacgggaggtggatcctgtggtatataacatgcttcatgaagatccaggaatgtcagttactctgct

SEQ ID NO: 6319 - protein, 140 aa, Zea mays
  misc_feature: Ceres CLONE 332914-F
  misc_feature (11)..(11): Xaa is any aa, unknown, or other
  misc_feature (12)..(12): Xaa is any aa, unknown, or other
  misc_feature (22)..(22): Xaa is any aa, unknown, or other
MADGEDAAAAXXRAAITDYRKXLLNCRELESRVGTVRESLKTAKKDFTKTEDDLKSLQSVGQIIGEVLRPLDNERFIVKASSGPRYVVGCRSKVDKEKLTSGTRVVLDMTTLTIMRTLPREVDPVVYNMLHEDPGMSVTL

SEQ ID NO: 6320 - DNA, 642 bp, Zea mays
  misc_feature: Ceres CLONE 332917-R
  misc_feature (21)..(21): n is a, c, t, g, unknown, or other
  misc_feature (642)..(642): n is a, c, t, g, unknown, or other
tcgaggtcgacggtatcgatnaagcttttttttttttttttttaggcgtcccaacggacgagggttgcaatcaacccctctcaagcggtccaaagacccacttgaataccatggtgttttgcttgctttttctcaatcctgtttgcgaggaatctccacaacttggagcctctcgcccttacactttaagatcacaaagaaacacggagcaagggagggattagcaacgcactcaagaaatcacagcaacaccacgcacacaagtcacaaacgagagctcacaatacaactcaatgagttcaccactcaactagagctccaattgctatcgcaaaagaatcaaaagggcgggaatcgatatcttggtggcttaggaaatgtttgtaagaaatgcttgggaatgccccctcccaggcgcccaaggggggcccctttttttgccccaagggaagctagggaaccctttgaaaacgcatcctaaggaagggttgaattttggccttttggtcaaatgggggccccgggaaaaagtccgggggaaaccccggaaattttcccgggggcccgaatttttttttccccaaaatggggcaacaccccaacccgttgtgggcccccaaaaaaaccccctttggggccccn

SEQ ID NO: 6321 - DNA, 443 bp, Zea mays
  misc_feature: Ceres CLONE 332936-F
  misc_feature (135)..(135): n is a, c, t, g, unknown, or other
  misc_feature (231)..(231): n is a, c, t, g, unknown, or other
  misc_feature (423)..(423): n is a, c, t, g, unknown, or other
  misc_feature (430)..(430): n is a, c, t, g, unknown, or other
atcttgctctgaacgcattcctcccatctcccaagacctcctcagacccgagaagcgcavkgcggccatggacgccaccggcactggagctggagggaaggcgaagaagggagcggccggtcgcaaggccgcggngcgaggaagaagtcggtgacgaggtccgtgaaggccgggctccagttccccgtcggccgcatcgggcgctacctcaagaagggccgctacgcgcancgtcggcagcggtgcccccgtctacctcgcggccgtcctggagtacctcgccgctgaggtcctggagctcgccggcaacgctgccaaggacaacaagaagacgcgcatcgtcccgcgccacgtgctgctggcgatccgcaacgacgaggayctcgggaagctsctgaccggcggtgaccatcgcccacggcncgtgttncccaacatcaacc

SEQ ID NO: 6322 - DNA, 507 bp, Zea mays
  misc_feature: Ceres CLONE 332938-F
  misc_feature: Translation starting site: 226
  misc_feature (75)..(75): n is a, c, t, g, unknown, or other
  misc_feature (76)..(76): n is a, c, t, g, unknown, or other
  misc_feature (388)..(388): n is a, c, t, g, unknown, or other
  misc_feature (450)..(450): n is a, c, t, g, unknown, or other
tcaggatgaatcggaagagagaatcctaccaaacctagctaccaactcgatcgtcgtcatcacgctcgaccgcannactgcaccgaggggggaggagacctaaaaactactacatcttttagctacacatctagctaaagatcgagaggggtaaatraggacgagcgggcgcgagctagaagagcagctgcaggtactaccatcatcgtcgtcgtcgtcgccaggatgaccgttgtcgacgccgtctcctccaccgatgccggcgccgcssccgccacggtaccggcggggaacgggcagaccgtgtgcgtcaccggcgcggccggtacatcgcctcgtggttagtgaagctgctgctcgagaagggatacactgtgaagggcacgtngagaacccagatgacccgaagaacgcgcacctcaaggcgctggacggcgcgcsaagcgstgnatcctctgcaggccgatctgctggactacgacgccatctgccgcgccgtgcagggct

SEQ ID NO: 6323 - DNA, 210 bp, Zea mays
  misc_feature: Ceres CLONE 332969-F
  misc_feature: Encodes the peptide sequence at SEQ ID NO. 6324
  misc_feature (33)..(33): n is a, c, t, g, unknown, or other
  misc_feature (34)..(34): n is a, c, t, g, unknown, or other
gccacaaccgtagcctgtagcttcatccgtttnngctgctcccggttccatcgcgcggtgcgaatttaacatggccgtgcggagtggtggtcgacggcgtsstcttcccgccggtggcccgcccgccgggtccgcggctcgcacttcctcggcggcgcaggcgtgcgaggccycgagatcggaggcaacttcatcaagttcacggccatc

SEQ ID NO: 6324 - protein, 46 aa, Zea mays
  misc_feature: Ceres CLONE 332969-F
  misc_feature (11)..(11): Xaa is any aa, unknown, or other
  misc_feature (35)..(35): Xaa is any aa, unknown, or other
MAVRSGGRRRXLPAGGPPAGSAARTSSAAQACEAXRSEATSSSSRP

SEQ ID NO: 6325 - DNA, 114 bp, Zea mays
  misc_feature: Ceres CLONE 332979-F
  misc_feature (72)..(72): n is a, c, t, g, unknown, or other
  misc_feature (76)..(76): n is a, c, t, g, unknown, or other
acgatcacacaccactccacagcagtagcaagagggatagagcaaggcccacaccacacacacacaccactnagtnaggctagcctagccttttagtcgtcgaggaggagcaag

SEQ ID NO: 6326 - DNA, 528 bp, Zea mays
  misc_feature: Ceres CLONE 333010-F
  misc_feature: Translation starting site: 43
  misc_feature: SWISSPROT Homolog: EC 2.1.1.146 (Iso)eugenol O-methyltransferase
accgcacacacatacacaagcacaagcacaagcactctagcaatggcttctgaggttgtccgccctagcgacgccgagctactgcaggcacaagccgacatatggcggctcagcctctcctacctcacgcccctgtcactgaagtgcgccgtggtgcttggcatccctagggcgatctaccgccatggcggggctgcctcagccgctgagctgatcacggcgctgtctctcccctccgctaagctaccgttcctccgccgcctgctgcggctcctagccgcgtcgggcgtgttcaccgtcgacaggcagagcacggaggaggagaggtaccgcatcagccccgtctcctacctcctggtggaaggcatccctcacgaggaccacatgaaccacacctctttcgtgctcaccttgcacctcgtcgcgctacatcgagccggcaatagggctggccgagtggttcaggaaggacacggccacgtcaccgttcgaggagctgcactgggcgactctgttccacgagagcat

SEQ ID NO: 6327 - DNA, 422 bp, Zea mays
  misc_feature: Ceres CLONE 333041-F
gcaccaccaccgtcactcaacacagcacaggcagctcgagagagagagagagagaaagawgtcgtggttcgggcaccaccaccacaaccagccggctcccccggcgtcgggccccaaccaggtgttcaagatcttctgccgcgccaacgagaactactgcctggccgtccgcgacggcgccgtcgtgctggccccggtcaaccccaaggacgaccaccagcactggtacaaggacatgcgcttcagcacccgggtcaaggacgaggaaggcatgccggcgttcgcgctcgtcaacaaggccacggggctcgcaatcaagcactccctcggccagtcccacccggtcaagctcgcgcctttcagcccggaccaggaggacgcgtcggtgctgtggacggagagcaaggacgtgggcaagggct

SEQ ID NO: 6328 - DNA, 329 bp, Zea mays
  misc_feature: Ceres CLONE 333122-F
  misc_feature: Encodes the peptide sequence at SEQ ID NO. 6329
aaccgagagagagaccgatacagagagagagacctagaggacacgggagagaggacgttcatttccgcgtcgtctccgcccgcagccggcagccccaccacccaccacatggccgccatgccgggtggggcccacggcgccggcgccgcggacccgatgcaggtggaccagccgctaccccctgccgccgcaggcacagcacacgcccccgccgacgccaagcatgctggttctatgattgaagggagtgatccggtcacaggtcatataatctcgacaaccattggagggaagaatggagagcctaaaaggactatcagctacatggc

SEQ ID NO: 6329 - protein, 73 aa, Zea mays
  misc_feature: Ceres CLONE 333122-F
  misc_feature: SWISSPROT Homolog: EC 2.7.11.1 Non-specific serine/threonine protein kinase
MAAMPGGAHGAGAADPMQVDQPLPPAAAGTAHAPADAKHAGSMIEGSDPVTGHIISTTIGGKNGEPKRTISYM

SEQ ID NO: 6330 - DNA, 457 bp, Zea mays
  misc_feature: Ceres CLONE 333129-F
ccaaatcccccgactcctcgcttcctcccgttccgtcgccgccgcgcgcctcggagaagagatagaggcggccgctgcatcgaccccgcgccacccccgcctgcctcccccggcaccgatcgggtttgatcgatggcgtcgacaaggcggccaaggaggaggagaagaaggatgcaggcggagccggaagcgaggagaagaaggacggcaaggaggaggaagagaagaaggacggcggcgagaagaatgaggagaagaaggacggcggcgacggagacggcgacaagaaggacgaggccggcgacaaggacaaggacccggccgccagcctgtacattcactacccgcggttcccgttcgctggagggtactaccagccgccggcctacccgccgcctccggggtacccgtacgcctaccagccggcatacccgccgccgttctacgcgccgccgca

SEQ ID NO: 6331 - DNA, 446 bp, Zea mays
  misc_feature: Ceres CLONE 333191-F
  misc_feature: Encodes the peptide sequence at SEQ ID NO. 6332
ataacacatctggtaagcgagcaccgagcagcaggtggtctcaacggtcgacgcgacaactttccttgtccatgcagcagatcactcgtcgtacgttccctatgctggctcctcctcggctccccctcgtcggggcgctcctgctgctcctcgccgtcgcgctcggcgcggtgccgtgcgagagcgccgcgctccgcctccgcggctccgtcgcctgcctcgactgcgacgaggaacacgatctctccggtgtggtcgtggcggtgaaatgcgccggcgacggcgacggcggcgcgggcctccacgcggcgcagaccgacgatcgcggcaacttcgacgtgaccgtgccagcagaagcgtcagctcgggcgcgccgtgcgcggccagggtcctcggcgccacggagcagctctgcgcgccgtggggactcacggtcgcgcgcgtcg

SEQ ID NO: 6332 - protein, 125 aa, Zea mays
  misc_feature: Ceres CLONE 333191-F
MQQITRRTFPMLAPPRLPLVGALLLLLAVALGAVPCESAALRLRGSVACLDCDEEHDLSGVVVAVKCAGDGDGGAGLHAAQTDDRGNFDVTVPAEASARARRARPGSSAPRSSSARRGDSRSRAS

SEQ ID NO: 6333 - DNA, 498 bp, Zea mays
  misc_feature: Ceres CLONE 333211-F
  misc_feature: Encodes the peptide sequence at SEQ ID NO. 6334
atactgtttggtttccatccctggcagatctcccactctctcgtcagatcctctcggctagctagctagctaggacagaggagggaggggaaggcgctggctatggcgactcggcggcggcggcggcggcggccatggaggagccggacgtcgtcaacggccgcgacgtggtgagctgggtggcgtccggggtggtgctgtggtcgaccgccttcttgctggtgcgggcgctgttccccaagcgctcctacgacttctgcaaccgcgccgtctccaccatgcacgccgtcgccgccgtgtgcctcgcctgcctctccgtcgacgactggtcgtgccccgtctgcccgctcgccgccgcatcctcccctcgccagatgaaggcgctggcggttacgctggcgtacatggtgtacgacgcggcgtgctgccacctcaacggcgacacgcggctggacaacgccgtgcaccacctggtcagcatcgtcggcatcggcgcgg

SEQ ID NO: 6334 - protein, 121 aa, Zea mays
  misc_feature: Ceres CLONE 333211-F
MEEPDVVNGRDVVSWVASGVVLWSTAFLLVRALFPKRSYDFCNRAVSTMHAVAAVCLACLSVDDWSCPVCPLAAASSPRQMKALAVTLAYMVYDAACCHLNGDTRLDNAVHHLVSIVGIGA

SEQ ID NO: 6335 - DNA, 421 bp, Zea mays
  misc_feature: Ceres CLONE 333213-F
  misc_feature: Encodes the peptide sequence at SEQ ID NO. 6336
aaccgcccccctcctttcaactcgctcgctcgctcgccttccatctttctccctctgtcggcagtctgcagcagcccagcgccgtcgcgcatgcaggaggcgtcatcggcggcggcggcgggggccgagcccggccgtcgggcggcgcagcatcagttcgccggcgtggacctccggcggcccaaggggtacgcgccgccggcgccggcggtgagcgagggggacccgtgcccgcggtgtgcgtcgcgggacaccaagttctgctactacaacaactacaacacctcccagccgcgccacttctgcaagggctgccgccgctactggaccaagggcggcacgctgcgcaacgtccccgtcggcggcggcacccgcaagaagccctccttgtcgtcgtcgtcgtcgtcgtcctacgcggccg

SEQ ID NO: 6336 - protein, 110 aa, Zea mays
  misc_feature: Ceres CLONE 333213-F
  misc_feature (40)..(102): Pfam Name: zf-Dof Pfam Description: Dof domain, zinc finger
MQEASSAAAAGAEPGRRAAQHQFAGVDLRRPKGYAPPAPAVSEGDPCPRCASRDTKFCYYNNYNTSQPRHFCKGCRRYWTKGGTLRNVPVGGGTRKKPSLSSSSSSSYAA

SEQ ID NO: 6337 - DNA, 415 bp, Zea mays
  misc_feature: Ceres CLONE 333226-F
  misc_feature: Encodes the peptide sequence at SEQ ID NO. 6338
ctttttttccgtttaaggcagcaagcaggagcagacaggaggcgccgagagcccagcgtcggagatctccgccgccatggagacgctggccagcgccatgcggcgcgagaaccgccggtccaaggccccgccctcctcctctgcttcctccgccctcgcctcgggcagggtccctctcgtcatggccttcctctcctgcctcgcctggctctacgtcgccggccgtttgtggcaggacgcgcagacccgggcgatcctgtccggcctcctcgagaagagctctaccagcgtcccgaaggtgctctcggtggaggacaagcttaggaaccttgggtgcaaggcgattggaaggaaaattgttgaggcggagatggacctgaccaaggccaagagcgaggggtacctgtgggggaac

SEQ ID NO: 6338 - protein, 113 aa, Zea mays
  misc_feature: Ceres CLONE 333226-F
METLASAMRRENRRSKAPPSSSASSALASGRVPLVMAFLSCLAWLYVAGRLWQDAQTRAILSGLLEKSSTSVPKVLSVEDKLRNLGCKAIGRKIVEAEMDLTKAKSEGYLWGN

SEQ ID NO: 6339 - DNA, 461 bp, Zea mays
  misc_feature: Ceres CLONE 333286-F
  misc_feature: Encodes the peptide sequence at SEQ ID NO. 6340
cagttcgttcgcgttgcccgcgactctctccgtcctcctactgcccacccgactcacacgcttggcacgcgcgtgcttccacccgtccgtcgcctctctctcggctgcctgattgatttggttgccccggttccagcaatggcggtccaggcgcattatcaccaccactaccaccgcgagtcccctttcctcgtcaggtacctgccgtggccgctgtgcatcttctaatcgtttcttccgcgtcgatcgtcggtctgctggatcgtattcggatgggtgatttgagcgtctgggttgtcagcggcgcgccggagggcagccggttggcggcggcgatggagctgcatcatcaggcgcagaaggaggctatggcgccgcagcaggctcaggctccgcccctcttcttggacttctcgcatggagattacggcggcgggaggaagcggcagcgcgaggcggag

SEQ ID NO: 6340 - protein, 63 aa, Zea mays
  misc_feature: Ceres CLONE 333286-F
MGDLSVWVVSGAPEGSRLAAAMELHHQAQKEAMAPQQAQAPPLFLDFSHGDYGGGRKRQREAE

SEQ ID NO: 6341 - DNA, 850 bp, Zea mays
  misc_feature: Ceres CLONE 333294-R2
  misc_feature: Pfam Name: NifU Pfam Description: NifU-like domain
  misc_feature: SWISSPROT Homolog: EC 3.1.3.16 Phosphoprotein phosphatase
acgatcagcgtgaattcagaaatatcaatcacaaggcgaatgttactgatgatttgacttccatagaacttggatcattggatgagttattgaaagcaatgagaactgttcttgaccttccttgggaaggctcaattttgatcccttgggatgggctgtggcctgacccttcctcgcagatgggtctttctctgaataaagaacaagacaatggattgctttggggtcctgatattacccagcaatttctgaggacaaatcatttgaagcgacgcacaggcgaattgatcatgtggaggtctggaagggtaatggaggtttatcaagggagcatttacaaaaggcctctaaaatctcaagctctaaatggtgcctcatcatcgggttaaggcgaatatggggcattgctcatcccaaatgcctctaacgctgatgagaatgatattcagggggatatatttgtctgcaaaacatgcaactgtgtccctattgaatgtgtagaatattgagcacatgaatgaggaagggctggagttcaattatataattgatgagctgcgtcctcattttgtggattggcggaaacagatctgactagccaaatttagtgaggaaccttccatgccattttgctctaggcagaaaccataactatcaagtttagcaacagtaatataataatgagcatgctgcaactgccctagcgcgacgacgactatgaatatggacatcgagcgcgtgctcaaggacaagttcggcgacgctttcatgaaatccatcgcgagttcgacgaggaccagccggcgacgaagaccacgtccgatgtcagtgcatcgactccgtcactgta

SEQ ID NO: 6342 - DNA, 907 bp, Zea mays
  misc_feature: Ceres CLONE 333294-R3
  misc_feature: SWISSPROT Homolog: EC 3.1.3.16 Phosphoprotein phosphatase
acgattgggtaccgggccccccctcgaggtcgacggtatcgatattttttttttttttttttctttttgaacagatcaagcggaacattcagaacatatcaatcacaaggcgaattttactgatgatttgacttccataaaacttggatcattggatgagttattgaaagcaatgagaactgttcttgaccttccttgggaaggctcaattttgatcccttgggatgtgctgtggtctgacccttcctcgcagatgggtctttctctgaataaagaacaagacaatggattgctttggggtcctgatattacccagcaatttctgaggacaaatcatttgaagcgacgcacaggcgaattgatcatgtggaggtctggaagtgtaatggtggtttatcaagggagcatttacaaaaggcctctaaaatctcaagctctaaatggtgcctcatcatcggtttaaggcgaatatggtgcattgttcatcccaaatgcctcgaacgctgttgagaatgatattcagggggatatatttgtctgcaaaacatgcaactgtgtccctattgaatgtgtagaatattgagcacatgaatgaggaagggctggagttcaattagataattgatgagctgggtcctcattttgtggattggtgggaacagagctgactagccaaatttagtgaggaaccttccatgccattttgctctaggtagaaaccagaactatcaagtttagcaacagtaatataataaggagcatgctgcaactgccctagcgcggtgacgacgatgaatatggacatcgagcgggtgctcaaggagaaagttcgcgacgctttcaaggaaatccatcgggtgttcgacggggaacagccggcgtcgggagaaacgtccgaagtcagtgg

SEQ ID NO: 6343 - DNA, 643 bp, Zea mays
  misc_feature: Ceres CLONE 333294-R
  misc_feature: SWISSPROT Homolog: EC 3.1.3.16 Phosphoprotein phosphatase
cgattgggtaccgggccccccctcgaggtcgacggtatcgatattttttttttttttttttctttttgaacagatcaagcggaacattcagaacatatcaatcacaaggcgaattttactgatgatttgacttccataaaacttggatcattggatgagttattgaaagcaatgagaactgttcttgaccttccttgggaaggctcaattttgatcccttgggatgtgctgtggtctgacccttcctcgcagatgggtctttctctgaataaagaacaagacaatggattgctttggggtcctgatattacccagcaatttctgaggacaaatcatttgaagcgacgcacaggcgaattgatcatgtggaggtctggaagtgtaatggtggtttatcaagggagcatttacaaaaggcctctaaaatctcaagctctaaatggtgcctcatcatcggtttaaggcgaatatggtgcattgttcatcccaaatgcctcgaacgctgttgagaatgatattcagggggatatatttgtctgcaaaacatgcaactgtgtccctattgaatgtgtagaatattgagcacatgaatgaggaagggctggagttcaattagataattgatgagctgggtcctcatttt

SEQ ID NO: 6344 - DNA, 309 bp, Zea mays
  misc_feature: Ceres CLONE 333325-F
  misc_feature: Translation starting site: 83
  misc_feature (115)..(115): n is a, c, t, g, unknown, or other
  misc_feature (118)..(118): n is a, c, t, g, unknown, or other
aatcacaattcacagcgctcragttctcgccccacagccaaatttttctccactcaatcgcggcataagctgcactgcagccatggacgcsagcggagccggtagcaaggcgaanaanggggcggctgggcrcaaggctggacggccccaggaagaagtcggtgtcgcggtccagtcaaggcmcgggctagcaagttccccgtcggccggatcgggcgctacctcaagaaggggcggtacgcgcagcgcgtgggcacyggcgccmcmgtctatctcgccgccgtgcttgagtacctcgccgccgaggtg

SEQ ID NO: 6345 - DNA, 501 bp, Zea mays
  misc_feature: Ceres CLONE 333402-F
  misc_feature: Encodes the peptide sequence at SEQ ID NO. 6346
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacggcggtgacgcagatggcgacggaggcgtccctgtcgtgcgtccgctcgtggggcggcgcgctctcgtccatcacccacctcgtgtacgtctcgtcgag

SEQ ID NO: 6346 - protein, 139 aa, Zea mays
  misc_feature: Ceres CLONE 333402-F
  misc_feature (10)..(139): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MVSSSMDTTSDKRASSMLAPNPGKATILALGHAFPQQLVMQDYVVDGFMKNTNCDDPELKEKLTRLCKTTTVRTRYVVMSDEILKNYPELAQEGLPTMNQRLDISNGGDADGDGGVPVVRPLVGRRALVHHPPRVRLVE

SEQ ID NO: 6347 - DNA, 471 bp, Zea mays
  misc_feature: Ceres CLONE 333491-F
  misc_feature: Translation starting site: 101
  misc_feature: SWISSPROT Homolog: EC 2.7.11.7 [Myosin heavy-chain] kinase
ataaaggcctggtctcccgctttgccccatttccctcgccatcctacgcctcgcgccgccgccacagcaacccttgcagccccaatcccccacggcgaccatggccggcgcgcaggagtccctctccctggtgggcacgatgcgcggccataacggcgaggtgacggcgatcgcgaccccgatcgacaactcgcctttcatcgtctcctcctcccgggacaagtccgtgctggtgtgggacctgaccaacccggtccactccaccccggaatccggcgtcaccgccgactacggcgtccccttccgccgcctcaccgggccactcccacttcgtccaggacgtcgtccttagttccgacggccagttcgcactctctggctcctgggacggcgagctccgcctttgggacctctccaccggcctcaccacccgccgcttcgtcggccacgagaaggacgtcatctccgtcg

SEQ ID NO: 6348 - DNA, 138 bp, Zea mays
  misc_feature: Ceres CLONE 333497-F
aagggaggaggactcgagggaagagatgggcaactgcggcacgcgggaggagaatgccgtcgtcgctgcgcacgcgcaagttcaacgagctccacttgttacaaaatcctgccaagaatgccattggagataggaagc

SEQ ID NO: 6349 - DNA, 417 bp, Zea mays
  misc_feature: Ceres CLONE 333512-F
  misc_feature: Encodes the peptide sequence at SEQ ID NO. 6350
  misc_feature (332)..(332): n is a, c, t, g, unknown, or other
  misc_feature (333)..(333): n is a, c, t, g, unknown, or other
ctcggatcttggaggccacgggccacccgggtgctgctgcctggcggcccgcggcgccatcattggcgtcctcttccaaggtctcggtgcaagtctacaccgtcccaagctcagctgctaccggccgtgaagcccgaggtcaaggtgttgcaccaatgatgcatgcgtctagcgtcgctggccatggcgggccgcgctgctgatctagaccccgtcaaggccaagatcgtctcccaccctagctaccaccgcctgctcgccgccttcttggactgccacaaggtcggctgcccgccggaagcgccgaggagatcgcggcggtggcgcgggannagggcgtggcagcgtgcagccgcgggckacgtcgcgcacacaaggccggacccggagctcgaccagttcatgggagtcctactg

SEQ ID NO: 6350 - protein, 78 aa, Zea mays
  misc_feature: Ceres CLONE 333512-F
  misc_feature (9)..(53): Pfam Name: KNOX1 Pfam Description: KNOX1 domain
  misc_feature (50)..(50): Xaa is any aa, unknown, or other
  misc_feature (60)..(60): Xaa is any aa, unknown, or other
MAGRAADLDPVKAKIVSHPSYHRLLAAFLDCHKVGCPPEAPRRSRRWRGXRAWQRAAAGXVAHTRPDPELDQFMGVLL

SEQ ID NO: 6351 - DNA, 509 bp, Zea mays
  misc_feature: Ceres CLONE 333514-F
  misc_feature: Encodes the peptide sequence at SEQ ID NO. 6352
  misc_feature (196)..(196): n is a, c, t, g, unknown, or other
  misc_feature (197)..(197): n is a, c, t, g, unknown, or other
  misc_feature (418)..(418): n is a, c, t, g, unknown, or other
aaacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctctcccttggccacgccttcccgcagcanntgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgaccgagnatggcgacggaggcgtccctgtcgtgcgtccgctcgtggggcggcgcgctctcgtccatcacccacctcgtgtacgtctcgtcgagcgagg

SEQ ID NO: 6352 - protein, 102 aa, Zea mays
  misc_feature: Ceres CLONE 333514-F
  misc_feature: SWISSPROT Homolog: EC 2.3.1.74 Naringenin-chalcone synthase
  misc_feature (73)..(73): Xaa is any aa, unknown, or other
MQDYVVDGFMKNTNCDDPELKEKLTRLCKTTTVRTRYVVMSDEILKNYPELAQEGLPTMNQRLDISNAAVTEXGDGGVPVVRPLVGRRALVHHPPRVRLVER

SEQ ID NO: 6353 - DNA, 358 bp, Zea mays
  misc_feature: Ceres CLONE 333578-F
  misc_feature: Encodes the peptide sequence at SEQ ID NO. 6354
  misc_feature (125)..(125): n is a, c, t, g, unknown, or other
gaggcccgcgctcacgagccagagaagggagaggagakgagaggctaaccaccgcggcasstgcgacctgcgaccgcgaggagtagcgcacgacgaccagcgcggaggaggtggagccgrcgggnggagatttgctcgcccggctggggttgtggtgggaggaggggaggaggcagagacaaccagcgatggcggcgtccgcgaggcctggggagagggcgaccagcttcgccgtcgcgtgcagcctcctcagccgcttcgtccgacagaacggcgccgcgcccgcccagctaggcctcgggatcawaggcgaggtcgagcagcaaatgacgccggcgacaattracttgctccccgg

SEQ ID NO: 6354 - protein, 56 aa, Zea mays
  misc_feature: Ceres CLONE 333578-F
  misc_feature (40)..(40): Xaa is any aa, unknown, or other
  misc_feature (53)..(53): Xaa is any aa, unknown, or other
MAASARPGERATSFAVACSLLSRFVRQNGAAPAQLGLGIXGEVEQQMTPATIXLLP

SEQ ID NO: 6355 - DNA, 476 bp, Zea mays
  misc_feature: Ceres CLONE 333579-F
  misc_feature: SWISSPROT Homolog: EC 1.1.1.219 Dihydrokaempferol 4-reductase
  misc_feature (208)..(208): n is a, c, t, g, unknown, or other
acctcgagtctgagagaatggctaacactgctaagggtaaggtctgtgtcacttgggccktctggtttcatcgcctcctggctcgtcaagcggcttcttgagtctgggtacatgtcctgggaacagtcagagacccagggaatggcaagaaagtagggcacctctggggcctggaassgcaaaggaaaggctgcagctcgtgagatantctcttggaggaagggagcttcgacgacgctgtgatggcttgcgagggcgtcttccacaccgcatcgcccgtcgtcaccggatctaattccaaggaggagatgcttgattcagcaataaacggcacgatgaacgtgctacgctcgtgcaagaaggaacccatcgctcaagagggttgtcctgacatcctcgtcgtcgacagtgaggatcaaggacgaaggccgacctgccccctaacgtgctgctggacgaatcgtcgtggagctcca

SEQ ID NO: 6356 - DNA, 485 bp, Zea mays
  misc_feature: Ceres CLONE 333580-F
  misc_feature: Encodes the peptide sequence at SEQ ID NO. 6357
  misc_feature (314)..(314): n is a, c, t, g, unknown, or other
acccccgcctcgccctccgtcgtctcagcgtatgttgtgcatgtgaagagagagaggaagagggtgacgagcgagaaaaaagctaatagagtgataggttgacaagacgcattgaagctaaggccacgcataccaaagcaacctcaccatcgctcgcaagctactcgatcaaggacattattgtcgcaacgagctagctaggatccgcgcgttagtttcgcgavssttggtacatatggctcgcatcctcgtgctggctctggtcaccatcgcgagcctcctcctgccgccggtcgtcgcgagccagcaggcgncggccaagtgcgagtacaaaagcactccggccaccgtacaggcacccggtgggcgtgcggaagatcgtggtggacgcgggcggcgcggcgatttcgtctccatccagcgcgccgtcgactccgtgccggagggcaacaccgtgcgcgtcgtcgtgcagatcaacgccggca

SEQ ID NO: 6357 - protein, 83 aa, Zea mays
  misc_feature: Ceres CLONE 333580-F
  misc_feature (27)..(27): Xaa is any aa, unknown, or other
MARILVLALVTIASLLLPPVVASQQAXAKCEYKSTPATVQAPGGRAEDRGGRGRRGDFVSIQRAVDSVPEGNTVRVVVQINAG

SEQ ID NO: 6358 - DNA, 500 bp, Zea mays
  misc_feature: Ceres CLONE 333615-F
  misc_feature: Encodes the peptide sequence at SEQ ID NO. 6359
  misc_feature (195)..(195): n is a, c, t, g, unknown, or other
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcycgcagcantgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacssagatggcgacggaggcgtccctgtcgtgcgtccgctcgtgggggcggcgcgctctcgtccatcacccacctcgtgtacgtctcgtcg

SEQ ID NO: 6359 - protein, 100 aa, Zea mays
  misc_feature: Ceres CLONE 333615-F
  misc_feature (1)..(99): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
  misc_feature (72)..(72): Xaa is any aa, unknown, or other
MQDYVVDGFMKNTNCDDPELKEKLTRLCKTTTVRTRYVVMSDEILKNYPELAQEGLPTMNQRLDISNAAVTXMATEASLSCVRSWGRRALVHHPPRVRLV

SEQ ID NO: 6360 - DNA, 511 bp, Zea mays
  misc_feature: Ceres CLONE 333739-F
  misc_feature: Encodes the peptide sequence at SEQ ID NO. 6361
accattgtattatggggtgcggtaggtttccgattccttctgcgcttttcacggtgccacccagcgtgcaacctaggcgagaaccgcctccccctccgctccttccagctcgctctgtaatctgcatcagcctcgcccgccgccgtcgccgccatggggaggggaaagttcaaggggaagcccacaggccgccgcaacttctccacacccgaggagatcgctgctggtacttcaggtcggccacgcacctttaagaagaaggaggaagaggaagatgaggaagaggtagaaagagaagagtctgaggaagaatctgaagaggattctgatgaaaagactaaacataaaggcactgagcgtattattcagattgaaaatccaaacttggtgaaagccaagaatataaaggccaaggaagttgattttggcaagacaactgaactctcaaggcgtgaaagagaggagcttgagaaacaaaaagctcatgaacgttatatgaagcttcaggagc

SEQ ID NO: 6361 - protein, 119 aa, Zea mays
  misc_feature: Ceres CLONE 333739-F
MGRGKFKGKPTGRRNFSTPEEIAAGTSGRPRTFKKKEEEEDEEEVEREESEEESEEDSDEKTKHKGTERIIQIENPNLVKAKNIKAKEVDFGKTTELSRREREELEKQKAHERYMKLQE

SEQ ID NO: 6362 - DNA, 510 bp, Zea mays
  misc_feature: Ceres CLONE 333801-F
  misc_feature: Encodes the peptide sequence at SEQ ID NO. 6363
acaaacctctcctggcacgagatcacgcttctcgtcggatcgaacagctagggtttccaagatgttcgggcgcgcgccgaagaagagcgacaacacacggtactacgagatcctcggggtctccaaggacgcgtcccaggatgacctcaagaaggcctaccgcaaggccgccatcaagaaccaccccgacaagggcggcgatcccgagaagttcaaggagctagctcaggcctatgaggtcctcagtgatcctgaaaagcgagagatttatgatcaatatggtgaggatgccctcaaggagggaatgggaggtggtggagggatgcacgatccctttgacatattccagtcattctttggtggtggaagcccttttggaggtggtggcagcagtaggggcagaaggcagcgaaggggagaggatgtggttcatcctctgaaggtttctctggaggatttgtacaatggcacatcgaagaagctctctctgtccgcagtgttctctgctcc

SEQ ID NO: 6363 - protein, 149 aa, Zea mays; identical to SEQ ID NO: 451
  misc_feature: Ceres CLONE 333801-F
  misc_feature (13)..(71): Pfam Name: DnaJ Pfam Description: DnaJ domain

SEQ ID NO: 6364 - DNA, 496 bp, Zea mays
  misc_feature: Ceres CLONE 333832-F
  misc_feature: Encodes the peptide sequence at SEQ ID NO. 6365
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggaggcgtccctgtcgtgcgtccgctcgtggggcggcgcgctctcgtccatcaccacctcgtgtacgtctc

SEQ ID NO: 6365 - protein, 137 aa, Zea mays
  misc_feature: Ceres CLONE 333832-F
  misc_feature (10)..(137): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MVSSSMDTTSDKRASSMLAPNPGKATILALGHAFPQQLVMQDYVVDGFMKNTNCDDPELKEKLTRLCKTTTVRTRYVVMSDEILKNYPELAQEGLPTMNQRLDISNAAVTQMATEASLSCVRSWGGALSSITTSCTS

SEQ ID NO: 6366 - DNA, 656 bp, Zea mays
  misc_feature: Ceres CLONE 333837-R
  misc_feature (335)..(335): n is a, c, t, g, unknown, or other
  misc_feature (381)..(381): n is a, c, t, g, unknown, or other
  misc_feature (384)..(384): n is a, c, t, g, unknown, or other
  misc_feature (400)..(400): n is a, c, t, g, unknown, or other
  misc_feature (402)..(402): n is a, c, t, g, unknown, or other
  misc_feature (404)..(404): n is a, c, t, g, unknown, or other
  misc_feature (416)..(416): n is a, c, t, g, unknown, or other
  misc_feature (417)..(417): n is a, c, t, g, unknown, or other
  misc_feature (426)..(426): n is a, c, t, g, unknown, or other
  misc_feature (434)..(434): n is a, c, t, g, unknown, or other
  misc_feature (436)..(436): n is a, c, t, g, unknown, or other
  misc_feature (443)..(443): n is a, c, t, g, unknown, or other
  misc_feature (460)..(460): n is a, c, t, g, unknown, or other
  misc_feature (485)..(485): n is a, c, t, g, unknown, or other
  misc_feature (486)..(486): n is a, c, t, g, unknown, or other
  misc_feature (493)..(493): n is a, c, t, g, unknown, or other
  misc_feature (511)..(511): n is a, c, t, g, unknown, or other
  misc_feature (519)..(519): n is a, c, t, g, unknown, or other
  misc_feature (525)..(525): n is a, c, t, g, unknown, or other
  misc_feature (527)..(527): n is a, c, t, g, unknown, or other
  misc_feature (535)..(535): n is a, c, t, g, unknown, or other
cgattggtgaccgggccccccctcgaggtcgacggtatcgataagcttttttttttttttttttggtttttttttttttttttttttttttttggaaaattcttccttattcattacgaaaacctcctgatgaacgaggagtccgacaaataaatatgataccgtgatcacgcaaagcaaaatccgatacatacacaccccatggaaatactcaacagtgaagtgatgaaggaacctgggttgtctacacccggagagaaatttacaaagcatttatgggggggggggcagcagcagtagcagaagcaagcgacgtgggggggggggcggcgacnggggccgacaaacaaaaaggggcgggcggggggttggggggggtanacnaaggggtggttttccngncncttggggaagtnnttaagggcnaaagcaancnagtgtcnagcgtggggatcatggntggctgggaaaccccccccctggtnntttggtnttgggcttggtgccgtcntggtcccnagaaangngcgtaaancattgggggcgccttcgccttaaaccaggggtggttgttgggaacccctgggtgcctttaaaaaccacctgtggcccgcacaccccccttgggagttgtgacaacagggcgcaggtggccg

SEQ ID NO: 6367 - DNA, 421 bp, Zea mays
  misc_feature: Ceres CLONE 333868-F
  misc_feature: Encodes the peptide sequence at SEQ ID NO. 6368
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatgg

SEQ ID NO: 6368 - protein, 112 aa, Zea mays
  misc_feature: Ceres CLONE 333868-F
  misc_feature (10)..(112): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MVSSSMDTTSDKRASSMLAPNPGKATILALGHAFPQQLVMQDYVVDGFMKNTNCDDPELKEKLTRLCKTTTVRTRYVVMSDEILKNYPELAQEGLPTMNQRLDISNAAVTQM

SEQ ID NO: 6369 - DNA, 392 bp, Zea mays
  misc_feature: Ceres CLONE 333883-F
  misc_feature: Translation starting site: 77
acacagacacacacatatccgtcaaagaaacaagtgcacacaaataaatacatcgctcactagattgccaagagcaatggcctctaggtcatccatcctgctcgtcacggtggcgctggctacgctattcacggtcggttcgtgcaccaccccgctcaccttccatgtcggtaagggctccaagcccggccacttagtcctcacccgccaacgttgccaccatctctgacgtggagatcaaggagcacggtggcgacgacttctcctttacgctcaaggagggtccgactggcacctggacgcttgacaccaagaccccactcaagtaccccctctgcatccgcttcgccgtcaagtccggtggctaccagcatcgccgacgatgtcatccc

SEQ ID NO: 6370 - DNA, 389 bp, Zea mays
  misc_feature: Ceres CLONE 333887-F
  misc_feature: Encodes the peptide sequence at SEQ ID NO. 6371
aaccactcgcattcgtcactcgtccctctcccctctctcccccaaggccccaacccacttgagcgagccctagagaaggcaaaagccatggcgtccttggttgttcgtgccgccggcgccgccgccgccgccgcccgtcttccctccctccgtcctcgccgcaacggcagcggggtgctctccggcttgagggtcggaacagggcactacggcgcgcggctcgcgcttgcttcgtccacagcttctcacaaagagttcaagatcgcctgccttactgtcgatgacagcagtttgggcccgggggatgaatatgagtctgacccccgcatgccaggcgaggatgagttcgaccatttctaccgtgttctcgccaagaagactgacaacct

SEQ ID NO: 6371 - protein, 100 aa, Zea mays
  misc_feature: Ceres CLONE 333887-F
MASLVVRAAGAAAAAARLPSLRPRRNGSGVLSGLRVGTGHYGARLALASSTASHKEFKIACLTVDDSSLGPGDEYESDPRMPGEDEFDHFYRVLAKKTDN

SEQ ID NO: 6372 - DNA, 676 bp, Zea mays
  misc_feature: Ceres CLONE 333890-R
  misc_feature (401)..(401): n is a, c, t, g, unknown, or other
  misc_feature (433)..(433): n is a, c, t, g, unknown, or other
  misc_feature (459)..(459): n is a, c, t, g, unknown, or other
tcgaggtcgacggtatcgataagcttttttttttttttttttaaagactacacagttaatcagtataccacagtcatagatccatcacataaacacaaaagcaccacaattatatattcacaaaagcatcacaattataatatcattcacaacgttgcaaatttctcttttggagaaaatacaaaacaaaatatctagctgcatccatccaaaagaacttttgatctttcttgttgtagcatccataggcaccaccgtgatctgcttgctattgtcatcatggagtaaacaagtgacttactacctctaggaactccctcccaagtcgccctcctcatgtactggttccaggaaacactcccctggttttttggccaccaccaactggctttttttttgancaaatgggtccaccaattttacgcccctttanaagggatggttcacatttcccttttntaaaaatatttaacattgggggcccgagcgcactttaaaaaaaaaaattgggcccttttggaaaaatcataaaaattggtaaatcctttgggaaaaaaaattaatcaacgttaaaaattggtgtctgttaagggcgtgcaatttctcccccccccccagaggagggggccccgccgcgcctctctcctcctccgcccgggcacaaaaaaaaagcaac

SEQ ID NO: 6373 - DNA, 264 bp, Zea mays
  misc_feature: Ceres CLONE 333918-F
  misc_feature: Encodes the peptide sequence at SEQ ID NO. 6374
  misc_feature (33)..(33): n is a, c, t, g, unknown, or other
aagcacacaaagaaacacacacacacaacattnsmttttcatcgagtgcaatggcatccaacaagtccatagcgctccttgtcctagccttggcactcatgttaacggtttcagtgcatggacagttatcgtcttcgtcgccgacgcctgcaccctctcctgctcctgcagccccaacaccgacaccatcaccatcccctgcatcagcaccagcgccgactcctgctccggcaccatcccaaaaccgatgccccctggcttccc

SEQ ID NO: 6374 - protein, 71 aa, Zea mays
  misc_feature: Ceres CLONE 333918-F
MASNKSIALLVLALALMLTVSVHGQLSSSSPTPAPSPAPAAPTPTPSPSPASAPAPTPAPAPSQNRCPLAS

SEQ ID NO: 6375 - DNA, 517 bp, Zea mays
  misc_feature: Ceres CLONE 333953-F
  misc_feature: Encodes the peptide sequence at SEQ ID NO. 6376
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggaggcgtcccttgtsgtgcgtccgctcgtggggcggcgcgctctcgtccatcacccacctcgtgtacgtctcgtcgagcgaggcgcgcttc

SEQ ID NO: 6376 - protein, 144 aa, Zea mays
  misc_feature: Ceres CLONE 333953-F
  misc_feature (10)..(143): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MVSSSMDTTSDKRASSMLAPNPGKATILALGHAFPQQLVMQDYVVDGFMKNTNCDDPELKEKLTRLCKTTTVRTRYVVMSDEILKNYPELAQEGLPTMNQRLDISNAAVTQMATEASLVVRPLVGRRALVHHPPRVRLVERGAL

SEQ ID NO: 6377 - DNA, 472 bp, Zea mays
  misc_feature: Ceres CLONE 333959-F
  misc_feature: Encodes the peptide sequence at SEQ ID NO. 6378
acagcacaagaacactcctagctagctgaagatctcgagtgcaacgcaacgttggcgcttggcggccagtagtagcagctaatttagcgtcgctccttcctagacgagagatcgagaaaccatggccaagctccaagtcactcctggcgccgcgttcaccgagtgcaatgaactcaacttccagggcctgtacctgtaccacacgcccctgggccccaaggccaaccaagctgcgatcgtagagagcaaggccaagatcggcatcggtgccaccgtggttaacaactgggcagtgtatgacgggccagggccaggcgctaagctcgtcggccgtgcgcagggcttgcacatcctagccggcaactgggtcaactcattcaccctggtgttcgaggatgaaaggttcagtgggtccacgcttgaagtgaggggcataacggttgaaactggcgagtgggctgttgttgggggc

SEQ ID NO: 6378 - protein, 117 aa, Zea mays
  misc_feature: Ceres CLONE 333959-F
  misc_feature (2)..(117): Pfam Name: Dirigent Pfam Description: Dirigent-like protein
MAKLQVTPGAAFTECNELNFQGLYLYHTPLGPKANQAAIVESKAKIGIGATVVNNWAVYDGPGPGAKLVGRAQGLHILAGNWVNSFTLVFEDERFSGSTLEVRGITVETGEWAVVGG

SEQ ID NO: 6379 - DNA, 496 bp, Zea mays
  misc_feature: Ceres CLONE 334031-F
  misc_feature: Encodes the peptide sequence at SEQ ID NO. 6380
gaatctctctctacataaacaaaaaccagtcctttgttcttcttcccccggcacgcccagcgccagtcaccaaccttccactccctccctccgtcgccatggcgcgcaagaagatccgggagtacgactccaagcgcctcctcagggagcacctcaagcgcctcgccggcatcgacctcaccatcctctccgcccagatcacgcaatcaacggacttcgcggagcttgtgagccagcagccatggctgtcaaccatgaagctagtggtgaagcctgatatgctgttcgggaagcgtgggaagagcggcctcgtggctctcaacttggatttcaatcaagtcaaggagtttgtcaaggagcggctgggggttgaggttgagatgggtggctgcaaggctccaatcacgaccttcatcgtcgagccatttgtgccacatgatcaagagtactacctttcgattgtctcagagaggttgggcagcaccatcagcttctc

SEQ ID NO: 6380 - protein, 132 aa, Zea mays
  misc_feature: Ceres CLONE 334031-F
  misc_feature: SWISSPROT Homolog: EC 2.3.3.8 ATP citrate synthase
MARKKIREYDSKRLLREHLKRLAGIDLTILSAQITQSTDFAELVSQQPWLSTMKLVVKPDMLFGKRGKSGLVALNLDFNQVKEFVKERLGVEVEMGGCKAPITTFIVEPFVPHDQEYYLSIVSERLGSTISF

SEQ ID NO: 6381 - DNA, 478 bp, Zea mays
  misc_feature: Ceres CLONE 334069-F
  misc_feature: Encodes the peptide sequence at SEQ ID NO. 6382
  misc_feature (430)..(430): n is a, c, t, g, unknown, or other
aacaaacctctcctggcacgagatcacgcttctcgttggatcgaacagctagggtttccaagatgttcgggcgcgcgccgaagaagagcgacaacacacggtactacgagatcctcggggtctccaaggacgcgtcccaggatgacctcaagaaagcctaccgcaaggccgccatcaagaaccaccccgacaagggcggcgatcccgagaagttcaaggagctagctcaggcttatgaggtcctcagtgatcctgaaaagcgggagatttatgatcaatatggtgaggatgccctcaaggagggaatggggaggtggtggagggatgcacgatccctttgacatattccagtcattctttggtggtggaagcccttttggaggtggtggcagcagtaggggcagaaggcagcgaaggggagaggatgtgnttcatcctctaaaggtttctctggaggatttgtacaatggcacatcaa

SEQ ID NO: 6382 - protein, 92 aa, Zea mays
  misc_feature: Ceres CLONE 334069-F
  misc_feature (13)..(71): Pfam Name: DnaJ Pfam Description: DnaJ domain
MFGRAPKKSDNTRYYEILGVSKDASQDDLKKAYRKAAIKNHPDKGGDPEKFKELAQAYEVLSDPEKREIYDQYGEDALKEGMGRWWRDARSL

SEQ ID NO: 6383 - DNA, 496 bp, Zea mays
  misc_feature: Ceres CLONE 334079-F
  misc_feature: Translation starting site: 237
acccccgcctcgccctccgtcgtctcagcgtatgttgtgcatgtgaagagagagaggaagagggtgacgagcgagaaaaaagctaatagagtgataggttgacaagacgcattgaagctaaggccacgcataccaaagcaacctcaccatcgctcgcaagctactcgatcaaggacattattgtcgcaacgagctagctaggatccgcgcgttagtttcgcgaagcggtggtacatatggctcgcatcctcgtgctggctctggtcaccatcgcgagcctcctcctgccgccggtcgtcgcgagccagcaggcggcggccaagtgcgagtacaaaagcactccggccaccggtacaggcacccggtgggcgtgcggaagatcgtggtggacgcgggcggcgccggcgatttcgtctccatccagcgcgccgtcgactccgtgccggagggcaacaccgtgcgcgtcgtcgtgcagatcaacgccggcacgtacath

SEQ ID NO: 6384 - DNA, 490 bp, Zea mays
  misc_feature: Ceres CLONE 334169-F
  misc_feature: Encodes the peptide sequence at SEQ ID NO. 6385
actccactccgccgcccggattcagagcgacagcgagaggaggcggagagggcggacatggcggcgatgttggtgggcgcgctgcggaggggaagtggatgccgcggcggcttgcgccttatcgctcattcgcttcgcagattcgtgagcacgctcgtcgtagcggagcacgaaggcgggttcgtcaagccgtcgtcgctgagcgcattggccgccgcggaggcaattgccaaggacaacaaagtttctgtcctgctgggtggttccgggccggcgcttcacaaggccgccgaccatgccgcgtgctgccatccactggtgtctgaggtgctcgtggccgattccgaagccttggcgcatcctctggctgaaccctgggccgagctactccgttccgttcagcagaaaggatgctactctcatgtcatagcttcatccacatcattcgggaagaatttgcttccacgtgctgcggctctccttgatgtgt

SEQ ID NO: 6385 - protein, 144 aa, Zea mays
  misc_feature: Ceres CLONE 334169-F
MAAMLVGALRRGSGCRGGLRLIAHSLRRFVSTLVVAEHEGGFVKPSSLSALAAAEAIAKDNKVSVLLGGSGPALHKAADHAACCHPLVSEVLVADSEALAHPLAEPWAELLRSVQQKGCYSHVIASSTSFGKNLLPRAAALLDV

SEQ ID NO: 6386 - DNA, 518 bp, Zea mays
  misc_feature: Ceres CLONE 334181-F
  misc_feature: Encodes the peptide sequence at SEQ ID NO. 6387
ctcgtgctctctcagaggtgggctggcttctcctccccctcttaccaagtcctcctcgggttagggttccttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggcggtcgcggcggcggcggctatggtggcgggcgccgtgacggcggttatggcggcggtggcggctacggcggtcggcgcgagggtggtggcggcggctacggaggcggtggcggcaaccgattctggaagagca

SEQ ID NO: 6387 - protein, 142 aa, Zea mays
  misc_feature: Ceres CLONE 334181-F
  misc_feature (10)..(81): Pfam Name: RRM_1 Pfam Description: RNA recognition motif. (a.k.a. RRM, RBD, or RNP domain)
  misc_feature (48)..(135): Pfam Name: GRP Pfam Description: Glycine rich protein family
  misc_feature: SWISSPROT Homolog: EC 5.2.1.8 Peptidylprolyl isomerase
MAAADVEYRCFVGGLAWATSNESLENAFASYGEILDSKVITDRETGRSRGFGFVTFSSENSMLDAIENMNGKELDGRNITVNQAQSRGGGGGGGGYGGGRGGGGYGGGRRDGGYGGGGGYGGRREGGGGGYGGGGGNRFWKS

SEQ ID NO: 6388 - DNA, 532 bp, Zea mays
  misc_feature: Ceres CLONE 334219-F
  misc_feature: Encodes the peptide sequence at SEQ ID NO. 6389
ttcaacctctagctgattgatctctggtttaccactctttccttccctccttcaattctaaataccacaaatcaaagttgctttgcgagtggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggaggcgtccctgtcgtgcgtccgctcgtggggcggcgcgctctcgtccatcacccacctcgtgtacgtctcgtcgagcgaggcgcgcttcccgggcggcgac

SEQ ID NO: 6389 - protein, 143 aa, Zea mays
  misc_feature: Ceres CLONE 334219-F
  misc_feature (5)..(143): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MDTTSDKRASSMLAPNPGKATILALGHAFPQQLVMQDYVVDGFMKNTNCDDPELKEKLTRLCKTTTVRTRYVVMSDEILKNYPELAQEGLPTMNQRLDISNAAVTQMATEASLSCVRSWGGALSSITHLVYVSSSEARFPGGD

SEQ ID NO: 6390 - DNA, 499 bp, Zea mays
  misc_feature: Ceres CLONE 334222-F
  misc_feature: Encodes the peptide sequence at SEQ ID NO. 6391
gtctctaggcaagtctacacccgccggtctcctcctctccagatctgcccatccgccatggcgcctccaccgcaccgccacctgctgctcctcctctttctcctccctctggtcctcctcgctggcacacccgccggcgccgatgaccttgtatcggagctccaatctctccgcgcgcggtccccgtccggcgtgatccacctcaccgacacctccgtcacccgtttcctctccgccccctccgcgcgccgcccctactccgtgctcgtattcttcgacgccgcttcgctccactcaaagcctgacctccacctgccccagctccgcaccgagttcgcgctcctctccgcctccttcctcgctcacaaccccgattctggcgacctcttcttcgccgacatcgagttcgccgagtcgcagcactcctttcassagtttggtgtcaactcgctgccccattatcgcctcatccgttccgatcacgccaccctgtcgggat

SEQ ID NO: 6391 - protein, 147 aa, Zea mays
  misc_feature: Ceres CLONE 334222-F
  misc_feature (125)..(125): Xaa is any aa, unknown, or other
  misc_feature (126)..(126): Xaa is any aa, unknown, or other
MAPPPHRHLLLLLFLLPLVLLAGTPAGADDLVSELQSLRARSPSGVIHLTDTSVTRFLSAPSARRPYSVLVFFDAASLHSKPDLHLPQLRTEFALLSASFLAHNPDSGDLFFADIEFAESQHSFXXFGVNSLPHYRLIRSDHATLSG

SEQ ID NO: 6392 - DNA, 496 bp, Zea mays
  misc_feature: Ceres CLONE 334228-F
  misc_feature: Translation starting site: 87
  misc_feature (439)..(439): n is a, c, t, g, unknown, or other
cttcccttctgtcgctgctcccacsgtctagcccgacaggtgaagccgccgcgctgcagtgtccatagcchccgcaggagactgagatggggggttttgtcaagacccacaagagcaatgcatacttchrgcgtttccaggtgaagttcaagagaaggcgcgcyggcaagacagactacagggccaggataaggctgattaaccaagacaaaaacaagtacaatacacccaaatacagatttgttgtgcgatttaccaacaaggacatcacagcacaaatcatatctgctagtatagcaggtgatatggytcttgctytgcttactcgcatgagttgccacgatatggtctcgaagttggtctgascaactagtgcagctgcctactgcactggccttctgttggctckyccgtgtgctcaagacccgtggtttagatnaggaatatgagggcaatgktgaggccactggtgaggacttctctgttgagccagctg

SEQ ID NO: 6393 - DNA, 455 bp, Zea mays
  misc_feature: Ceres CLONE 334282-F
  misc_feature: Encodes the peptide sequence at SEQ ID NO. 6394
acaaacctctcctggcacgagatcacgcttctcgtcggatcgaacagctagggtttccaagatgttcgggcgcgcgccgaagaagagcgacaacacacggtactacgagatcctcggggtctccaaggacgcgtcccaggatgacctcaagaaggcctaccgcaaggccgccatcaagaaccaccccgacaagggcggcgatcccgagaagttcaaggagctagctcaggcctatgaggtcctcagtgatcctgaaaagcgagagatttatgatcaatatagtgaggatgccctcaaggagggaatgggaggtggtggagggatgcacgatccctttgacatattccagtcattctttggtggtggaagccttttggaggtggtggcagcagtaggggcagaaggcagcgaaggggagaggatgtggttcatcctctgaaggtttctctggagga

SEQ ID NO: 6394 - protein, 125 aa, Zea mays
  misc_feature: Ceres CLONE 334282-F
  misc_feature (13)..(71): Pfam Name: DnaJ Pfam Description: DnaJ domain
MFGRAPKKSDNTRYYEILGVSKDASQDDLKKAYRKAAIKNHPDKGGDPEKFKELAQAYEVLSDPEKREIYDQYSEDALKEGMGGGGGMHDPFDIFQSFFGGGSLLEVVAAVGAEGSEGERMWFIL

SEQ ID NO: 6395 - DNA, 498 bp, Zea mays
  misc_feature: Ceres CLONE 334294-F
accaccagtagtcctactggtccttgacgtccgtggccactcaggttgtgttctctgagttctttcgccgggtggggaggcggagtgcgcggtcgaggaaggcccccttagcggtcggatcgatcggcgccgtgcttgactgcctgtacatgaggatcggctgcggcggcggcggcggagggagacaacctggggaaggaggcgggggaggcgctggggctgctgggctgcgtcaatgaggtggtggcggcggtggcggccacgtgggggcccatgaccgacggcgcgcgcgtcgagacggcgcccaggctcgcccaatggcgcgtcgacccgctcccctgctacacctaccgcaagtcactccccttcctcatcggcctctggaactggtgcatatctgtggagagaaataacaagcaaacctgtgttaagctctttgcagagaatacaagttctctcaagaacggttcctcagccccaatagcttcctttatcgcc

SEQ ID NO: 6396 - DNA, 516 bp, Zea mays; identical to SEQ ID NO: 6069
  misc_feature: Ceres CLONE 334326-F
  misc_feature: Encodes the peptide sequence at SEQ ID NO. 6397

SEQ ID NO: 6397 - protein, 144 aa, Zea mays; identical to SEQ ID NO: 6070
  misc_feature: Ceres CLONE 334326-F
  misc_feature (10)..(144): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase

SEQ ID NO: 6398 - DNA, 509 bp, Zea mays
  misc_feature: Ceres CLONE 334334-F
  misc_feature: Encodes the peptide sequence at SEQ ID NO. 6399
gacgattccgatcccctcccgtcccgtccatcccgtctcggtctcgccctccacgccggcgaccggagaaggggccgtgcagcgcaggcgacgcccacaacgaatccgtccccccgcgccggcttcgcccagccccgcggcgacgcgccaggattgaaggaggcatgaaaaggtggacatcgttgctatagccatttgattactggaaatggtgttggtggtaaagcagcaccgctgcacacactctgcgagctgcgtttgcatcaagggccacctcagtgaggatgctctgttcctcgtcttccgccacatgaactggaacccgaggctgattgctatcttgtcgtgtgtgtgcaagtggtttgatgaggttgccaagcaggtgctgtggaaggagttctgtcatgcaagggctccaaagatgatgctggatttgcattcaggtggcagccacattgttgatgggaactggaaggcattggggaagctgctcatctatttgcaatggc

SEQ ID NO: 6399 - protein, 100 aa, Zea mays
  misc_feature: Ceres CLONE 334334-F
MVLVVKQHRCTHSASCVCIKGHLSEDALFLVFRHMNWNPRLIAILSCVCKWFDEVAKQVLWKEFCHARAPKMMLDLHSGGSHIVDGNWKALGKLLIYLQW

SEQ ID NO: 6400 - DNA, 729 bp, Zea mays
  misc_feature: Ceres CLONE 334385-R
caattgggtaccgggccccccctcgaggtcgacggtatcgataagcttttttttttttttttttgtgagagaaacagattatttctactgtcacttgccagtcagtctttgcagaaatttacaagtattgggaatgtacatgcttggtagtacgtgactgcacatctgaacctgttcctggatcaagattcaagacaccaaataaaacttggcaacagactaatgatcagcagcaagcagcaacgccgaatcaggtcagaactcgtcatgggacatcacgaaaggactgcgaatgctgtccaagcagccgcaacgagcgggaggagaagcgaaggcgacagccgcggggaggcggcgttgggcagccacgggtaggcgtccggcggcggcatcacgcagttgtctccgttgaagtagactcgcctggggaaggcccatcctttgtggaaggtgaacgtggacggctccttccggaacagaagctcggactgcacgttcccgtctggcccggccgtcatgagcagatcgttgtagtacttgatgccccatagcatcgccgtgtcgttgatcactccgtaagggttgagaggtctgtaattgaagctgaaaatggtggtgaggttgtcgaacttggggtgctgcgcgaccaggttccactgcgagtagttcatccggtagttgaagttggtgaccgtgatcttcaccctccagtactccttgtagctgacc

SEQ ID NO: 6401 - DNA, 250 bp, Zea mays
  misc_feature: Ceres CLONE 334436-F
acagtacacacacggaacggaatccgggcatccgggaaagcagccctaatctcaaggccgcggctgcgagcgctgcttcccacctcccaactccggaactcctccccagttgccgccagccgcgcgcacacccaccgagagctcgggctttctttctccgttcctccctcgcgcgctcagggtttcacgatggaggccgaggcggcggccaagagssgcgcgggagggcggggaggacgccaccgcgccg

SEQ ID NO: 6402 - DNA, 440 bp, Zea mays
  misc_feature: Ceres CLONE 334479-F
  misc_feature: Translation starting site: 65
  misc_feature (196)..(196): n is a, c, t, g, unknown, or other
atctcaagccaccatcgaccttcaagtctcgctacgtagcagtgcaataaaaaaagcagccgcaatggcgagcagcaccatggccctctcctccacggccttcgcsggcaaggccgtgaacgtgccgtcgtcgtccgccttcggsagcccgcgtgacgatgcgcaagacggcggggaaggccaagccgggcgssgncgtccgggagcccgtggtacgccccgaccgcgtgctgtacctgggcccactgtccggcgagccgcsagctacctgacgggcgagttcccgggcgactacggctgggacaccgcggggctgtcgggcggacccggagacgttcgccaagaaccgggagctggaggtgatccactcccgctgggccatgctggggcgcgctcggctgcgtcttccccggagctgctcgcccgcaacggcgtcaagt

SEQ ID NO: 6403 - DNA, 475 bp, Zea mays
  misc_feature: Ceres CLONE 334525-F
  misc_feature: Encodes the peptide sequence at SEQ ID NO. 6404
atatccaggaataaactgctcgtctcatcgaccgatggtggtgcccggcgtagtcatgggagagaagagcctcggaccgtggaggattagcaccgttgccgtctcggtcgctctagagaaaagcagcggacgtgtgcctccatattcatagccgccgtgcatggattacgagtgacgcgatggtctcacaactgggcaatttcttaccggaatttgagcgtggacgcattgccgctgcactgcatggcgagcgatttagcaacttcaaactctggtcaagagcaggtaccacaggatgaggcgcatggaggatgctgtgatgagttcgtgagtggtctaggccgtcgtctcccagtcaactttgggttgctggaccgttgtctccttataatgtaattatttatttattttgtatagaactcctattatatagtaaagttgtgacattcgatcctaaaaaaaaaaaaaaaaaagc

SEQ ID NO: 6404 - protein, 50 aa, Zea mays
  misc_feature: Ceres CLONE 334525-F
MASDLATSNSGQEQVPQDEAHGGCCDEFVSGLGRRLPVNFGLLDRCLLIM

SEQ ID NO: 6405 - DNA, 472 bp, Zea mays
  misc_feature: Ceres CLONE 334554-F
  misc_feature: Encodes the peptide sequence at SEQ ID NO. 6406
attcaacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggaggcgtccctgtcgtgcgtccgctcgtggggcggcgcgctc

SEQ ID NO: 6406 - protein, 128 aa, Zea mays; identical to SEQ ID NO: 5592
  misc_feature: Ceres CLONE 334554-F
  misc_feature (10)..(128): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase

SEQ ID NO: 6407 - DNA, 518 bp, Zea mays
  misc_feature: Ceres CLONE 334588-F
  misc_feature: Encodes the peptide sequence at SEQ ID NO. 6408
ataggctgtcaatacaacttggtaggtttgctgcaactttctcatgactgcccatgcatgcatgcagatatatgcatacatatcatacaacaaaatacaaaactgaaccagcaacaaaccgatgcccatgagattgacatggtgatcgagctacagcaggccgccggtcttctccaacgctagacaacgaagaaggagcaattaatcaagtagatcgattcaatccaatccaatggggttgctgataccagcccgtccggagcaatgcacgttgagccgtgtcgtgtctctcatcaccgtcggtgtcgtcatcgtggtttgcacgtacgtcacatcttctccggccggtggcgacgccgggaaggaggagttcttcagcatatggcaccgtcgatcatcggattttgtccccgacgatctggaggtggcgctgcgcggcgcagcgtacgcgaacaggacgctgatcctgaccatgctgaacaaggcttattcggaggarggcggctgctcgacctctt

SEQ ID NO: 6408 - protein, 95 aa, Zea mays
  misc_feature: Ceres CLONE 334588-F
MGLLIPARPEQCTLSRVVSLITVGVVIVVCTYVTSSPAGGDAGKEEFFSIWHRRSSDFVPDDLEVALRGAAYANRTLILTMLNKAYSEEGGCSTS

SEQ ID NO: 6409 - DNA, 488 bp, Zea mays
  misc_feature: Ceres CLONE 334592-F
  misc_feature: Encodes the peptide sequence at SEQ ID NO. 6410
atctctctctgcgttcctggtgctcggccatggcggactaccacttcgtgtacaaggacgttgagggggcgagcacgcagtgggacgacatccagcgccgcctcgggaacctgcccccgaagtcggagcccttcaagccgccgcccttcgcccccaaggtcgacgccggcgagcagcccaagtccaaggaatggctcgacgagcgcgaggccgaagagctcgaggaactcgaggacgaccttgatgacgaccgcttcctcgagcagtacaggaagatgaggcttgccgagctgagggaggccgcaaaagccgcgcgatttggtagtatagttcccatcactggctcggacttcgtgcgggaggtgtctcaggcaccatcagaagtttgggttgtggtcttcctctacaaggatggaattgtttggaggaattggctacaagatacccagcgacaaagtttgttaaaaattatctccacggactgcatc

SEQ ID NO: 6410 - protein, 153 aa, Zea mays
  misc_feature: Ceres CLONE 334592-F
MADYHFVYKDVEGASTQWDDIQRRLGNLPPKSEPFKPPPFAPKVDAGEQPKSKEWLDEREAEELEELEDDLDDDRFLEQYRKMRLAELREAAKAARFGSIVPITGSDFVREVSQAPSEVWVVVFLYKDGIVWRNWLQDTQRQSLLKIISTDCI

SEQ ID NO: 6411 - DNA, 484 bp, Zea mays
  misc_feature: Ceres CLONE 334617-F
  misc_feature: Encodes the peptide sequence at SEQ ID NO. 6412
ctcgaaccatagatgatttggcagagatgtcttctgccggcatcagcggatgcgtgcctacaactgtaaacataagttgtttcttattttcttgcgtaaatcgcaacgttggaattttcaatcttgctgctggttgaagttcttcaggaattctcactagcctttttctcctctttttttttgacatgttttacttcttgtctattcaggaacaccatatacaaacgaatcatggacctgtatctgttgcagtgtatggtgaccatgacaagcctgcccttgttacttaccccgatattgctttaaactatatgtcctgcttccaaggactattgttctgtcccgaagccgcttcgctgctgcttcataatttttgcatttaccatattagccccccaggacatgagttaggagctgctccaatttcaccaaatgctcctataccgtctgttgacgatttggcagatcaggttgcggatgtcct

SEQ ID NO: 6412 - protein, 44 aa, Zea mays
  misc_feature: Ceres CLONE 334617-F
RTIDDLAEMSSAGISGCVPTTVNISCFLFSCVNRNVGIFNLAAG

SEQ ID NO: 6413 - DNA, 454 bp, Zea mays
  misc_feature: Ceres CLONE 334634-F
  misc_feature: Translation starting site: 297
  misc_feature: Pfam Name: eIF-1a Pfam Description: Translation initiation factor 1A / IF-1
aaaaaggcaacgacccaagtcccaacggaacttagctgccgagcgcccaaagccccaccgccgctcccatcaagcggcgctaaaggtttcctcgcccgcaacgcgatgccgaagaacaagggaaagggaggcaagaaccggaagcggggcaagaacgaggcggacgacgagaagcgggagctggtgttcaaggaggacgggcaggagtacgcgcaggtgacgcggatgctgggcaacggcgttgcgaggcgctctgcatcgacggcaccaagcgcctctgccacatccggggcaagatgcacaagaaggtgtggatcgccgccggggacatcgtgctcgtcggcctgcgcgactaccaggacgacaaggcggacgtcatcctcaagtacatgaacgacgaggcccgcctgctcaaggcctacggcgagatccccgacaacgtcaggctcaacga

SEQ ID NO: 6414 - DNA, 479 bp, Zea mays
  misc_feature: Ceres CLONE 334657-F
  misc_feature: Encodes the peptide sequence at SEQ ID NO. 6415
ctttttagtctccacgctcggcgcggggacagaccaaacgccgaggcgcgattccgcaaagcgaccggccgcgcgacacgactgagcgagctcgctcgaccctcctgccgcggtgctgctacacagctagtactagtaagtaaattactccgccaccggtgcaactttccatacacgccgaggccacttgtgttctctgtatataaagggcgagggggtggtgggcgctatggagaggagcaacagctggttccggtggtggaggaagaaggcgcgcgaggggcaggggcagggcggccgcccccgtcacggcgagaaggtggtggtggacgggtcggagatccgggagctggtggaggaccgggaggcgttcgggatgctcgtggacaccaagttccggcagctcgacgccgacggcgacggcatgctctccgtgggggacctgcgccccgccgtggcagacatcggcgcgcgctcgg

SEQ ID NO: 6415 - protein, 83 aa, Zea mays
  misc_feature: Ceres CLONE 334657-F
  misc_feature: SWISSPROT Homolog: EC 2.4.1.18 1,4-alpha-glucan branching enzyme
MERSNSWFRWWRKKAREGQGQGGRPRHGEKVVVDGSEIRELVEDREAFGMLVDTKFRQLDADGDGMLSVGDLRPAVADIGARS

SEQ ID NO: 6416 - DNA, 426 bp, Zea mays
  misc_feature: Ceres CLONE 334658-F
  misc_feature (396)..(396): n is a, c, t, g, unknown, or other
gcgttagggtttttctcccccaccccgctcgccgccgcaggcgactcgccactctaactcgctgcccgccgaccatgaaggtcgacgtgaggtgagacgctattgccgtcgagccagagctgaaggtggtggttcaggcgacggttgtgcgggttgctgaactcgttgtacatatgtgcaactcatttgaagtggctcggtttagggtttagggtttccaccatagatgcttggtttgttgattcgatttgatatgattggcgacgtcgttctttgatacaaccccattattctttcctttactgcctcgttttagagggtttgctagtttgcctgtcataaacaacmacaatgagattatcaagttgcactgatccattttcctttgattccacnccataatggttcttgtgattcgtttcctac

SEQ ID NO: 6417 - DNA, 532 bp, Zea mays
  misc_feature: Ceres CLONE 334698-F
  misc_feature: Translation starting site: 138
  misc_feature: SWISSPROT Homolog: EC 2.3.1.95 Trihydroxystilbene synthase
  misc_feature (367)..(367): n is a, c, t, g, unknown, or other
attcaacctctagctgattgatctctggtttaccactctttccttccctccttcaattctaaataccacaaatcaaagttgctttgcgatggtgagcagcagcagtggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccaghctctgcaagacgacgaccgtgaggactcggtacgtggtgatgtcggatgagatcctcaagaactacccggagctggcgcaggnggggctgcgacgatgaatcagcgtctggacatctcgaacgcggcggtgacgcagatggcgacggaggcgtccctgtcgtgcgtccgctcgtggggcggcgcgctctcgtccatcacccacctcgtgtacgtctcgtcgagcgaggcgcgcttcccgggcggcgac

SEQ ID NO: 6418 - DNA, 495 bp, Zea mays
  misc_feature: Ceres CLONE 334713-F
  misc_feature: Encodes the peptide sequence at SEQ ID NO. 6419
  misc_feature (455)..(455): n is a, c, t, g, unknown, or other
catcgcctccaccgctctctcttcctctgctcttctctgcctgcctgagctcaccgcacctcgcctcctcaccgcgtttcctccgttaatccggtagaaaatggccgatgccgaggatatccagcccctcgtctgcgacaacggaactggcatggtcaaggctgggttcgctggcgacgacgccccgagggccgtcttccccagcatcgtggggcgcccgcgccacactggtgtcatggtcgggatggggcagaaggacgcctacgtcggtgacgaggcgcagtccaagaggggtatcctgaccctcaagtaccccatcgagcacgggatcgtcagcaactgggacgacatggagaagatctggcatcacaccttctacaacgagctccgcgtggctcccgaggagcaccccgtcctcctcaccgaggcgcccctgaaccccaaggctaacaggnagaagatgacccagatcatgttcgagaccttcaacacccc

SEQ ID NO: 6419 - protein, 131 aa, Zea mays
  misc_feature: Ceres CLONE 334713-F
  misc_feature (4)..(131): Pfam Name: Actin Pfam Description: Actin
  misc_feature: SWISSPROT Homolog: EC 2.7.10.2 Non-specific protein-tyrosine kinase
  misc_feature (119)..(119): Xaa is any aa, unknown, or other
MADAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANRXKMTQIMFETFNT

SEQ ID NO: 6420 - DNA, 556 bp, Zea mays
  misc_feature: Ceres CLONE 334747-F
  misc_feature: Encodes the peptide sequence at SEQ ID NO. 6421
attgtcccatcaaactccgctactggcctcgggcccgcccgtcgtgaggtcgagctcgatgcagccgatccggcggcggcaccgaggctttgcactcctctgtctctccgccgtcctcctcgcttccgccactctgctccccggcgccgccgtcgccgaaggtgtcacgccctccgaggcgcaccggctccgcgacgaggtagtgcgggtccctcagatccgccgctcctaactcttctacgtattgctagttttgtggcttcgagcgccaagcgagtgcttggtgattttagcgtttagcgtggaggtgtgactgtgtgagtagtatggtgttcgattgcaagggtggaggtgtcggcctgcttgcttagggagctgatttaggaatttaggttgatgattgagcgaatttctagcttgcttagattgattgtctgttaatgcctgatgcgaattcgtcagatcgtggttttattgttctgctatcgcacatttgcttttgttcatgcttggtatgctttaccaaattctagtaatggctgctcgcctgtttggt

SEQ ID NO: 6421 - protein, 57 aa, Zea mays
  misc_feature: Ceres CLONE 334747-F
MQPIRRRHRGFALLCLSAVLLASATLLPGAAVAEGVTPSEAHRLRDEVVRVPQIRRS

SEQ ID NO: 6422 - DNA, 499 bp, Zea mays
  misc_feature: Ceres CLONE 334757-F
  misc_feature: Encodes the peptide sequence at SEQ ID NO. 6423
atttttttctcttctccgtcgctctcatctcgcggcgggatcggacccccagcgccgccgaccgccgtcctcactccctgccccccgagactgccccccacgccgccacacgaaccacctcagctccctgcgccactaccctcggcctgccgccgcacgcctcccgcgctgtcgttgtcagccctccgctcctcgagacgccgcacgcctcccgcgctgtcgttgtcagccctccgctccccgcgacgccgcccttggctttctgcccaccgccgtatcgacagcgccgcctccgccccacttttccgttcgatttggtgggccgaggtctctcgctcgtggagtcgtagttcagcgcttcccgcacggcgatgtcggcgacgccgctgcccccgccgggccccgatggcgcggtggcgctcctgcctccgccgggtacggacatgactgggatctgcttccgcgaccagctgtggctcgaacacttacccgctcgatc

SEQ ID NO: 6423 - protein, 42 aa, Zea mays
  misc_feature: Ceres CLONE 334757-F
MSATPLPPPGPDGAVALLPPPGTDMTGICFRDQLWLEHLPAR

SEQ ID NO: 6424 - DNA, 377 bp, Zea mays
  misc_feature: Ceres CLONE 334765-F
  misc_feature: Encodes the peptide sequence at SEQ ID NO. 6425
atcgaacaccaatggcattcttgcattgaaggaaccttccctccacctccaccgcccgagagcgagcggccggacggggttttggttgggcatggctgccccggcgatgctccaagtggtgatcctcgccgcggtcctccttctcccgttcctcagcgtgccgggcgccgaggcacagaccaagaagttctgcctcacgcagttcgccatcgctagccaggcctgcgccatcctgccacccaccagtcctgagcaccaccaccatcatcacgatgacgaggacaatgacgaggacaacgacgaagatgagggtggtgcgcggggtgggttactaggttgtaaatttgatgtcggaggctggggtacacatgggcatt

SEQ ID NO: 6425 - protein, 95 aa, Zea mays
  misc_feature: Ceres CLONE 334765-F
MAAPAMLQVVILAAVLLLPFLSVPGAEAQTKKFCLTQFAIASQACAILPPTSPEHHHHHHDDEDNDEDNDEDEGGARGGLLGCKFDVGGWGTHGH

SEQ ID NO: 6426 - DNA, 528 bp, Zea mays
  misc_feature: Ceres CLONE 334798-F
  misc_feature: Encodes the peptide sequence at SEQ ID NO. 6427
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggaggcgtccctgtcgtgcgtccgctcgtggggcggcgcgctctcgtccatcacccacctcgtgtacgtctcgtcgagcgaggcgccgcttcccgggcggcga

SEQ ID NO: 6427 - protein, 148 aa, Zea mays
  misc_feature: Ceres CLONE 334798-F
  misc_feature (10)..(146): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MVSSSMDTTSDKRASSMLAPNPGKATILALGHAFPQQLVMQDYVVDGFMKNTNCDDPELKEKLTRLCKTTTVRTRYVVMSDEILKNYPELAQEGLPTMNQRLDISNAAVTQMATEASLSCVRSWGGALSSITHLVYVSSSEAPLPGRR

SEQ ID NO: 6428 - DNA, 496 bp, Zea mays
  misc_feature: Ceres CLONE 334815-F
  misc_feature: Encodes the peptide sequence at SEQ ID NO. 6429
ctcacacaaccaagctcgatcgatctcactctcagctggtcgctcactcttgcagctccacccttcactcagtcttaggctcttagctctaggctctagctagccgcgccactccttcgtgtagccatcagccttctcatcgccaccaatggccactgcgaggtccagaccccgaccgtcgtggcggccgaggaagcgccagtggtggagaccccgccgccggccgtcgtgcccgaggagtctgcccccgccgaggccgaggctgaggctgaggctgaggctgctgctcctgctgatcccgaggagcttcccgcggccgagcagcaggcagccgccgagcccgaggccgctgctcctgctggtgccgaggagcccgcggcggccgaaccggccgctgaggcggaggctgctgctcctgctggtcccgaggagactcctgcggtcgagcaggaggcagccgccgaggaggaggctgctgctgctcctcctgctggtg

SEQ ID NO: 6429 - protein, 116 aa, Zea mays
  misc_feature: Ceres CLONE 334815-F
MATARSRPRPSWRPRKRQWWRPRRRPSCPRSLPPPRPRLRLRLRLLLLLIPRSFPRPSSRQPPSPRPLLLLVPRSPRRPNRPLRRRLLLLLVPRRLLRSSRRQPPRRRLLLLLLLV

SEQ ID NO: 6430 - DNA, 503 bp, Zea mays
  misc_feature: Ceres CLONE 334836-F
  misc_feature: Encodes the peptide sequence at SEQ ID NO. 6431
aaaaatctgcagcttcccgcaccgtatcctgcggaagaagtttctaacgggctacatcccaccaccgcacgatgtcggcagcggcgcgagtgctgccgaaggcggtgaccttcgtgacgggcaacgccaagaagctggaggaggtccgcgccatcctcgggtcttccgtcccattccagtcgctcaagctcgacctgcctgaactgcaaggggagccagagtacatatccaaagagaaagcacgaatcgctgcatctcaggtgaatgggcctgtactggtggaggacacctgcctatgttttaatgcgctcaaaggcctaccaggaccctacataaagtggtttcttgagaagattgggcatgaaggtttaaataatctgttaaaagcttatgaagataaatcagcgtttgctatgtgcatcttctctcttgctcttggacctggagaggaaccaatcacatttgttggcaaaactgcgggaaagatcgtgcctgctagaggc

SEQ ID NO: 6431 - protein, 144 aa, Zea mays
  misc_feature: Ceres CLONE 334836-F
  misc_feature (12)..(144): Pfam Name: Ham1p_like Pfam Description: Ham1 family
  misc_feature: SWISSPROT Homolog: EC 3.6.1.19 Nucleoside-triphosphate diphosphatase
MSAAARVLPKAVTFVTGNAKKLEEVRAILGSSVPFQSLKLDLPELQGEPEYISKEKARIAASQVNGPVLVEDTCLCFNALKGLPGPYIKWFLEKIGHEGLNNLLKAYEDKSAFAMCIFSLALGPGEEPITFVGKTAGKIVPARG

SEQ ID NO: 6432 - DNA, 474 bp, Zea mays
  misc_feature: Ceres CLONE 334904-R
caattgggaccgggccccccctcgagtcgacggtatcgataagcttttttttttttttttttggatggaaacacgacaaacactgacaacaggccagtgtatacatgacacgtatttattacaattaatattactgttacaaatttgtggctacctatatagggtgatcagtttacatatataagccaaactctaattggtttccttttttttttgctaggctcactggagaaacacatactcttgatgggttataaactgtaaagggatggcatactttgggaaaaagcagacgacctcaatcctcaatcgcctcctcttcaatcaggtccatccggattttattaccgtttcccgaaatattccccctttttgggggcccacccccccttccttttaaacaaaaaaaaaaaggaaaggcccctcttttcccgccccccaaataaaaaaaagaggggggggggggggggccgg

SEQ ID NO: 6433 - DNA, 481 bp, Zea mays
  misc_feature: Ceres CLONE 334911-F
  misc_feature: Encodes the peptide sequence at SEQ ID NO. 6434
aaacactcatcacgccgccactgatctgctctgttgctggtgactaggagcagtagcgagagggattctggatggccaagtcgaagaaccacacggcgcataaccagtcgttcaaggcgcacaagaacggcatcaagaagcccaagcgccaccgccagacctccaccaaggggatggacccgaagtttctgaggaacttgaggtactcaaggaagggcaacaagaagagtggcgaggctgagtccgaggagtaagatgatggtgattgagtttgtggcgacaaatgcatctcttgtatcgctaagagtcttagctgtgaacttagttctcacttctgtgtgactgtgatcaaaggacttgtgtatgatcaaaggagatccatcagttggtaccgaagtgtattttatgtcttgttggttacctggaatttaattaaaaccatcacttgtatccttttgagaattgggcaattgatgtgtcg

SEQ ID NO: 6434 - protein, 60 aa, Zea mays; identical to SEQ ID NO: 1569
  misc_feature: Ceres CLONE 334911-F
  misc_feature (3)..(42): Pfam Name: Ribosomal_L29e Pfam Description: Ribosomal L29e protein family

SEQ ID NO: 6435 - DNA, 379 bp, Zea mays
  misc_feature: Ceres CLONE 334932-F
  misc_feature: Encodes the peptide sequence at SEQ ID NO. 6436
agtgaaaaatcgtgttcccagcagagccagtgcaattatcggaagcaactgcagagctgcagcgaccaagcggacgacgcgagagagatgagggcggtggtgatcacgcgcggcggcggcggcccggaggtgctggaggcgcaggaggtagaggaccccgcgccgctgggcgacggcgaggtcctcctccaggtggtcgccgcgggcgtcaaccgcgccgacacgctccagcgccacggcggccacccgccgcccgccggcgcccccccgtacccggggctcgagtgctccggcaccatcctcgcgctcggccccaacgccccaccacggtgggccgtcggcgacaaggtctgcgcgctgcttagcggcggcgggtacg

SEQ ID NO: 6436 - protein, 97 aa, Zea mays
  misc_feature: Ceres CLONE 334932-F
  misc_feature (29)..(93): Pfam Name: ADH_N Pfam Description: Alcohol dehydrogenase GroES-like domain
  misc_feature: SWISSPROT Homolog: EC 1.6.5.5 NADPH:quinone reductase
MRAVVITRGGGGPEVLEAQEVEDPAPLGDGEVLLQVVAAGVNRADTLQRHGGHPPPAGAPPYPGLECSGTILALGPNAPPRWAVGDKVCALLSGGGY

SEQ ID NO: 6437 - DNA, 463 bp, Zea mays
  misc_feature: Ceres CLONE 334972-F
  misc_feature: Encodes the peptide sequence at SEQ ID NO. 6438
acaagcagcatccgcacactcccaattcccctcgagcgccgcagcgagcccaagaagccgaccgccgagccccctctccagtccagtccgcggtctcggtttcttgcttacccggcgcccaatcttcagggagctccttctcgtcgtctgtctccatggccgcctcgaccaagaccgtcgccgtcctcctcgccgcggtgctcctcgcgctggtcgcgtccgcggcagccagcaggaagctggaggaggaggacgcactcctgggaagcctggccccagcccccgcgccggccgttggcggttccgcggggctgctggcgccaggccgggggcgtgggccgtcgccgccctggtctctctcgtcgccttcctcgtgaactgagggkgtgggcatcgtgctgcgcagcgcgggagatgggagggacgaatcctgcgatctggatcgctgggagaggagaggggg

SEQ ID NO: 6438 - protein, 73 aa, Zea mays
  misc_feature: Ceres CLONE 334972-F
MAASTKTVAVLLAAVLLALVASAAASRKLEEEDALLGSLAPAPAPAVGGSAGLLAPGRGRGPSPPWSLSSPSS

SEQ ID NO: 6439 - DNA, 655 bp, Zea mays
  misc_feature: Ceres CLONE 334981-R
  misc_feature: Pfam Name: DHQS Pfam Description: 3-dehydroquinate synthase (EC 4.6.1.3)
  misc_feature (459)..(459): n is a, c, t, g, unknown, or other
  misc_feature (480)..(480): n is a, c, t, g, unknown, or other
  misc_feature (533)..(533): n is a, c, t, g, unknown, or other
cgattgggtaccgggccccccctcgaggtcgacggtatcgataagcttttttttttttttttttctgatgaatgttgcaatcatacatcatttttttgttcaaaacgacgtgaaactggtgcattcagcgtttccattttcatctctcaacaataaactcctgaatctctatcccagtgtgacgggcggcgccctgtttcctcaccagaacttcatcaccgactttcagcgaagtcacgggaatggcggtccttccacttgatcctgtgttaggggtaataagtgcaactgtttctgcgttttgtagaaaaatgctatacgtctcgtctccagagttatccttcgcttctacaaggatcagaggccttgattcgatcttcacacgaccgacaattgcagtacgccatagcccactctgattgatcacgatgacttcctttcctgacccccactctgagnagtagcttgtcttgccaccangaaacggtgacatatgcatgtacaggcccccgcattgactctgaaaggcctgncttgcatgtaattagtctccaagcattcagaatgaaccagaaacattcctcctggataccgaccaaacaaaagggcctttcgccagttcccatgaaacttgcaaagattcccccaaaaccca

SEQ ID NO: 6440 - DNA, 377 bp, Zea mays
  misc_feature: Ceres CLONE 335107-F
  misc_feature (293)..(293): n is a, c, t, g, unknown, or other
aaaaaaacagcaactccagaagatgagtctccctcgycgccgccaccttgtcctgctcgcctgccttcctggtcttcctcgtcttcgccgcgtccgcgtcgacgagttccgccgaggtggccccgagcgtggcggtggacttcgtgcggcggtcgtgccggtcgacggagtacccgcgcgtgtgcgagagcacgctggtcccctgcgcggctggcgtggggcgcagcccgcgcctgctggcgcgagcggcgctggtggttggcgccgaccgcgcgcgcaactgctcctcctanatccgcggcggcggcggcggcgcgatgaaggactgcgcggagctggcgcgcgacgcggaggagcggctgcgscagtccgcggca

SEQ ID NO: 6441 - DNA, 506 bp, Zea mays
  misc_feature: Ceres CLONE 335108-F
  misc_feature: Encodes the peptide sequence at SEQ ID NO. 6442
aaacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggaggcgtccctgtcgtgcgtccgctcgtggggcggcgcgctctcgtccatcaccacctcgtgtacgtctcgtcgagcga

SEQ ID NO: 6442 - protein, 140 aa, Zea mays
  misc_feature: Ceres CLONE 335108-F
  misc_feature (10)..(140): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MVSSSMDTTSDKRASSMLAPNPGKATILALGHAFPQQLVMQDYVVDGFMKNTNCDDPELKEKLTRLCKTTTVRTRYVVMSDEILKNYPELAQEGLPTMNQRLDISNAAVTQMATEASLSCVRSWGGALSSITTSCTSRRA

SEQ ID NO: 6443 - DNA, 512 bp, Zea mays
  misc_feature: Ceres CLONE 335189-F
  misc_feature: Encodes the peptide sequence at SEQ ID NO. 6444
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacaacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggaggcgtccctgtcgtgcgtccgctcgtggggcggcgcgctctcgtccatcacccacctcgtgtacgtctcgtcgagcgaggcgcg

SEQ ID NO: 6444 - protein, 142 aa, Zea mays
  misc_feature: Ceres CLONE 335189-F
  misc_feature (10)..(142): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MVSSSMDTTSDKRASSMLAPNPGKATILALGHAFPQQLVMQDYVVDGFMKNTNCDNPELKEKLTRLCKTTTVRTRYVVMSDEILKNYPELAQEGLPTMNQRLDISNAAVTQMATEASLSCVRSWGGALSSITHLVYVSSSEA

SEQ ID NO: 6445 - DNA, 479 bp, Zea mays
  misc_feature: Ceres CLONE 335197-F
  misc_feature: Encodes the peptide sequence at SEQ ID NO. 6446
gcacctgcacgcgtccaccaagcccccgactccccgaggccccgacctgcgcacccacgggatccctacctatccggccgtcacccctccccctgcccctcccgagttggattgttcgcggaattggcggaggggcagccggatatgtcgtcgtcggttgggggcggcagcgcgggcggcggcggagtggacatggtcagcctgctggagaaggccaaggatttggaccagctaaagaaggaacaggacgaaatcgttgccgatatcaacaagattcacaagaagctcctcgcatccccagagatggttgataaaccagttgacaccattttgctcaagcttcgtggtttatatgcacgtgcaaaggagctctctgagaatgaaatcagtgcctcaaatgctttgattggattattagatggtttgttgcaatctggagcttcaactgcacaaaagaaaagatagttgctttctacatt

SEQ ID NO: 6446 - protein, 106 aa, Zea mays
  misc_feature: Ceres CLONE 335197-F
MSSSVGGGSAGGGGVDMVSLLEKAKDLDQLKKEQDEIVADINKIHKKLLASPEMVDKPVDTILLKLRGLYARAKELSENEISASNALIGLLDGLLQSGASTAQKKR

SEQ ID NO: 6447 - DNA, 515 bp, Zea mays
  misc_feature: Ceres CLONE 335202-F
  misc_feature: Translation starting site: 82
aaagatcgagcagcgagagacgggcaggggaggaaaaaaatctaaccctagcatccgcagcgctagggttcgggggttgcgatggcggcggcggcgaggcagcgggggacggtgaagtggttcaacgacaccaagggcttcgggttcatctcccccgaggacggcagcgaggatctcttcgtgcaccagtcgtcgatcaagtcggagggcttccgctcgctcgcggagggcgaggaggtggagttttccgtctcggagggtgacgacggccgcactaaggccgtcgacgtgaccggccccgacggatccttcgtcaggggcggcggaggcggaggaggcggcggcggcggcggctacggctcccgcggcggtggcggatctggcggcggcggtcgcagctacggtggtagctggybgcggcggccggagatccggcggcgggggcggtcctggcgcgtgctacaagtgcggcgagcccggccacatggccagggactgccctagcgccgacggcg

SEQ ID NO: 6448 - DNA, 554 bp, Zea mays
  misc_feature: Ceres CLONE 335211-F
  misc_feature: Encodes the peptide sequence at SEQ ID NO. 6449
actctcgtctcgtctccctcctccccgttcctgattcgcgagaccggagggaggggtacgagcttcaccgctttcatcccgcccgcgctcctccccagatctcctctccattgccgccgaccttgcccagattcgcgccctcctcgctcatatctgaaagcggctctgattttccaagccgaccgcaggagcggtgcaccgcgccgcgtgattccggcggcttgatttggaatttgtgatctttcggggcattcgtcggtttgtctgtcggtgccggtggtgctgcgtttcgagggcagcgaagatgggcgtcggcggagagaagtttcagctggggacggtgggggcgctgagcctatccgtggtctcctccgtctccattgtcatctgcaacaaggccctcatgagctccctcggctttaacttcgccactaccttgacaagctggcatctgctggttacattctgctcccttcatgtggcattatggatgaaattctttgagcataagccttttgaatcaagaactgtcatgggatttggagtactaatgg

SEQ ID NO: 6449 - protein, 83 aa, Zea mays
  misc_feature: Ceres CLONE 335211-F
MGVGGEKFQLGTVGALSLSVVSSVSIVICNKALMSSLGFNFATTLTSWHLLVTFCSLHVALWMKFFEHKPFESRTVMGFGVLM

SEQ ID NO: 6450 - DNA, 524 bp, Zea mays
  misc_feature: Ceres CLONE 335241-F
  misc_feature: Encodes the peptide sequence at SEQ ID NO. 6451
aaacttcccctgtcacgagagtacgagaccacgccttccgtgggatcaatcggctagggtttcggagatgttcggccgcgcgccgaagaagagcgacaacacccggtactacgagatcctgggggtttccaaggacgcgtcacaggatgacctcaagaaggcctaccgcaaggccgccatcaagaaccaccccgacaagggcggcgaccccgagaaggtgagcgcgcgagctggtcatttcgtctggctccgacctgtccgcggcggggagtagtaggcgggttgtcaggtttgcggcgatgttgagacggtttggctgggtcgatttcatatggtgctggtgcttgtgggttcggagcggtggtttcgatctgaggcggcgtggatttagatgagtttaatgctgttggggtagtggagggaattcgtatgggcaaggagatgttgcatggaaactgttatgaatattggttgcgaggaaagtgttaggattgttgtctgccacggagacgcatctagagctg

SEQ ID NO: 6451 - protein, 68 aa, Zea mays
  misc_feature: Ceres CLONE 335241-F
  misc_feature (13)..(56): Pfam Name: DnaJ Pfam Description: DnaJ domain
MFGRAPKKSDNTRYYEILGVSKDASQDDLKKAYRKAAIKNHPDKGGDPEKVSARAGHFVWLRPVRGGE

SEQ ID NO: 6452 - DNA, 511 bp, Zea mays
  misc_feature: Ceres CLONE 335281-F
  misc_feature: Encodes the peptide sequence at SEQ ID NO. 6453
aatccacacctgcagctgccacagcgggtggtgcctggcttggcggcctagcatagctgcgctgcgcatgctagtgaccaatggcgtccaccaaggtgccactgttcctcgtcctcaacctcctgctcttcgcggcggccaacgcctgcccttactgcccgggcaacaatggccacggtagcagcgggcaccatggcggcagtgggcatggcggcggtggcagcggcggttccggtggcggcagcagcggcggagggtacggtccgatcggtggtggtggcagcggcggcggcggcggaggagggtacggtccgatcggtgacggtggcagcggcggtgggatcggagtcggacccatcgtaggcggcagcggggggatcggacccataggaggtggcagcggtggtgggtacggtcccatcggtggaggtggaggtgggatcggtggcggtggcagcgacggcacgagcggctggtacggccaktgcccgacgaacgcgctgaagctcgg

SEQ ID NO: 6453 - protein, 143 aa, Zea mays
  misc_feature: Ceres CLONE 335281-F
  misc_feature (135)..(135): Xaa is any aa, unknown, or other
MASTKVPLFLVLNLLLFAAANACPYCPGNNGHGSSGHHGGSGHGGGGSGGSGGGSSGGGYGPIGGGGSGGGGGGGYGPIGDGGSGGGIGVGPIVGGSGGIGPIGGGSGGGYGPIGGGGGGIGGGGSDGTSGWYGXCPTNALKL

SEQ ID NO: 6454 - DNA, 564 bp, Zea mays
  misc_feature: Ceres CLONE 335294-F
  misc_feature: Encodes the peptide sequence at SEQ ID NO. 6455
gtcgcatcgcacgccatcagcagctagcgcgctcctcgagcccagcagagaaaggccggcagcgctaatcgtaatagccatgggctccaccgccggcgacgtggccgcggtggtggacgaggaggcgtgcatgtacgcgatgcagctggcgtcgtcgtccatcctgcccatgacgctgaagaacgccatcgagctgggcctgctggaggtgctgcagaaggaggccggcggcggcaaggcggcgctggcgcccgaggaggtggtggcgcggatgcccgcggcgcccagcgaccccgccgccgccgcggccatggtggaccgcatgctccgcctgctcgcctcctacgacgtcgtccggtgccagatggaggaccgggacggccggtacgagcgccgctactccgccgcgcccgtctgcaagtggctcacccccaacgaggacggcgtgtccatggccgccctcgcgctcattgaaccaggacaaggtcctcatggagagctggtactatctcatgacgcggtgctggacggcggcatcccgttcaacaaggcgtacgggatgac

SEQ ID NO: 6455 - protein, 161 aa, Zea mays
  misc_feature: Ceres CLONE 335294-F
  misc_feature (31)..(87): Pfam Name: Dimerisation Pfam Description: Dimerisation domain
  misc_feature: SWISSPROT Homolog: EC 2.1.1.68 Caffeate O-methyltransferase
MGSTAGDVAAVVDEEACMYAMQLASSSILPMTLKNAIELGLLEVLQKEAGGGKAALAPEEVVARMPAAPSDPAAAAAMVDRMLRLLASYDVVRCQMEDRDGRYERRYSAAPVCKWLTPNEDGVSMAALALIEPGQGPHGELVLSHDAVLDGGIPFNKAYGM

SEQ ID NO: 6456 - DNA, 530 bp, Zea mays
  misc_feature: Ceres CLONE 335303-F
  misc_feature: Encodes the peptide sequence at SEQ ID NO. 6457
aacgaccatcgagtgccattggagtggctccattgcttggcaagctagctagtctcctgtcctgtcctgtccttccttggcaacaatatatagaatggtgggtagcagggagcagatcggtgcgacgacgcaggcgcccaacaaggtgtcgatgagccgccaggttttccatgtcctcctccttgccgccgtcgtccttttggcctcgctgctatccgcgaaggagaagctgctggggctgagcccggctgcggtggcggtggcctgctgggcgggtgcggtggcggcgtgggcgtacgcggtgtcccgcccgcgtcccgtgtacctggtggacctgtccgggtacgtgggcgggccttcgcacgaggcctcccgcgccaagacgatcgcccacttcgggcggtgcgggcggttcagcgacgagagcatggcgttccagaagcggatgctggagcggtcggggctcggggagcagacccacttcccggcgtcgctcatcagcgtgcccgtggacatgtgcctcccgcacg

SEQ ID NO: 6457 - protein, 145 aa, Zea mays
  misc_feature: Ceres CLONE 335303-F
  misc_feature (68)..(144): Pfam Name: FAE1_CUT1_RppA Pfam Description: FAE1/Type III polyketide synthase-like protein
  misc_feature: SWISSPROT Homolog: EC 2.3.1.119 Icosanoyl-CoA synthase
MVGSREQIGATTQAPNKVSMSRQVFHVLLLAAVVLLASLLSAKEKLLGLSPAAVAVACWAGAVAAWAYAVSRPRPVYLVDLSGYVGGPSHEASRAKTIAHFGRCGRFSDESMAFQKRMLERSGLGEQTHFPASLISVPVDMCLPH

SEQ ID NO: 6458 - DNA, 500 bp, Zea mays
  misc_feature: Ceres CLONE 335305-F
  misc_feature: Encodes the peptide sequence at SEQ ID NO. 6459
gtctccatccaattcacaggctcaccacaccaaccagcaagcaaaaattccccaatcctctcgtctccgcggcgaagatgtcggggcgcggcaagggcggcaagggcctgggcaagggcggcgcgaagcgtcaccggaaggtgctgcgcgacaacatccaggggatcacgaagccggcgatccggaggctggcgcggcggggcggcgtgaagcgcatctcggggctcatctacgaggagacccgcggcgtgctcaagatcttcctggagaacgtcatccgcgacgccgtcacctacaccgagcacgcgcgccgtaagaccgtcaccgccatggacgtcgtctacgcccttaagcgccagggccgcaccctctatggcttcggcggctaggtctgccgcggccgcgcctcgcctcgccgttggtgcggttctggtgttgctgcagttcgcaagttgtttgtggggggtgaaaaaatgctagctactgtagaactgcagtgc

SEQ ID NO: 6459 - protein, 103 aa, Zea mays
  misc_feature: Ceres CLONE 335305-F
  misc_feature (25)..(94): Pfam Name: Histone Pfam Description: Core histone H2A/H2B/H3/H4
MSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6460 - DNA, 534 bp, Zea mays
  misc_feature: Ceres CLONE 335329-F
  misc_feature: Encodes the peptide sequence at SEQ ID NO. 6461
acctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggaggcgtccctgtcgtgcgtccgctcgtggggcggcgcgctctcgtccatcacccacctcgtgtacgtctcgtcgagcgaggcgcgcttcccggggcggcgacctgcac

SEQ ID NO: 6461 - protein, 150 aa, Zea mays
  misc_feature: Ceres CLONE 335329-F
  misc_feature (10)..(149): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MVSSSMDTTSDKRASSMLAPNPGKATILALGHAFPQQLVMQDYVVDGFMKNTNCDDPELKEKLTRLCKTTTVRTRYVVMSDEILKNYPELAQEGLPTMNQRLDISNAAVTQMATEASLSCVRSWGGALSSITHLVYVSSSEARFPGRRPA

SEQ ID NO: 6462 - DNA, 1410 bp, Zea mays
  misc_feature: Ceres CLONE 335407
  misc_feature: Encodes the peptide sequence at SEQ ID NO. 6463
atccatccattccgttccatctgaaggcgagagttatctcgtgcctgccccgctgttctcctctcccgccgcatccgatagttcagcgcaacaaaacctccctctccgcgcacgctccccacccccaccggtgaccgcgcgcgcatggctgccttacttcggacggccgcggccctcgcgcccccgccctcgtctcccccgtccgcacgggagccgcgtgggcggtgcctgcggctggcctgctcccggcgcgcgccggtccgaccgctccgggcgtggccgctgccgactccgcacgtcttctgtctcgccggggggcggctccggcgcctgggcgccaccgaggccgacgaggccgcgcagacggcgacgcaggaggatttagaaaccgaagttactggagactctgctgcagatgacagtgctggaagcacagatgaaactccatctattattgtgacaaccctgcagtcgtacagagaagctcttattaatgatgatgaagcaaaagctgctgagatagagtcccttttactttctatcgaggatgagaaaaactctcttttgaacaaaatcactgctctagatgccgaactagcaactcaacgagaacgtatcttgaggatcagtgctgattttgacaatttcaggaaaaggacagaaaatgagaagcttaacatgatggaaaatgtgcaaggggaacttatagagagctttttgcctgttctcgacaactttgaaagagcgaaagtgcaaataaaggtggaaacagagggagaggagaaaataaataatagctaccagagcatttataagcaattcatcgagattttgaattcattgggcgttgaagatgttgaaacggtcggcaaaccatttgatcccatgcttcatgaggctattatgagagaagaatcatcagagtttgaagaggggattattctccaggaattccgaaaaggtttcaaactcggggaaagactgcttcgcccagcaatggtcaaagtgtctgcaggaccaggccctgaaaagtttggagatgatgacccaacagctgtcgaaggtagtgtggcacctcaaaaggttgacgaagtcgaagacgacggttttggtgccggcgatgcagaataggtggctggagcttgatctgtgaatcaacaagaacaggtccagaaattttgatgcttttctggagcgtgccaagcaggaaataggatggtaccaattcgttcaagctatagagttaggtcccaaaatgtgctgttatttcctcctgctgacatggggtgttggtattgcgacaaatttgtgcttctatccgccgtggtcgaccttttgttcttgcaatgaggaattttcgtgatcaattgatgcaacatgatattgtaagggccaaaaaaaaaaaaaaaa

SEQ ID NO: 6463 - protein, 328 aa, Zea mays
  misc_feature: Ceres CLONE 335407
  misc_feature (117)..(290): Pfam Name: GrpE Pfam Description: GrpE
MAALLRTAAALAPPPSSPPSAREPRGRCLRLACSRRAPVRPLRAWPLPTPHVFCLAGGRLRRLGATEADEAAQTATQEDLETEVTGDSAADDSAGSTDETPSIIVTTLQSYREALINDDEAKAAEIESLLLSIEDEKNSLLNKITALDAELATQRERILRISADFDNFRKRTENEKLNMMENVQGELIESFLPVLDNFERAKVQIKVETEGEEKINNSYQSIYKQFIEILNSLGVEDVETVGKPFDPMLHEAIMREESSEFEEGIILQEFRKGFKLGERLLRPAMVKVSAGPGPEKFGDDDPTAVEGSVAPQKVDEVEDDGFGAGDAE

SEQ ID NO: 6464 - DNA, 523 bp, Zea mays
  misc_feature: Ceres CLONE 335413-F
  misc_feature: Encodes the peptide sequence at SEQ ID NO. 6465
  misc_feature (327)..(327): n is a, c, t, g, unknown, or other
agtcttctctccgcctcgcgcacccggttccgcgtgcctttccccacctactctcgcggctctcgccagccagtctagggtttcggtcccggcgtgcttatccgcccccgccggccatgtcgaagcaaggagggaaggccaagccgctgaaggcgcccaaggccgacaagaaggagtacgacgagacggatcttgcatatctgcagaagaagaaagatgaggaaaaagcactgaaggagcttaaggccaaggcacagaagggcgcgattgggggctcgggtctgaagaaaagtggaaagaaatgagactggtcacccgtctccaatncctagaggatgataaggcagctgtctatctgtgttgcgcttcactaagtgtgattgtaacagtggtacctcttgtgttctgtgttccgcgatgttgcagttggttgcttgatcgaaagatgtttcaacctcccatctgctagctatgatacagatggtcccctgataataaatgatgacatattctgtgatggatg

SEQ ID NO: 6465 - protein, 62 aa, Zea mays; identical to SEQ ID NO: 5990
  misc_feature: Ceres CLONE 335413-F
  misc_feature (1)..(62): Pfam Name: TMA7 Pfam Description: Translation machinery associated TMA7

SEQ ID NO: 6466 - DNA, 475 bp, Zea mays
  misc_feature: Ceres CLONE 335426-F
  misc_feature: Encodes the peptide sequence at SEQ ID NO. 6467
gctttctcagaggcgggttggcttctcctcccccaccggttcgtgttcaggttctggttcgtgggcgagagggaagagatggcggcgtcggacgttgagtaccgttgcttcgttggcggcctcgcctgggccaccgacgaccactccctcaacaacgccttcagcacctacggcgaggtcctcgagtcgaagatcatcctggatcgggagacgcagaggtcccgcggcttcggcttcgtcaccttctccacggaggacgcgatgcgcagcgccatcgagggcatgaacggcaaggagctcgacggccgcaacatcaccgttaacgaggcccagtcccgcggcggccgcggaggcggcggtggcggatacggtggcgggcgccgtgatggaggcggctacggcggtggcggtggcggctacggaggtggtcgtggaggctacggcggcggctacggcaacaacgacgggaactgga

SEQ ID NO: 6467 - protein, 132 aa, Zea mays
  misc_feature: Ceres CLONE 335426-F
  misc_feature (10)..(81): Pfam Name: RRM_1 Pfam Description: RNA recognition motif. (a.k.a. RRM, RBD, or RNP domain)
  misc_feature (48)..(129): Pfam Name: GRP Pfam Description: Glycine rich protein family
  misc_feature: SWISSPROT Homolog: EC 5.2.1.8 Peptidylprolyl isomerase
MAASDVEYRCFVGGLAWATDDHSLNNAFSTYGEVLESKIILDRETQRSRGFGFVTFSTEDAMRSAIEGMNGKELDGRNITVNEAQSRGGRGGGGGGYGGGRRDGGGYGGGGGGYGGGRGGYGGGYGNNDGNW

SEQ ID NO: 6468 - DNA, 402 bp, Zea mays
  misc_feature: Ceres CLONE 335428-F
  misc_feature: Encodes the peptide sequence at SEQ ID NO. 6469
ctaccgcaggccgcagcccagcaccggccgctctacgccggcacgtcctcgtttctgtccgaggtcatcgcctccgcaacttcgtggccggtgaggtcgcaccaccatggcgtcgctcctagcccggcaggcagcgcaggcgctccgcgcgaggcaaacggcgcagctcgggccggccgcgtcggcgatgcaagggcacctccgtacctacatgaacgcggggattcccaagcggttcaaagaggatgaggagaaagaacagcttgcaaaagatctcgcaaaagattggaatgctgtgtttgaaaggagcatcaatacattgtttttgactgaaatggtccgtggcttgatgctaactctcaagtacttctttgatagaaatgtcacaattaactatccgtt

SEQ ID NO: 6469 - protein, 98 aa, Zea mays
  misc_feature: Ceres CLONE 335428-F
  misc_feature (64)..(98): SWISSPROT Homolog: EC 1.6.5.3 NADH dehydrogenase (ubiquinone)
  misc_feature (69)..(98): SWISSPROT Homolog: EC 1.6.99.5 NADH dehydrogenase (quinone)
MASLLARQAAQALRARQTAQLGPAASAMQGHLRTYMNAGIPKRFKEDEEKEQLAKDLAKDWNAVFERSINTLFLTEMVRGLMLTLKYFFDRNVTINYP

SEQ ID NO: 6470 - DNA, 439 bp, Zea mays
  misc_feature: Ceres CLONE 335437-F
  misc_feature: Encodes the peptide sequence at SEQ ID NO. 6471
agttcgttcgcgttgcccgcgactctctccgtcctcctactgcccacccgactcacacgcttggcacgcgcgtgcttccacccgtccgtcgcctctctctcggctgcctgattgatttggttgccccggttccagcaatggcggtccaggcgcattatcaccaccactaccaccgcgagtcccctttcctcgtcaggtacctgccgtggccgctgtgcatcttctaatcgtttcttccgcgtcgatcgtcggtctgctggatcgtattcggatgggtgatttgagcgtctgggttgtcagcggcgcgccggagggcagccggttggcggcggcgatggagctgcatcatcaggcgcagaaggaggctatggcgccgcagcaggctcaggctccgcccctcttcttggacttctcgcatggagattacggcggcgggagg

SEQ ID NO: 6471 - protein, 56 aa, Zea mays
  misc_feature: Ceres CLONE 335437-F
MGDLSVWVVSGAPEGSRLAAAMELHHQAQKEAMAPQQAQAPPLFLDFSHGDYGGGR

SEQ ID NO: 6472 - DNA, 467 bp, Zea mays
  misc_feature: Ceres CLONE 335484-F
  misc_feature: Encodes the peptide sequence at SEQ ID NO. 6473
aacctctagctgattgatctctggtttaccactctttccttccctccttcaattctaaataccayataatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgcgacgatgaatcagcgtctggacatctcgaacgcggcggtgacgcagatggcgacggaggcgtccctgtcgtgcgtccgcccgttggggcggcgcgc

SEQ ID NO: 6473 - protein, 97 aa, Zea mays; identical to SEQ ID NO: 2271
  misc_feature: Ceres CLONE 335484-F
  misc_feature: SWISSPROT Homolog: EC 2.3.1.74 Naringenin-chalcone synthase

SEQ ID NO: 6474 - DNA, 485 bp, Zea mays
  misc_feature: Ceres CLONE 335509-F
  misc_feature: Encodes the peptide sequence at SEQ ID NO. 6475
aattcgaccccatccacttctcagttctcacctcaatctcgcgagaagcgaagccggaggaggagggtgcgaggagatcgcgagcagccggagccggagccggaggcctagaagatgaagacgttcgacccgtggccggtattcttccgccgggagtcgaagcgcaattggcccttcctcacggggttcgccatcaccggcttcatcatcactaagatgacggccaacttcaccgaggaggacctcaagaactccaagttcgttcaggagcacaagaagcgctgaccaaccaggtgttgtccgaattgcctgtctggacagccagttatgttatgatgtttgaatgaaaaattagcttctttttcttcatctaaatgcgtgcagcctatgctccatttgtaatgtaataagaggcatctgacttgatccaaaagctaccagcttctgattatgagtgatacttcaaagtttgatctggttctctg

SEQ ID NO: 6475 - protein, 56 aa, Zea mays
  misc_feature: Ceres CLONE 335509-F
MKTFDPWPVFFRRESKRNWPFLTGFAITGFIITKMTANFTEEDLKNSKFVQEHKKR

SEQ ID NO: 6476 - DNA, 520 bp, Zea mays
  misc_feature: Ceres CLONE 335512-F
  misc_feature: Encodes the peptide sequence at SEQ ID NO. 6477
agcctccgcccatacacacacagccccatcccgccgccgcaggcgagaaccagcgccaccttaggttagggcggccgccgccggagaagtgcgcggttgccaagatgcagatcttcgtgaagaccctgacggggaagaccatcacgctggaggtggagtcctcggacaccatcgacaacgtgaaggccaagatccaggacaaggagggcatcccgccggaccagcagcgcctcatcttcgccggcaagcagctcgaggatggccgcaccctcgccgactacaacatccagaaggagtcgacgctgcacctggtgctccgcctcaggggaggcgccaagaagcgcaagaagaagacgtacaccaagcccaagaagatcaagcacaagcacaagaaggtgaagctcgccgtgctccagttctacaaggttgacgacgccaccggcaaggtcacccgcctccgcaaggagtgccccaacgccgagtgcggcgcgggggtcttcatggccaaccacttcgaccg

SEQ ID NO: 6477 - protein, 138 aa, Zea mays
  misc_feature: Ceres CLONE 335512-F
  misc_feature (6)..(74): Pfam Name: ubiquitin Pfam Description: Ubiquitin family
  misc_feature (101)..(138): Pfam Name: Ribosomal_S27 Pfam Description: Ribosomal protein S27a
  misc_feature: SWISSPROT Homolog: EC 3.1.2.15 Ubiquitin thiolesterase
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDDATGKVTRLRKECPNAECGAGVFMANHFD

SEQ ID NO: 6478 - DNA, 516 bp, Zea mays
  misc_feature: Ceres CLONE 335574-F
  misc_feature: Encodes the peptide sequence at SEQ ID NO. 6479
gaagcatccaggcatccagcaaatccagcgggtccgtactcatctgcttcacctccgggctccggctacggcggcactcttctctggcaaccggaccacagaaacctctaggcgacgaatcgagcaggtagaggagtaatcaggcatccatggctgagcatcttgcgtccatctttggcacggagaaggaccgcgtgaactgccccttctacttcaagatcggcgcatgccgccacggcgaccggtgctcccgcctgcacaacaagccttccatctccccgacgctgctgctctgcaacatgtaccagcggccggacatgatcaccccgggcgtggacgcgcagggcaaccccatcgacccggagcggatccaggaggacttcgaggacttctacgaggacatcttcgtggagctgagcaagcacggcgagatcgagagcctccacgtctgcgacaacctcgcggaccacatgatcgggaacgtgtacgtggagttcccgcgaggaggagcaggcg

SEQ ID NO: 6479 - protein, 122 aa, Zea mays
  misc_feature: Ceres CLONE 335574-F
  misc_feature (13)..(39): Pfam Name: zf-CCCH Pfam Description: Zinc finger C-x8-C-x5-C-x3-H type (and similar)
MAEHLASIFGTEKDRVNCPFYFKIGACRHGDRCSRLHNKPSISPTLLLCNMYQRPDMITPGVDAQGNPIDPERIQEDFEDFYEDIFVELSKHGEIESLHVCDNLADHMIGNVYVEFPRGGAG

SEQ ID NO: 6480 - DNA, 1434 bp, Zea mays
  misc_feature: Ceres CLONE 335600
  misc_feature: Encodes the peptide sequence at SEQ ID NO. 6481
accgaggtcccccaatcccccaaacatttcccccaaacatttttttgtcgaatctgtcgtgagatcctccccgacgagatggcggggaagggagccaaggccacggccgccaagtcggcggacaaggacaaggggaagaaggccggcggccccgtctcgcgctcctcccgcgccgcacctcaggagaattcaactccgaagaaagatgtttatcaattgttcgctgagaaggttagggataacaaacagctggaatcaagatgggcaatcatgcaagaaacccgtgtggagtattttcgtggaaaagatttcaatgccttcatcaagaattatccagaagtcagggaaattttggggccagataaggatttagaagtggaagacattgttaacactttgttgaccaagaaccttgtgataaggtgtgaccgagttatgaaaactgtgaggcctggcaagaaaaagttatcatcatggcctgctcacttggagatacataatgaacaagtgtttactgaaaatgatgggttttatgcttggatgtttctgaaaaggcggaccttgtggcagacagttctttcatttgtttggcctctttttgcactggcagtctgcttatttccagtttacccataccaatgcaagattgttgtactgtactcatgtgctggagctctacttttcattgtctccattcttttgctaagagctgccatctttggcatcttatgggttctccttgggaaacgcgtgtggttcttccccaatataaatgcagaggagacaacatttagagaactggttcgtttttggcctgaaaaagatgaaggagagcggccaaagtggacatcaagacttttctatgctcttgttgctctattggtgatattactgcttaggcaccatgctcctgacgaagcagctagagccaggtaccaaaagaaggtttctaacataattgatgatgttcttgaatggtccccaaagttagctatttctggaatgattgaaaaacacactggggctaacattacagaagaaagcaattacactagcagggctgcgagtagtcatgtgcctccttccaccaaagccaaagcttcagaagccggttcagatacagatattgaggctaacttagatgaagcccaagatagtgaatatgctgatgatacaagatcaaacgaagcttaaaatcagctttatcttgtagttttttgagcaatctttgttattgttaatctgcaggatcatgtagatagcttactgctgacaacaaaaatttagggtgtcatgttttgatgttacaaccatatattgcctgcaatggttgtattctaaggttcccaaacaacattctcatagagcgcgacaaatcttcaccttttctctacacgagcatgaatctttttaatttgaaaaaaaaaaaaaaaa

SEQ ID NO: 6481 - protein, 371 aa, Zea mays
  misc_feature: Ceres CLONE 335600
  misc_feature (67)..(258): Pfam Name: Sec62 Pfam Description: Translocation protein Sec62
MAGKGAKATAAKSADKDKGKKAGGPVSRSSRAAPQENSTPKKDVYQLFAEKVRDNKQLESRWAIMQETRVEYFRGKDFNAFIKNYPEVREILGPDKDLEVEDIVNTLLTKNLVIRCDRVMKTVRPGKKKLSSWPAHLEIHNEQVFTENDGFYAWMFLKRRTLWQTVLSFVWPLFALAVCLFPVYPYQCKIVVLYSCAGALLFIVSILLLRAAIFGILWVLLGKRVWFFPNINAEETTFRELVRFWPEKDEGERPKWTSRLFYALVALLVILLLRHHAPDEAARARYQKKVSNIIDDVLEWSPKLAISGMIEKHTGANITEESNYTSRAASSHVPPSTKAKASEAGSDTDIEANLDEAQDSEYADDTRSNEA

SEQ ID NO: 6482 - DNA, 499 bp, Zea mays
  misc_feature: Ceres CLONE 335633-F
  misc_feature: Encodes the peptide sequence at SEQ ID NO. 6483
ctctagccaaaaccctagcagccgcccggtgctccctctctgcaggtggcggcgcgctcccctcgcctcccgccgaggaaccccttcacagcgcggaagatggctgaacaggaggccccagtcgcggttgaggcaccaaccccagttcttggggagcctatggacttgatgactgctctgcagctcgtgatgaagaagtcaagtgctcatgacggtcttgtgaagggtctccgtgaggctgccaaggccatcgagaagcacgccgctcagctttgcgtgcttgctgaggactgtgaccagccagattacgtcaagttggtgaaggcactctgcgctgagcacaatgttcacctggtcactgttcctgccgctaagactcttggcgagtgggccgggctttgcaagattgrctctgagggcaaggcaaggaaggttgtaggctgctctgcgtcgtcgtcaaggactacggtgaagaatctgagggccttaacatagtgca

SEQ ID NO: 6483 - protein, 131 aa, Zea mays
  misc_feature: Ceres CLONE 335633-F
  misc_feature (25)..(120): Pfam Name: Ribosomal_L7Ae Pfam Description: Ribosomal protein L7Ae/L30e/S12e/Gadd45 family
  misc_feature (104)..(104): Xaa is any aa, unknown, or other
MAEQEAPVAVEAPTPVLGEPMDLMTALQLVMKKSSAHDGLVKGLREAAKAIEKHAAQLCVLAEDCDQPDYVKLVKALCAEHNVHLVTVPAAKTLGEWAGLCKIXSEGKARKVVGCSASSSRTTVKNLRALT

SEQ ID NO: 6484 - DNA, 405 bp, Zea mays
  misc_feature: Ceres CLONE 335639-F
  misc_feature: Encodes the peptide sequence at SEQ ID NO. 6485
atcgcctccaccgctctctcttcctctgctcttctctgcctgcctgagctcaccgcacctcgcctcctcaccgcgtttcctccgttaatccggtagaaaatggccgatgccgaggatatccagcccctcgtctgcgacaacggaactggcatggtcaaggctgggttcgctggcgacgacgccccgagggccgtcttccccagcatcgtggggcgcccgcgcyacactggtgtcatggtcgggatggggcagawggacgcctacgtcggtgacgaggcgcagtccaagaggggtatcctgaccctcaagtaccccatcgagcacgggatcgtcagcaactgggacgacatggagaagactggcatcacaccttctacaacgagctccgcgtggctcccgaggagc

SEQ ID NO: 6485 - protein, 102 aa, Zea mays
  misc_feature: Ceres CLONE 335639-F
  misc_feature: SWISSPROT Homolog: EC 2.7.10.2 Non-specific protein-tyrosine kinase
  misc_feature (42)..(42): Xaa is any aa, unknown, or other
  misc_feature (52)..(52): Xaa is any aa, unknown, or other
MADAEDIQPLVCDNGTGMVKAGFAGDDAPRAVFPSIVGRPRXTGVMVGMGQXDAYVGDEAQSKRGILTLKYPIEHGIVSNWDDMEKTGITPSTTSSAWLPRS

SEQ ID NO: 6486 - DNA, 458 bp, Zea mays
  misc_feature: Ceres CLONE 335731-F
  misc_feature: Encodes the peptide sequence at SEQ ID NO. 6487
caccgcagccctagcgcgccgccaccttcaccttcccaggccgccgccgccgccgcctccattgctgctaaacccgcaaccatgggtcccgtgctgaagcgcccgaccccgggcacggtgcagtgcttcgggcgcaagaagacggccgtggcgtggcctacacgaagccaggccgggggatgatcaaggtgaacggcgtcccgatcgagctgctccgtcccgagatgctgcggctcaaggccatggagcccgtgctgctggcggggcggtccaggttcaaggacatcgacatgcggatccgcgtgcgcggcggcgggaagacgtcgcagatctacgccatccgccaggccgtcgccaagggtctcgtggcctactaccagaagtacgtggacgaggcggcgaaaaaggagatcaaggacatcttcatgcgctacgagcgcaccctcctcgtcgccgac

SEQ ID NO: 6487 - protein, 93 aa, Zea mays
  misc_feature: Ceres CLONE 335731-F
  misc_feature (1)..(93): Pfam Name: Ribosomal_S9 Pfam Description: Ribosomal protein S9/S16
MIKVNGVPIELLRPEMLRLKAMEPVLLAGRSRFKDIDMRIRVRGGGKTSQIYAIRQAVAKGLVAYYQKYVDEAAKKEIKDIFMRYERTLLVAD

SEQ ID NO: 6488 - DNA, 478 bp, Zea mays
  misc_feature: Ceres CLONE 335747-F
  misc_feature: Encodes the peptide sequence at SEQ ID NO. 6489
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggaggcgtccctgtcgtgcgtccgctcgtggggcgggcgcgctctcgtccatc

SEQ ID NO: 6489 - protein, 131 aa, Zea mays
  misc_feature: Ceres CLONE 335747-F
  misc_feature (10)..(130): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MVSSSMDTTSDKRASSMLAPNPGKATILALGHAFPQQLVMQDYVVDGFMKNTNCDDPELKEKLTRLCKTTTVRTRYVVMSDEILKNYPELAQEGLPTMNQRLDISNAAVTQMATEASLSCVRSWGGRALVH

SEQ ID NO: 6490 - DNA, 719 bp, Zea mays
  misc_feature: Ceres CLONE 335786-R
  misc_feature (531)..(531): n is a, c, t, g, unknown, or other
  misc_feature (667)..(667): n is a, c, t, g, unknown, or other
  misc_feature (719)..(719): n is a, c, t, g, unknown, or other
tcgaggtcgacggtatcgataagcttttttttttttttatttcttttttttttaggactcaaacggaccagtatatatatagtagtaatacgtaattcctgagcacggatctggatgtaccaacatcgaacgggtacaaagctcacttttcctgaaggtgattgcaaacgtatgtgtgaccgagaaatataaacaaacagaaatatgatcttagtgcgcggcttgcaataatggaggacacacgtctgaatttcgatggaccgatgaactgagactggattcgcaggcgacgtgatgtacgaagctacactaactacataacctatcttgccggaaacggattgaggcgcggtgtggggatgaggaggagatggttagtccgggcggtgaccagccccgctgcctcctccatgtccaaggggggacactttatattgatccggcgggatgggcacctcccaggggaagcactgcaccagcgcggcgaggaaggccggcacggcctgcatggctaggcccattataggaagngtatagatatattctcccaagcggcatgagctgcatgtgctgggccttgggagtgacgccggcgccggcgccgccgggcatgaagcgctcgggccggaaccggagcgggtccccgaagagtagaaaaagaaagggntttcagcttttttattttctacaccggcgtgtttgtgaggatgtgacgtagn

SEQ ID NO: 6491 - DNA, 502 bp, Zea mays
  misc_feature: Ceres CLONE 335793-F
  misc_feature: Encodes the peptide sequence at SEQ ID NO. 6492
ctctccatctcctgtctctttctctttctacaaagtcgcttgcgaacagccggtgctgcctgctgccgctgtgttggagagaaagaaagcgagcgagcgaggagggaggagggagagggaccgcaaatccctcggtcgctttcgacggcctggatctcccgcacgcgggatcgtacgaccggcacgctgctgtcgctttccaccgcatagtaaattgccaaggctgttgtaatgggggcaaatggtcatcatgaacctcgcagaggatgtaatggcaccgtctgcaatggtagtataagaccactcgattactttggtgatgtagatccatggacggcttgggcatacaagcctcgaacgatctcgctcttgctgacgggaacatgccttttaatttgggcaagtggtgctctcgatccagaaaggagctcatctgctgatcgtgtttggtcagtcaagaggggtgtatttgcgatgattgctgttttttttggcttactct

SEQ ID NO: 6492 - protein, 90 aa, Zea mays
  misc_feature: Ceres CLONE 335793-F
MGANGHHEPRRGCNGTVCNGSIRPLDYFGDVDPWTAWAYKPRTISLLLTGTCLLIWASGALDPERSSSADRVWSVKRGVFAMIAVFFGLL

SEQ ID NO: 6493 - DNA, 458 bp, Zea mays
  misc_feature: Ceres CLONE 335809-F
  misc_feature: Encodes the peptide sequence at SEQ ID NO. 6494
accctctagccaaaaccctagcagccgcccggtgctccctctctgcagatctcccttcgcagccgccgaggaaccccttcacagcgcggaagatggctgaacaggaggccccagtcgtggttgaggcaccaaccccagttcttggggagcctatggacttgatgactgctctgcagctcgtgatgaagaagtcaagtgctcatgatggacttgtgaagggtctccgtgaggctgccaaggccatcgagaagcacgccgctcagctttgcgtgcttgctgaggactgtgaccagccagattatgtcaagctggtgaaggcactctgcgcggagcacaatgttcacctggtcactggttcctgccgctaaagacccttggcgagtgggctgggctttgcaagattgactctgagggcaaggcaaggaaggttgtaggctgctcctgtgtccgtcgtcaag

SEQ ID NO: 6494 - protein, 91 aa, Zea mays
  misc_feature: Ceres CLONE 335809-F
  misc_feature (25)..(92): Pfam Name: Ribosomal_L7Ae Pfam Description: Ribosomal protein L7Ae/L30e/S12e/Gadd45 family
MAEQEAPVVVEAPTPVLGEPMDLMTALQLVMKKSSAHDGLVKGLREAAKAIEKHAAQLCVLAEDCDQPDYVKLVKALCAEHNVHLVTGSCR

SEQ ID NO: 6495 - DNA, 517 bp, Zea mays
  misc_feature: Ceres CLONE 335816-F
  misc_feature: Encodes the peptide sequence at SEQ ID NO. 6496
agtcggatccaaacggagcctacataacccttcccttcctcgcttccctcctccccgcgccgccataccctcgaacccgagaggaaccctaacaccaaaacgcccccggaggcagctaggagagctcgaatcaccagccatgtcggagcacgacctcacggcgctgatggcggcgcagctggaccgccacctggtgttccccctgctggagttcctccaggagcggcagctctactcggagtcggagatcctggaggccaagatccgcctcctcagcggcaccaacatggtcgactacgccatggacatccacaagtccctctacggcaccgacgacgtgcccgaggacatggtgaagcgccgcgccgaggtcgtctccaggctcaggtcgctcgaggaggccgcagcccgctcgtcgccttcctccagaacccgcagctcgtgcaggagttcaggccgacaaacagtacaacatccacatgctccaggaagcgayaccagatcggtcctgaccaga

SEQ ID NO: 6496 - protein, 126 aa, Zea mays
  misc_feature: Ceres CLONE 335816-F
MSEHDLTALMAAQLDRHLVFPLLEFLQERQLYSESEILEAKIRLLSGTNMVDYAMDIHKSLYGTDDVPEDMVKRRAEVVSRLRSLEEAAARSSPSSRTRSSCRSSGRQTVQHPHAPGSDTRSVLTR

SEQ ID NO: 6497 - DNA, 499 bp, Zea mays
  misc_feature: Ceres CLONE 335868-F
  misc_feature: Encodes the peptide sequence at SEQ ID NO. 6498
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggaggcgtccctgtcgtgcgtccgctcgtggggcggcgcgctctcgtccatcacccacctcgtgtacgtctcgt

SEQ ID NO: 6498 - protein, 138 aa, Zea mays; identical to SEQ ID NO: 5562
  misc_feature: Ceres CLONE 335868-F
  misc_feature (10)..(138): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase

SEQ ID NO: 6499 - DNA, 367 bp, Zea mays
  misc_feature: Ceres CLONE 335902-F
  misc_feature: Encodes the peptide sequence at SEQ ID NO. 6500
gcctcggccgctctggcgcttgtgcggtgggtgaagcgcgggtgctggtgcgggaagcctcgccagacctagcgctgccgactgccgagctgggtgcgggcgcgaggagtcgacgggaagacaagggtgaggaattatgagtgaaacagggcacactgtacaagtcactaacctctcgagcagagtatctgaaagtgatcttcatgagttcttttcgttctctggtcctattgagcatatagaacttatcagatcagaaggatacggtgccactgcttatgtatttccaattccatgtgattgtggccttgtgccgacgttcctcactcttgattatgtagcagtatataactatcaacgacaaaaa

SEQ ID NO: 6500 - protein, 77 aa, Zea mays
  misc_feature: Ceres CLONE 335902-F
MSETGHTVQVTNLSSRVSESDLHEFFSFSGPIEHIELIRSEGYGATAYVFPIPCDCGLVPTFLTLDYVAVYNYQRQK

SEQ ID NO: 6501 - DNA, 750 bp, Zea mays
  misc_feature: Ceres CLONE 335913-R
  misc_feature: Encodes the peptide sequence at SEQ ID NO. 6502
  misc_feature (524)..(524): n is a, c, t, g, unknown, or other
ccaattgggtaccgggccccccctcgaggtcgacggtatcgatattttttttttttttttttggttttttttttttttttttttttttttttttttttttttttttttttaaaaaaaacaaaaatagcccttcttattttgttccccaacaaggaagggacaccacttggacaaaaaaaaaaaaaatagggggtccaataagttataaaaaaaacatagcacatgagcgcacaccttacgcccccagcgccagcgcgacggcggtcgtcactgcggcggtcacccatcgagcggacaggtacaacggcgcggcggcagccttgtccccggcatcatcggacaaatcgtcctcggcaaacgggccatctgcaaattcatcgtccgagggcgcggaagccccccaaatgccggtgggcttcttcttgctcttcttcttgggcccttgtggagccggcgcaggcgcaagatcaacggttttggccttgaacagctccttaggctgcaggaacttggagcaagcttanacagctattaagaacccggggcctaaaaacaaactaacccccccccgggagaaatggaaaggggaaaaaaaacccttttaagaccccttttttattttgggggggttccccccccccccaaaggttttcccaaaaggggtttacctttgtgagcaccccatttaaaaaaaaacgttctgtttttccttttctcttttaaagggcaccccccacaaaacctttggat

SEQ ID NO: 6502 - protein, 62 aa, Zea mays
  misc_feature: Ceres CLONE 335913-R
PIGYRAPPRGRRYRYFFFFFLVFFFFFFFFFFFFFFLKKTKIALLILFPNKEGTPLGQKKKK

SEQ ID NO: 6503 - DNA, 504 bp, Zea mays
  misc_feature: Ceres CLONE 335926-F
atctcttagagacgcaaggttctctgttctctcttccttttcaccattccagtcacgatttggagcgattcgttcgttcctggtattcttgtgttgatctagccagtggtgattggaagtgggagaaagtggagctgcgctcgtgagtttcttgtgccctgttgctgtgctcaagcacctgtgtggtgccgtgcatcctctctggttactatctaccgtggcctggtgcttgagtttcctactgcgcggtgttcctcttctcgggctagtgccgtggacgtctccctcggcctcagcagcgactctagtatctccgtcaacctcccgccatgcaggtccggacgtgggcggcggaattggttttctgggacagaaccttgtgttcgctgagctggtcttcccacgtagacaatctacgtgcttgatgtcggctgttcccgaggctgcatccagatgatgctgatgatgcagcgaaggccgacgcactagcggagaaggccaagt

SEQ ID NO: 6504 - DNA, 720 bp, Zea mays
  misc_feature: Ceres CLONE 336076-R
  misc_feature (45)..(45): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (720)..(720): n is a, c, t, g, unknown, or other
ggggagaggggaaaaggaagaagaagaaaaacatccttctttttnttatttnnnttaacgaattgggtacgggccccccctcgaggtcgacggtatcgatattttttttttttttttttgtccacgcgcacatggcttacattcaaacaagcgagccaaactgccacatacaaacacacgagatttcgtcccactctcacacacaagaagaacaagtcgcagcaaacagagatttaactgcagggacgaactttatcaaaaagaagggaagagtcggagagagacagagagagttgaaaaaaaaaaaactcgacagctagacaaactgggccaattaactgtggcggcagcagaaccgcactccaggccaggccggcaggcaggcacaggcacgcagccaccacacatggcgcaatcgactctgcaaactatactggaactacgtactagctactgatggctagccggacggcgctggcagacgcccggcgcgacgacgccctgcgttcaaatgtcgacggcgatgtcagccgaggccggcggtgcggcgggggcgtctgtggaaggccccatccccgtcgagcgcagcgtcgggtctccccttaagacgcagcaacctggtgtgcgcacggactcacgccggtcactaggcagagcgagaccacctcaaagggtataggcctatccgtgaaacacttaccctagtccgccctcccaggn

SEQ ID NO: 6505 - DNA, 458 bp, Zea mays
  misc_feature: Ceres CLONE 336081-F
  misc_feature: Encodes the peptide sequence at SEQ ID NO. 6506
actacttaactcgcaggccgcggccccctagaccttcctctcacttcgcgggcacgcagagagccgcaagacgcacctcgctcgcaacttgttggactcgaaggggcaataggcagcaggcagggccccgaactgcgggaggagattcccaaggatcccgtcggcctggtagaggaagggacggggactggcgatggcggtggacggcggcggcggggtggactgggagagcctggcggaggccacctccggggcaatcggctcgctcgtcagcaccaccgtgctctacccgctcgacacctgcaagaccaagttccaggccgagctccagacgcaccagggsgcgcagaagtataggaacctttcagatgtcttttgggaagcgatttgtaaaaagcaatttttgtccctatatcagggcctgaacacgaagaacattcagtcttttgtctcctcgt

SEQ ID NO: 6506 - protein, 88 aa, Zea mays
  misc_feature: Ceres CLONE 336081-F
MAVDGGGGVDWESLAEATSGAIGSLVSTTVLYPLDTCKTKFQAELQTHQGAQKYRNLSDVFWEAICKKQFLSLYQGLNTKNIQSFVSS

SEQ ID NO: 6507 - DNA, 428 bp, Zea mays
  misc_feature: Ceres CLONE 336137-F
  misc_feature: Encodes the peptide sequence at SEQ ID NO. 6508
aaacatgatcgatcgatcgaccccgcgcgccagccatgcagatgcaggccctcgccctgcccacgatggagtcggagctgagggctctcgcgtgggcgacgttgctcaccccagcgtgcgcggtgtacgcgcggttcgccgctcgccgccttcgccccggcgtcccgcgcctggccgcgctcttcccgacattcccggtgttcgtgtacatgccctggatgttcaactccctccacctgcgcctcttctccaccttcttccacacctggctggccatcaacaggctcgtcctcctcgcgctcgacctcggcccgctccacccgcgcctcccgctcctgccgttcgtcctctgcgccggcctccccatcaaggtccgtctccagcagccgacgaagaaccaagcgtcgtcgtcgtcgtcgtcgtcgtca

SEQ ID NO: 6508 - protein, 131 aa, Zea mays
  misc_feature: Ceres CLONE 336137-F
MQMQALALPTMESELRALAWATLLTPACAVYARFAARRLRPGVPRLAALFPTFPVFVYMPWMFNSLHLRLFSTFFHTWLAINRLVLLALDLGPLHPRLPLLPFVLCAGLPIKVRLQQPTKNQASSSSSSSS

SEQ ID NO: 6509 - DNA, 517 bp, Zea mays
  misc_feature: Ceres CLONE 336149-F
gaaaaatccggcccgtgaaaaaagtcacaggactctactgtatgtcgcatggaacgattgcacagccctgcttagcagtaatctcgaaccgtcgaacgcgttgaggaatcagtttagttctcgctaatcagccacccgacccggggcattaaacatcagctaaccacccttgggctcaataccagcgctctatataaaccgtggctctggttcccatccattgcatccccctttctgctcctgtgctgcgtccaccagcctcgtcgttaggacgtaaggtaagacacccaggggcgagccagtgagtacagagagtagccttacgtagcgaagctcagagcaagcgagggtacggtcaaggggggtgatggcgctgtctcgacgcatggcggctcccgtcctcgtcctcatgctcctcctcgtcgccacaggtgcccgactcaactcctcgttgctcgtcagtgctgcttgagtgaccccttcaaagtaaagttcacagtaatgcgacgcgcttggt

SEQ ID NO: 6510 - DNA, 436 bp, Zea mays
  misc_feature: Ceres CLONE 336178-F
  misc_feature: Encodes the peptide sequence at SEQ ID NO. 6511
aagcgcaaagatcaggcggccgccatggcggatcagttcgcggattcggcgaacaacgtgatcatcgaggaggtgaacaagggcctgaacccaggaatggtggttctgctcgkggttgccagcttcctgctgctcttcttcgccgggaactacgcgctgtatgtgtacgcgcagtaagacgctcccgcccaagaagaagaagccggtctccaagaagaagctgaagagggaaaagctgaagcagggggtctccgctccaggggagtgaacagacagggatgccgccgatcggcccgtcctgagcccgccccctatttacatgattgtcgaagaaaaaagatacacctgctggagccgcggtgttcgtagtaattttgttctgtagatgccttttgttgtcttcgatggtaktgcattttgtattgggacaccttgt

SEQ ID NO: 6511 - protein, 50 aa, Zea mays
  misc_feature: Ceres CLONE 336178-F
  misc_feature (30)..(30): Xaa is any aa, unknown, or other
MADQFADSANNVIIEEVNKGLNPGMVVLLXVASFLLLFFAGNYALYVYAQ

SEQ ID NO: 6512 - DNA, 497 bp, Zea mays
  misc_feature: Ceres CLONE 336200-F
  misc_feature: Encodes the peptide sequence at SEQ ID NO. 6513
aacctctagctgattgatctctggtttaccactctttccttccctccttcaattctaaataccacaaatcaaagttgctttgcgatggtgagcabcagcatggacacgacgagtgacaaacgtgcgtcatccatgctggctcctaaccctggcaaggccacgatcctcgcccttggccacgccttcccgcagcagcttgtcatgcaggactacgtcgtcgacggcykcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgactgatgaatcagcgtctggacakctcgaacgcggcggtgacgcagatggcgacggaggcgtccctgtcgtgcgtccgcgtcgtggggcggcgcgctctcgtccatcacccacctccgtgtacgt

SEQ ID NO: 6513 - protein, 137 aa, Zea mays
  misc_feature: Ceres CLONE 336200-F
  misc_feature (10)..(137): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
  misc_feature (4)..(4): Xaa is any aa, unknown, or other
  misc_feature (48)..(48): Xaa is any aa, unknown, or other
  misc_feature (104)..(104): Xaa is any aa, unknown, or other
MVSXSMDTTSDKRASSMLAPNPGKATILALGHAFPQQLVMQDYVVDGXMKNTNCDDPELKEKLTRLCKTTTVRTRYVVMSDEILKNYPELAQEGLPTDESASGXLERGGDADGDGGVPVVRPRRGAARSRPSPTSVY

SEQ ID NO: 6514 - DNA, 493 bp, Zea mays
  misc_feature: Ceres CLONE 336229-F
  misc_feature: Encodes the peptide sequence at SEQ ID NO. 6515
gtaccctactactacacgcgcctcgcaaaaagtcgccctcttcctccactcgccgacacacacggcgcaaatccccacaaccccaagcgggcgggcggacttccacccaccttctcgcgcggcgacgtgctcggctctcttccagccacctcgctcgccgcccgcctcggaatccccgccgcgagatcttgttccccggaggatggaggtgaaaacagtaaaagttagcaatctttcattaaatgctttgaaaagagagatcacagagttcttcagtttctcaggagatatagaatatgttgaaatgcaaagtgaatctgaatggtcacagcttgcttatgtcacatttaaagactcacagggagcagacactgctgttcttctctcgggggcaacaatcgtggatcgtgctgtcattataactcctgctgagaactatcagctgcctctggaagcacacaaacaattatcgggagcaaacgtctctactgaa

SEQ ID NO: 6515 - protein, 97 aa, Zea mays
  misc_feature: Ceres CLONE 336229-F
MEVKTVKVSNLSLNALKREITEFFSFSGDIEYVEMQSESEWSQLAYVTFKDSQGADTAVLLSGATIVDRAVIITPAENYQLPLEAHKQLSGANVSTE

SEQ ID NO: 6516 - DNA, 439 bp, Zea mays
  misc_feature: Ceres CLONE 336242-F
  misc_feature: Encodes the peptide sequence at SEQ ID NO. 6517
aaaaaaccacaacaagagagagagagagagacagagagagagagactgccaacgaggcgaagcagccggccaatctagcatcagcgcgcggggtctgagagcagagcggcagggcgccatggcggcatcggtggcgctgagcagcgggcaccggatgccggcggtggggctgggcgtgtggcggatggagaaggcggacatccgcggcctcatccacacagcgctccgcgtcggctaccgccacctggactgcgccgctgactaccagaacgaagctgaagttggtgacgcgctcgcagaggcattccagaccggactcgtcaagcgggaggacctgttcatcacaaccaagcttgtggaactcagaccatgggcatgtgcttgaagcctgcaaggacagcctgaagaagctgcmgctagactatctcgacctctacct

SEQ ID NO: 6517 - protein, 88 aa, Zea mays
  misc_feature: Ceres CLONE 336242-F
  misc_feature: SWISSPROT Homolog: EC 1.1.1.200 Aldose-6-phosphate reductase (NADPH)
  misc_feature: The sequence is a functional homolog of SEQ ID NO 26 in US patent 7193127
MAASVALSSGHRMPAVGLGVWRMEKADIRGLIHTALRVGYRHLDCAADYQNEAEVGDALAEAFQTGLVKREDLFITTKLVELRPWACA

SEQ ID NO: 6518 - DNA, 483 bp, Zea mays
  misc_feature: Ceres CLONE 336279-F
  misc_feature: Encodes the peptide sequence at SEQ ID NO. 6519
acaccgagaatcacaatacgaaacgaattaatccccaatcaacacagcaagtcagcaacaagcaaagcagcgatccgagagatggacgcgaggatgttcgggctggagaaccccctggtggcggcgctgcatcacctgctggacgtgcccgatggcgacgccggagcgggcggcgacaaggcgggcggcggcgccacgcgcacctacgtccgcgacgcgcgcgccatggcggccaccccggccgacgtcaaggagctcgcgggagcgtacgcgttcgtggtggacatgccggggctgagcacgggcgacatcagggtgcaggtggaggacgagcgggttcttgtgatcagcggcgagcggcgccgggaggagcgcgaggacgccaagtacctgcgcatggagcggcggatgggcaagttcatgcgcaagttcgtgctgccggacaacgccgacgtggacaaggtctccaaattcagactcatt

SEQ ID NO: 6519 - protein, 134 aa, Zea mays
  misc_feature: Ceres CLONE 336279-F
  misc_feature (55)..(134): Pfam Name: HSP20 Pfam Description: Hsp20/alpha crystallin family
MDARMFGLENPLVAALHHLLDVPDGDAGAGGDKAGGGATRTYVRDARAMAATPADVKELAGAYAFVVDMPGLSTGDIRVQVEDERVLVISGERRREEREDAKYLRMERRMGKFMRKFVLPDNADVDKVSKFRLI

SEQ ID NO: 6520 - DNA, 503 bp, Zea mays
  misc_feature: Ceres CLONE 336289-F
  misc_feature: Encodes the peptide sequence at SEQ ID NO. 6521
gacagctgtgacgtgacgtgagtgacttgagcagatccgactccgagaggcgggtaccaaccgcatccctaatacagatcgagtgtcccgtagccactccacgtctccacgctccacggtcacactcggaacctcagctcagaggatcggaagaacggacggcgagatggcaagcggggaagaaggcaagggcgagacggtgctggtcaccggggccagcggcttcatcggctcgaccctcgtccgcggcctcctcggccgcggctacaacgtccgcgccggcgtcctcgaccccgacgacagggcggagacggaccacctcctcgcgctcgccgccggcgccggcgccggccgcctcagcttcttccgctgcgacctcctggacggcgccgcgctgctcgacgcggcaagggggtgctcgggcgtcttcacctcgcgtcaccctgcaccgtcgaccccgtcaaggacccccagaatcagcytgatggtgcctgcggtggaag

SEQ ID NO: 6521 - protein, 112 aa, Zea mays
  misc_feature: Ceres CLONE 336289-F
  misc_feature (7)..(111): SWISSPROT Homolog: EC 1.1.1.219 Dihydrokaempferol 4-reductase
  misc_feature (1)..(36): SWISSPROT Homolog: EC 5.1.3.2 UDP-glucose 4-epimerase
MASGEEGKGETVLVTGASGFIGSTLVRGLLGRGYNVRAGVLDPDDRAETDHLLALAAGAGAGRLSFFRCDLLDGAALLDAARGCSGVFTSRHPAPSTPSRTPRISLMVPAVE

SEQ ID NO: 6522 - DNA, 665 bp, Zea mays
  misc_feature: Ceres CLONE 336326-R
  misc_feature: SWISSPROT Homolog: EC 2.4.1.14 Sucrose-phosphate synthase
cgaattgggtaccgggccccccctcgaggtcgacggtatcgataagcttttttttttttttttttgagaggaaatataatttaatatgtatactatgtgcaccaaaagattcatgtacacttataccataagccccttccaaaaaaataaaagtaaccgaaaacaaaaacatgtatcttttttatataaagtttgcagtcattcgctgtgaaattttaactggccgtccaaaataaccccagcagagtgtggaaccaacagctggaatgtcggagcagatcatgtatcataatcccggactctcaaatagccttgaggatgtcgactgccgcctggtactcggcgagggtgaggatattcggggagtccatggagaagaagtcctctgccagaaacccgtcttggtcgcggcgcagctcctcgctgccgtggcaaactagctccggcaggaccagcgttctgtgcaggccagggagcagccgttcgcggtcggtgtcgcccttgtcgcccacgagcacggccaccttggacaggtcgatgccccattgtatcgacaggtacctgagcgcgcgcggccgccacgcccagagcgggatgacgttgaggcgcgtgcacgcgcgcgtgtacacgaggttgcaccggaacccgcgcatgcgcagcgactg

SEQ ID NO: 6523 - DNA, 517 bp, Zea mays
  misc_feature: Ceres CLONE 336366-F
  misc_feature: Encodes the peptide sequence at SEQ ID NO. 6524
acgaagagccgactcaaccgctagtacagtccacacatgacacaacgacaccaactgtcctcaatccagcagccctcgagtctcgtccccgcacatcagcagagagacgccactaccaccaccgcaagcgacgacggggagatgtttctgcgacggatcctgaccggcggaggtggcctggcggcgctgaaggcggcgcgcgccgtgaaggagacgacggggatcgtcggccttgaggtggcgcccaacgcgcgggaggttctcatcgggctctacacgcgtacgctcaaggagatcgaggccgtccccaaagacgagggctaccgcaaggccgttgagtccttcaccaatcaccgcctccagatctgccaggaggaggacgactggaagcgcatcgaggaccgaatcggatgcgggcaagtcgaggagctcatcgaggaggccgaggacgagctcaagctcatcgccaaaatgattgaatgggatccgtggggtgtccctgatgactacgaatgtg

SEQ ID NO: 6524 - protein, 125 aa, Zea mays
  misc_feature: Ceres CLONE 336366-F
  misc_feature (35)..(91): Pfam Name: ETC_C1_NDUFA5 Pfam Description: ETC complex I subunit conserved region
MFLRRILTGGGGLAALKAARAVKETTGIVGLEVAPNAREVLIGLYTRTLKEIEAVPKDEGYRKAVESFTNHRLQICQEEDDWKRIEDRIGCGQVEELIEEAEDELKLIAKMIEWDPWGVPDDYEC

SEQ ID NO: 6525 - DNA, 308 bp, Zea mays
  misc_feature: Ceres CLONE 336398-F
  misc_feature: Encodes the peptide sequence at SEQ ID NO. 6526
aagaaaatgaaccctaaaacctcagccccggcgcacccgaaccggcgacgaggcccgcaaacaacaccgctagccatgtggcgccgcgcctcccacctcctcatccgcaccgccgccgccgccgccgcccccacccgccgcctcccacttcctcactcgccgctacccatcgccccaagagtggcctccgcatcctcatcctatgccacagcggtcgcggcgagggcaccgcggacggtagkgaccctgctgcggctcaacgacctgtgtgacaacccgggcgcgcggaagcagaagacgcgcaaggg

SEQ ID NO: 6526 - protein, 77 aa, Zea mays
  misc_feature: Ceres CLONE 336398-F
  misc_feature (56)..(56): Xaa is any aa, unknown, or other
MWRRASHLLIRTAAAAAAPTRRLPLPHSPLPIAPRVASASSSYATAVAARAPRTVXTLLRLNDLCDNPGARKQKTRK

SEQ ID NO: 6527 - DNA, 126 bp, Zea mays
  misc_feature: Ceres CLONE 336551-F
aggaaataacaggagaggggacgcgcgctcactagcaaaatgcaggcctcttccctccggcgagccctccttctgcggggaccgcgaggcgcccagctcttccccattcccgtaaccaccacaccc

SEQ ID NO: 6528 - DNA, 518 bp, Zea mays
  misc_feature: Ceres CLONE 336572-F
  misc_feature: Encodes the peptide sequence at SEQ ID NO. 6529
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggaggcgtccctgtcgtgcgtcccgctcgtggggcggcgcgctcctcgtccatcacccacctcgtgtacgtctcgtcgagcgaggcgcgcttc

SEQ ID NO: 6529 - protein, 144 aa, Zea mays
  misc_feature: Ceres CLONE 336572-F
  misc_feature (10)..(133): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MVSSSMDTTSDKRASSMLAPNPGKATILALGHAFPQQLVMQDYVVDGFMKNTNCDDPELKEKLTRLCKTTTVRTRYVVMSDEILKNYPELAQEGLPTMNQRLDISNAAVTQMATEASLSCVPLVGRRAPRPSPTSCTSRRARRA

SEQ ID NO: 6530 - DNA, 530 bp, Zea mays
  misc_feature: Ceres CLONE 336574-F
  misc_feature: Translation starting site: 141
tttgaagccccatttcggtataccctgctccaccgttccggtcctcccgaaaagctaagggagacgagcagcctaaaaaccctagcccccgaatcagatcccaccgcccgccggagcgcggaaccctgcccccggccgccatggacatgagcgatgcggagcggctgttcttcttcgagatggcctgcaacaactccgaggtcgcgtacgagcagaaccccaacgacgccgacaacttgacgcgatggggcggagcgctgctggagctatcgcagctgcgtaacggcccgacagcttcaagctcctccaagatgcggaagccaagctggaggaggcactgcaaattgatcccaacaagtctgatgcactctggtgcttgggaaatgctcagacttctcatggattcttcactccagacactgcaattgcaaatgagttctttgcgaaggcaactgaatgtttccagaaggctgctgatgtggaacctgcaaatgagctgtacaggaagtcatagacttgtcagcgaaggc

SEQ ID NO: 6531 - DNA, 304 bp, Zea mays
  misc_feature: Ceres CLONE 336575-F
  misc_feature (42)..(42): n is a, c, t, g, unknown, or other
  misc_feature (136)..(136): n is a, c, t, g, unknown, or other
  misc_feature (137)..(137): n is a, c, t, g, unknown, or other
accaatggcattcttgcattgaaggaaccttccctccacctncccaccgcccgagagcgagcggccggacggggttttggttgggcatggctgccccggcgatgctccaagtggtgatcctcgccgcggtcctccnnttttctcccgttcctcagcgtgccgggcgccgaggcacagaccaagaagttctgcctcacgcagttcgccatcgctagccaggcctgcgccaattccctggccacccaccagtcctgagcaccaccaccatcatcacgatgacgaggacaatgacgaggacaacgac

SEQ ID NO: 6532 - DNA, 1775 bp, Zea mays
  misc_feature: Ceres CLONE 336632
  misc_feature: Encodes the peptide sequence at SEQ ID NO. 6533
aaatccttgctgccctccctcctccgacgccggaggccatcagaaacgcgcgtgcgcgcccgcgcaaccaccaccacaacccctttcctatccacgttctccggcctcgctcctactgtctcccggtcggccgcccaccggccatcgttcgtctcatcccatgggtgttggggcgatggaagcctcttctccggccggcgacgacgtcggcggcacgggcatcgaggacctcccggcggacgtcctcgccctcgtgctccgccgcctggatggcgcgtcgctggcggcggtcggctgcgcgagctccggcctccgcagcctcgccaccgacccggccacgtggcgggcgctctgcttcgccatgtggccctccgtccgcgacctgccctgcacaggccgcgtcgacggcggtcaccgggcgctcttcgccgacgccttccccttcccgtgctcggtctcccctcccacgccgccgcagcccctgcccgcgcgcctcgtgtcggccgtcgacctgcgccacgcgggggtctgcgtcctgtcgcgcgtcgtggagacggacgccgcctccgactggttcctgggcgcgccgttccgcgtcgacgcgctgctgcaggagggcttcacgtcgccggccgccgcggcgatcgcgccggccgacctcgagctcagctgggtcctcttcgacccggccaccggccgcgcgctcaacgcgtccagccgccgcgccgtggccgtcgaccgcaagtggctcacgggggacaccgtggcgcgcttcgccgtcgtgctcggcggcggcgtcgcgctcgacgccgccgtcacgtgcgacgagcgccgcggccacgtccgggaggtcagcctgcgcgtcgaggacgcggacggcgccggcgtcagcggcagggacgggctggctgccgtcgccgccgccatggccgcgcccaggcgggggtgccgcggcgcggcggaggacgcggccaggctcaggtacgaggagttcgtcagggggaaaagggcgcgcaaggagtcgaaggccaggcgcgagggcatccttgacctctgctgctctggcgtcggcgccgccgccttcctcggcttcctggtcatgctcacgttccggtgaactcgtccgattcggcccgcccgggcattcgggcatcgcgaacaccacaaccactagagagtgccgttgacatgtacagtgtagttcagggaatgtgaatatgattgggttgtaggttatacggtcgcctgtcaaacaacagggaaagtcagcatcatatctctcttttttttctccttttccagaaagcgaagttaataagaattaaaaaaaaacttctagaatctcagtgctgtaatttgtccacgccaaagcacatcaaattccaacgttcttgaacaggctagttttacttccgcttctcacactgccaacacggatatttggaaccaagggaccccacagatactaccaaccattcctatagtactctacaccaatacactaacacaaacctatacaatagtacgggaagggaagcatgcaaaaaagtcaaaggaaaattacaggcacattcttgccacgagccagaaaactcccgacaagactaagcaagcagcctatacaagtgatctctgcaattcccggcacaccagatcaacgaactcgtcgctctgtcaggcatttggtgagagttagagaaaatgatgataccgatccaaaacagttgtaccctgtatgttttcagtgtggacaatttataaaaaaaaaaaaaaaa

SEQ ID NO: 6533 - protein, 318 aa, Zea mays
  misc_feature: Ceres CLONE 336632
  misc_feature (19)..(66): Pfam Name: F-box Pfam Description: F-box domain
MGVGAMEASSPAGDDVGGTGIEDLPADVLALVLRRLDGASLAAVGCASSGLRSLATDPATWRALCFAMWPSVRDLPCTGRVDGGHRALFADAFPFPCSVSPPTPPQPLPARLVSAVDLRHAGVCVLSRVVETDAASDWFLGAPFRVDALLQEGFTSPAAAAIAPADLELSWVLFDPATGRALNASSRRAVAVDRKWLTGDTVARFAVVLGGGVALDAAVTCDERRGHVREVSLRVEDADGAGVSGRDGLAAVAAAMAAPRRGCRGAAEDAARLRYEEFVRGKRARKESKARREGILDLCCSGVGAAAFLGFLVMLTFR

SEQ ID NO: 6534 - DNA, 506 bp, Zea mays
  misc_feature: Ceres CLONE 336690-F
  misc_feature: Encodes the peptide sequence at SEQ ID NO. 6535
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggaggcgtcctgtcgtgcgtccgctcgtggggcggcgcgctctcgtccatcacccacctcgtgtacgtctcgtcgagcgag

SEQ ID NO: 6535 - protein, 140 aa, Zea mays
  misc_feature: Ceres CLONE 336690-F
  misc_feature (10)..(137): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MVSSSMDTTSDKRASSMLAPNPGKATILALGHAFPQQLVMQDYVVDGFMKNTNCDDPELKEKLTRLCKTTTVRTRYVVMSDEILKNYPELAQEGLPTMNQRLDISNAAVTQMATEASCRASARGAARSRPSPTSCTSRRA

SEQ ID NO: 6536 - DNA, 1470 bp, Zea mays
  misc_feature: Ceres CLONE 336712
  misc_feature: Encodes the peptide sequence at SEQ ID NO. 6537
aaaccaccgtgcatcaaaccctaggcgaacccgaaccaggaacaccgccaacgccgacgggtggtggagctccgcttcgaccgcgcttctccagccatggctggccgcctccaccgcgcctctccgtcactcccccaacgccatgagtctgtaacggcacacgtaccatgggcaggaccagaggcaacaggggcgtgggcggcgcgaagtcgttcccgtcgccggcgtcgtcctcggcctcgtcgtcggagttcgagttcacggtcacgctgtcgccggcgtccaagcagcggtcggcggagcagctgtgcccggccgacgagctcttctacaagggccagctcctgccgctgcagctatcgccgcgcatctccatggtgcgcacgctgctgctgtcctcggcgtccacgtcgtccgcctccgcgtccgactccaccaactcctcctcccgcgactccaacggcagcacgtcgtcgtccttctccgccgactgcggcgcgctcctgggcccggactcggcggcctcgtcgtctcgccccagctccgccaccgaggacgaccgccacctgcatccgccgtcggccgccgcggggctgctgccacccgccaagcgcaccgggaagcagtacctctcgtccttcgccacgcgcttctcctcggtcttccaccgcggcggcgccggcgctccggccgcgaagaagcagccgtccaagtcgctcgccaaggaggtgatcaagaagtacgctaagaaggtgaaaccgctctacgaaaggctctcccagatccccaacaagaaccagaacaacgtcgtcaacggcaacagccaaccgcagcataggttcaagaagcccttcaccttctccatccgcaagaaaaagggcgacgccgtcgcggcagtggtggaggcggcagcagaggttggcggcaacaagtacgcgcactccagctccttctccggaaacctctggttcccgcgccagaagcgggccacggcgagctgcccgtcatcgatgcagtcgtcgcctagccactcgggtctgctcacctttggcggggctggcggcgtgggcttccccgacgtgccggccgttgccagcggcattggcgtcggtccggtgtcgttgtccacggcatcgtccatggaggagctccagagcgctatcgagggcgccattgcgcactgcaagaacacgatgggcggaaccgtgtcggtcaaggcggcggcggcggccgccgacgagatctgcacgttctgagcgcgaccacgctaggattccggggggagctaagtaaagcaggctgttttaatcggtagcagtacttatctgttattagcaaatttaatttcgtccgtctccttttttttttttgggttaagactctatggtcatggtcgtaaataggggtagttcggagggggttaaagatgatagtcggagcctttttcgatcaaaaaaaaaaaaaaaaaaa

SEQ ID NO: 6537 - protein, 362 aa, Zea mays
  misc_feature: Ceres CLONE 336712
MGRTRGNRGVGGAKSFPSPASSSASSSEFEFTVTLSPASKQRSAEQLCPADELFYKGQLLPLQLSPRISMVRTLLLSSASTSSASASDSTNSSSRDSNGSTSSSFSADCGALLGPDSAASSSRPSSATEDDRHLHPPSAAAGLLPPAKRTGKQYLSSFATRFSSVFHRGGAGAPAAKKQPSKSLAKEVIKKYAKKVKPLYERLSQIPNKNQNNVVNGNSQPQHRFKKPFTFSIRKKKGDAVAAVVEAAAEVGGNKYAHSSSFSGNLWFPRQKRATASCPSSMQSSPSHSGLLTFGGAGGVGFPDVPAVASGIGVGPVSLSTASSMEELQSAIEGAIAHCKNTMGGTVSVKAAAAAADEICTF

SEQ ID NO: 6538 - DNA, 94 bp, Zea mays
  misc_feature: Ceres CLONE 336747-F
aagaaaatcacagcagtacagcaccagaaacmgaaaggtcgtagatcaaggaacgccagtgcggcgacaatgaycggccgtggaagcacgggcg

SEQ ID NO: 6539 - DNA, 524 bp, Zea mays
  misc_feature: Ceres CLONE 336762-F
  misc_feature: Encodes the peptide sequence at SEQ ID NO. 6540
agaggcacatccttattggaagggcagctaataaggtaataaggggcgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgccgtcgccgccctccggcgccgccatcccggtggtggacctctcggtgacgcggcgcgaggacctagtcgagcaggtgaggcacgcggccgggacggtgggcttcttctggctggtgaaccacggagtgccggaggagctgatgggcggcatgctccgcggggtgcgccagttcaacgagggccccgtggaggcgaagcaggcgctctactcgagggacctcgctcgcaacctgcgcttcgcctccaacttcgacctcttcaaggctgctgcggccgactg

SEQ ID NO: 6540 - protein, 156 aa, Zea mays
  misc_feature: Ceres CLONE 336762-F
  misc_feature: SWISSPROT Homolog: EC 1.14.11.20 Desacetoxyvindoline 4-hydroxylase
MAPTTATKDDSGYGDERRRELQAFDDTKLGVKGLVDSGVKSIPSIFHHPPEALSDIISPAPLPPSPPSGAAIPVVDLSVTRREDLVEQVRHAAGTVGFFWLVNHGVPEELMGGMLRGVRQFNEGPVEAKQALYSRDLARNLRFASNFDLFKAAAAD

SEQ ID NO: 6541 - DNA, 511 bp, Zea mays
  misc_feature: Ceres CLONE 336774-F
  misc_feature: Translation starting site: 154
actcacactctctctctctctcggcgacgtctacgccgagtgcccaggcattcttcaggcgcaggtcgctggctcgctgccgccctacaccaggtgccccggtcttcttccgtcccttcgccggcgacgagcactgccaggacagtatagcggatggcttcgtcggtgcgggcgccatcggggtcggtgatcgccgtggcatcgtcctcttcctcagcagccgcggccggggtgtgcggcacgggctcgccgtgcgccgcgtgcaagttcctgcgtcgcaagtgccagccggactgcgtgttcgcgccctacttcccaccggacaacccgcagaagttcgtgcgcgtgcaccgcttcttcggcgcgagcaacgtgaccaagctgatgaacgaaatccacccgttgcagcgcgaggacgccatgaactcgctcgcctacgagggccgacatgcgaattcgcgaccccgtctacggctgcgtgggcgtcatctccatcctccagcacaaccta

SEQ ID NO: 6542 - DNA, 495 bp, Zea mays
  misc_feature: Ceres CLONE 336775-F
  misc_feature: Encodes the peptide sequence at SEQ ID NO. 6543
ccaacccaacccaacgacgcagctagcgcgcatctccgatctgcactgcaccttcgtctccgaagaacgtcgatcgtactcgtacaccatgaaggcagtcgtcgcggcgacgatgcttctgctggtgctggtggccgcggcgacggtggcgagcgcagaccaccgtgatgacgacggccaccaccaccagcgccaccgcggccagagctggcaccgccacagcggcggcggccgagatggccgccggtcgacccctctggcggggctgacgcagtgcgtgacaagctgcgggtctggggtcacctcctgcatgctggactgctaccagccgctggtcgacctggaccccgtggagctgcccgtctgcctcctcaagtgcaccaacgacgccatggacaacttcatgccggacctgaagattatctacatcccggaggggggccacttcgtgcaggagcagctcccggatcgggtcaacgagctcctcctcgactt

SEQ ID NO: 6543 - protein, 135 aa, Zea mays
  misc_feature: Ceres CLONE 336775-F
MKAVVAATMLLLVLVAAATVASADHRDDDGHHHQRHRGQSWHRHSGGGRDGRRSTPLAGLTQCVTSCGSGVTSCMLDCYQPLVDLDPVELPVCLLKCTNDAMDNFMPDLKIIYIPEGGHFVQEQLPDRVNELLLD

SEQ ID NO: 6544 - DNA, 489 bp, Zea mays
  misc_feature: Ceres CLONE 336778-F
  misc_feature: Encodes the peptide sequence at SEQ ID NO. 6545
acgcacaaagagggacttgctcgagggtttagctagcttggaagccctccgcaaactcccatggcgtgcctcctcgtgctcgtcatcgctgccacagtactaacggtgcaacacgaagccatagcccgatcagaacatgattcagagacgcagctggtgtcaattatttttttttgtttttttgtgctgaacaatgagtcgtgtctcttgatcctcagggtccaccgggaaaactgacgcacgccgctcggacgtcgccggcggaggccttctggcatgcggccctccccggcgctcccatgcccgaggccatccgcgagctcttgcgcccagctggtgctgccgggaccaacgctccagacgccgctaggtccaggcaccacgacgccgatccgccgccgatgaacttcaagtacgaagactacaggtcctcgcgtcggaacgaagccaccgccacctccgccgaggccctggaccgcgctggcggcg

SEQ ID NO: 6545 - protein, 63 aa, Zea mays
  misc_feature: Ceres CLONE 336778-F
MPEAIRELLRPAGAAGTNAPDAARSRHHDADPPPMNFKYEDYRSSRRNEATATSAEALDRAGG

SEQ ID NO: 6546 - DNA, 640 bp, Zea mays
  misc_feature: Ceres CLONE 336791-R
  misc_feature (369)..(369): n is a, c, t, g, unknown, or other
tcgaggtcgacggtatcgataagcttttttttttttttttttattttttttttttttttttttttttttttttttttcaccccaaccaaaaaaaattccagctcctggtaaagtaaaaagtgttacagtacccggaaaaagaaagatacagatgctacatgaaggcaaaggtcagtcaaaagtacgttacatgccaaatacacactgccctgcaatttcttcccggtttgacagcttttgccgtgaaggagaccatcatcataaccatgcatcatggtcactcaaacatcaggccgatcagcctcccctgcctacagaatttgtacagctaaaaacatctgttgttgccgggggtctctctaacacgtntttcacacgtcaaggtaggggtatctttcaagcggtcacgcaatatgtcacccagcttgatgcaagcttccatacagagctctactgcattggttattctgccatcggtccactctccagtgagcgtgagctgcgtgatctccttgggggctgggatgaaagccaccacaagggttccgtcttgccatgcttccccctcctaagttggatcaatgatgatgttctttcccaaaccggccccggataccacaccttccaggggcctaccctc

SEQ ID NO: 6547 - DNA, 458 bp, Zea mays
  misc_feature: Ceres CLONE 336839-F
  misc_feature: Encodes the peptide sequence at SEQ ID NO. 6548
acgggagcggacgctgccactcgcgatatttgcgagagagagagagagagagagggcccgagagccgaggacgagtgcagtctggctggcgtgatgctgcttcggagcgcgtcctcgccgctgctcaactgcgggcgcgcgccggctgccgcggcgtcggtcgagcacctcgcggtggtttcgccgttgttatcaccggcagtggcggcgcmtaggcaggggccggtgctgtgccgcgccatgtccgagggggacctcgccgcgccgctcgtgcccaagaaggacgatggacacgggagggcgccgaggctgtcggcgtccttgtcctcgtccgcctccatcttcgtcgaggaggaggacggcgagggcgaggaggaggaggaggacctggtcgcggtcgcgggggccggcgtggacgtgccgctgccgctgcgtcggctgctgacgaacacggggct

SEQ ID NO: 6548 - protein, 121 aa, Zea mays
  misc_feature: Ceres CLONE 336839-F
  misc_feature (40)..(40): Xaa is any aa, unknown, or other
MLLRSASSPLLNCGRAPAAAASVEHLAVVSPLLSPAVAAXRQGPVLCRAMSEGDLAAPLVPKKDDGHGRAPRLSASLSSSASIFVEEEDGEGEEEEEDLVAVAGAGVDVPLPLRRLLTNTG

SEQ ID NO: 6549 - DNA, 386 bp, Zea mays
  misc_feature: Ceres CLONE 336869-F
  misc_feature: Encodes the peptide sequence at SEQ ID NO. 6550
  misc_feature (378)..(378): n is a, c, t, g, unknown, or other
acagtacacacacggaacggaatccgggcatccgggaaagcagccctaatctcaaggccgcggctgcgagcgctgcttcccacctcccaactccggaactcctccccagtcgccgccagccgcgcgcacacccaccgagagctcgggctttctttctccgttcctccctcgcgcgctcagggtttcacgatggargccgaggcggcggccaagagggcgcgggarggcggggaggacgccaccgcgccggtggcgggggccgaagcggcggtcgccggtgctggcgagcaggyggggatctccgccgtcatcccaggatggttctccgagatcagccccatgtggcccggtgaggcgcactccttgaaggtgkagaangtgctgtt

SEQ ID NO: 6550 - protein, 65 aa, Zea mays
  misc_feature: Ceres CLONE 336869-F
  misc_feature (37)..(65): SWISSPROT Homolog: EC 2.5.1.16 Spermidine synthase
  misc_feature (38)..(65): SWISSPROT Homolog: EC 2.1.1.53 Putrescine N-methyltransferase
  misc_feature (35)..(35): Xaa is any aa, unknown, or other
  misc_feature (62)..(62): Xaa is any aa, unknown, or other
  misc_feature (63)..(63): Xaa is any aa, unknown, or other
MEAEAAAKRAREGGEDATAPVAGAEAAVAGAGEQXGISAVIPGWFSEISPMWPGEAHSLKVXXVL

SEQ ID NO: 6551 - DNA, 481 bp, Zea mays
  misc_feature: Ceres CLONE 336894-F
  misc_feature: Encodes the peptide sequence at SEQ ID NO. 6552
aacgtgctcgatctccatctcgaccgtcgctcaccgggaagctacgctacgacgaagcatggcgtccgtcaccgcccgcgccccggtcgcggccctgcgcccgtcggcgtctctcaagtcgtcgtcgtcgtcggcggcggccttccttggccactctagccgcctcggccgcactgctaccgcgtcgccgacgaggcgcagcctaaaggcggaggccaagggcgagtggctcccgggccttccctcccccgcctacctcgacggcagcctgccgggtgacaatggcttcgacccgttgggcctggcggaggacccggagaacctgaggtggtacgtgcaggcggagctggtgaacgggcggtgggcgatgctgggcgtggccgggatgctgatcccggaggtgctgaccaaggccgggctgatcaacgcgccgcagtggtacgacgccggcaagtcgggagtacttcgcgtcgtcgtcgac

SEQ ID NO: 6552 - protein, 141 aa, Zea mays
  misc_feature: Ceres CLONE 336894-F
  misc_feature (62)..(141): Pfam Name: Chloroa_b-bind Pfam Description: Chlorophyll A-B binding protein
MASVTARAPVAALRPSASLKSSSSSAAAFLGHSSRLGRTATASPTRRSLKAEAKGEWLPGLPSPAYLDGSLPGDNGFDPLGLAEDPENLRWYVQAELVNGRWAMLGVAGMLIPEVLTKAGLINAPQWYDAGKSGVLRVVVD

SEQ ID NO: 6553 - DNA, 494 bp, Zea mays
  misc_feature: Ceres CLONE 336964-F
  misc_feature: Translation starting site: 67
ctagcgctggcgccgcagacccctccccttcgcttccttccctagcgccgacgcccaccagacgagatggccccgaagaaggacaaggccccgccgccgtcgtcgaagccggccaagtccggtggtggcaagcaaaagaagaagaagtggagcaagggaaagctaaaggagaaggtaaacaacgcggtgctgttcgaccaggctacctacgacaagctgctctcggaggtgcccaagtacaagcaaatcaccccttccatcctctccgagcgtctgaggatcaacggctcccttgctcggagggccatcaaggacttgatggcgcgtggcctcattcggatggtctcggtccactcaagccagcagatctacaccagggcaaccaatacataaggatggggaagaagcagctgctggtgatcgagggcatcgagtacgacccccaggcgaacaataagttcgacgtcgccatcaacctgcccgcggacaaagcg

SEQ ID NO: 6554 - DNA, 502 bp, Zea mays
  misc_feature: Ceres CLONE 336971-F
  misc_feature: Encodes the peptide sequence at SEQ ID NO. 6555
aaaacctctagctgattgatctctggtttaccactctttccttccctccttcaattctaaataccacaaatcaaagttgctttgcgatggtgagcagcagcatggacacgacgaatgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgaaatcctcaagaactacccggagctggcgcaggaggggctgccgacgatgaatcagcgtctggacatctcgaacgcggcggtgacgcagatggcgacggaggcgtccctgtcgtgcgtccgctcgtggggcggcgcgctctcgtccatcacccacctcgtgtacgtctcgtc

SEQ ID NO: 6555 - protein, 138 aa, Zea mays
  misc_feature: Ceres CLONE 336971-F
  misc_feature (10)..(138): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MVSSSMDTTNDKRASSMLAPNPGKATILALGHAFPQQLVMQDYVVDGFMKNTNCDDPELKEKLTRLCKTTTVRTRYVVMSDEILKNYPELAQEGLPTMNQRLDISNAAVTQMATEASLSCVRSWGGALSSITHLVYVS

SEQ ID NO: 6556 - DNA, 492 bp, Zea mays
  misc_feature: Ceres CLONE 336998-F
  misc_feature: Encodes the peptide sequence at SEQ ID NO. 6557
catacctccatggatgatcaaagatggcatgaatcttacaaaggaacaaagaggagagaaaattgagtcacaaaaacttgaaaaatctgaagccaaagatgataagaaacaggacttgaaagatgatcaaagacgaaggcatgcccatgtaccagaggccgttcatgaagggcaagctgtacatccacttctcagtggagttcccggactcgctgagcccggagcagtgcaaggccctggaggctgtgctgccgcccaagccggtgtcgcagtacaccgacatggagctggacgagtgcgaggagacgatgccctatgacgtgaacatcgaagcggagatgcggaggcggcagcagcagcaccaggaggcctacgacgaggatgaggacatgccgggcggcgcacagagggtgcagtgcgcccagcagtaggcagcagcttgatagcagtgataaaatatttgacggcggcagaaaaatttgtgcgactact

SEQ ID NO: 6557 - protein, 102 aa, Zea mays
  misc_feature: Ceres CLONE 336998-F
MIKDEGMPMYQRPFMKGKLYIHFSVEFPDSLSPEQCKALEAVLPPKPVSQYTDMELDECEETMPYDVNIEAEMRRRQQQHQEAYDEDEDMPGGAQRVQCAQQ

SEQ ID NO: 6558 - DNA, 462 bp, Zea mays
  misc_feature: Ceres CLONE 337013-F
  misc_feature: Translation starting site: 84
  misc_feature: SWISSPROT Homolog: EC 3.4.21.97 Assemblin
aaagacgccgtcgccgctcttgttgtttccgatcccaaaccccaaacacgctccaccggcacctccgctcccacaccacaccgatggcccgcacgaagcagacggcgcgcaagtccaccggaggcaaggcgccgcggaagcagctggcgaccaaggcagcgcgcaagtcggccccggcaaccggcggcgtgaagaagccgcaccgcttccgcccgggcaccgtggcgctccgcgagatccgcaagtaccagaagagcacggagctgctcatccgcaagctccccttccagcgcctggtccgcgagatcgcgcaggacttcaagaccgacctccgcttccagtcctccgccgtcgccgcgctgcaggaggccgcggaggctacctcgtcggcctcttcgaggacaccaacctctgcgccatccacgccaagcgcgtcaccatcatgcccaaggacattcagct

SEQ ID NO: 6559 - DNA, 496 bp, Zea mays
  misc_feature: Ceres CLONE 337019-F
  misc_feature: Encodes the peptide sequence at SEQ ID NO. 6560
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatatcggatgagatcctcaagaactacccggagctggcgcaggaggggctgccgacgatgaatcagcgtctggacatctcgaacgcggcggtgacgcagatggcgacggaggcgtccctgtcgtgcgtccgctcgtggggcggcgcgctctcgtccatcacccacctcgtgtacgtct

SEQ ID NO: 6560 - protein, 137 aa, Zea mays
  misc_feature: Ceres CLONE 337019-F
  misc_feature (10)..(137): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MVSSSMDTTSDKRASSMLAPNPGKATILALGHAFPQQLVMQDYVVDGFMKNTNCDDPELKEKLTRLCKTTTVRTRYVVISDEILKNYPELAQEGLPTMNQRLDISNAAVTQMATEASLSCVRSWGGALSSITHLVYV

SEQ ID NO: 6561 - DNA, 124 bp, Zea mays
  misc_feature: Ceres CLONE 337035-F
cttttctccgcactcatcgcttgttgcggttcgctctctacaaggagggaggcggcttgcgcggggggcatcgtgcaatggcgcggcggtgccgtgcaggctgctgctagcgtggcggcggcgg

SEQ ID NO: 6562 - DNA, 453 bp, Zea mays
  misc_feature: Ceres CLONE 337043-F
  misc_feature: Encodes the peptide sequence at SEQ ID NO. 6563
aaatcgcagccagcagcctcatccccttgcccacttctacagcccctctgctgcagcaagaaggaaagaagctagcgcttatagcttgtcagccatggccaccgccgccgcgtctagcctcctcaagtcctccttcgcgggctcccggctcccggccgccacgcggaccacaccggcgtccctcgtggtggccaccggcccgcgcggcgccggcgcggggcccatctgcgcgtccatgtccatgtcctcctccaacccgccctacgacctgacgtccttccggttcagccccatcaaggagtccatcgtgtcccgcgagatgacccgtcgctacatgacggacatgatcacctacgccgacaccgacgtcgtcatcgtgggcgccggctccgcggggctgtcctgcgcgtacgagctctccaaggaccccgccgtgagcatcgccatcgtgga

SEQ ID NO: 6563 - protein, 119 aa, Zea mays
  misc_feature: Ceres CLONE 337043-F
MATAAASSLLKSSFAGSRLPAATRTTPASLVVATGPRGAGAGPICASMSMSSSNPPYDLTSFRFSPIKESIVSREMTRRYMTDMITYADTDVVIVGAGSAGLSCAYELSKDPAVSIAIV

SEQ ID NO: 6564 - DNA, 650 bp, Zea mays
  misc_feature: Ceres CLONE 337052-R
ccaaatgggtaccgggccccccctcgaggtcgacggtatcgatattttttttttttttttttccaccaaacaatgataaagttgcatattgcagcaaaataagatacatcgtataagctggagtccagcgaatcacttgtgtaacgccaatgccaagtatgctgagtgcactgaccaataccatgcatgtttcagttcttgtaggttctcaggctctgaacgaattcgtctatgtacctcttgtggcactcgtcgtctgccacaatctcctgcatcctcttagcattggccacaaagatcctcttgctttcttcttcgcacatgacagcccgtatcgctgtggcgatgttgtcaccaaggaacgctcccccactcttcgtgggtgggcaacttgactccgaccttccgctgctccatcaccccggcggtggacaagtggtccacgagaactggcatcatgaccagaaaatggccgtactaaagcccctccatgggggaaccccaacccgcaatgcatcatgaaagccgggaaggaccccgtgccccaataatgcttggtttgaagaaacccagccccgttaaaaacgtaacccccggctccgccgtagtccccctctccaaaaaccggggcgagggagaggttcctcttc

SEQ ID NO: 6565 - DNA, 451 bp, Zea mays
  misc_feature: Ceres CLONE 337066-F
  misc_feature: Encodes the peptide sequence at SEQ ID NO. 6566
gttcgtccccaatttccccttcgcctttgtcttcccgctcccgtcccgaaatccgcccgccgattaagcttgcttgccctagcagatcgaagccctagccctagccctagccgaggagcgcgcccatggccgtcgcggtcgtgggctgaggggccgcggctctttgcatggggtgaggaagcggcgtcccgaggcgcgggaatggaccctagcctgaaggaggaggtgatgaaggcggtggaggaggcgaggtccgcgactgtgccgcggtgccgggtggtgcggatcatcgtgcacgacgaggacgccaccgactcgtcctccagcgaggacgaggacgaggacgaggcgggggagcgcgccgcggcgcatccgggctcgccgtcggcgtcggcggggagcgtgaagccagccgcgtgctgctccagtccgccgggtgcggcgcggagga

SEQ ID NO: 6566 - protein, 83 aa, Zea mays
  misc_feature: Ceres CLONE 337066-F
MDPSLKEEVMKAVEEARSATVPRCRVVRIIVHDEDATDSSSSEDEDEDEAGERAAAHPGSPSASAGSVKPAACCSSPPGAARR

SEQ ID NO: 6567 - DNA, 484 bp, Zea mays
  misc_feature: Ceres CLONE 337084-F
  misc_feature: Encodes the peptide sequence at SEQ ID NO. 6568
aactgggaaagatgctcctccccactctccgtcctgctccggcaagaggcggcacaccgcgcaaggatgccacctagggctgctccggcgctgcgggtgctcccgctcgcgctcgcagcggcmatcttctcggggctcaccgccatcctcttctacctctccggcgtctcctcctcacatagcggctctcggctctcggaggcggacctggcggcgctcgccgcgctgcggggtggcttcagcaagtgcgtggatgcaaatgggctaggactgaaagccgtgaccggggaggactactgtcgtgttgtgatacaatacccaagtgacacagtttctaagtggagagatccaatcacccataaggctgaaagtctgtcgtttgagttcaatctgtgtgaagctgtggcctcatgggagcacgtccggaacagtacaacagtactcacaaaggagtacattgatgctttgccaaatggctgggagg

SEQ ID NO: 6568 - protein, 139 aa, Zea mays
  misc_feature: Ceres CLONE 337084-F
MPPRAAPALRVLPLALAAAIFSGLTAILFYLSGVSSSHSGSRLSEADLAALAALRGGFSKCVDANGLGLKAVTGEDYCRVVIQYPSDTVSKWRDPITHKAESLSFEFNLCEAVASWEHVRNSTTVLTKEYIDALPNGWE

SEQ ID NO: 6569 - DNA, 503 bp, Zea mays
  misc_feature: Ceres CLONE 337114-F
  misc_feature: Encodes the peptide sequence at SEQ ID NO. 6570
gctcaagtcaattcataaactcacaatggcggcaacggcataccccactgtggtgctcatcccactatgcgtcccaggccacctcgcgtccatgatcgaagccggcaagcggctgctcggcagaagccgctgccccatgtccctcaccgtgctcatcacgcagatgaccatgtccgccaacctgatgtccgacgtcgacgacatcatgcgacgggaagccgactccggcctggacatccgcttcgtccacctccccgccgtggagctccccaccgtccaccacggcctcgaggacttcatgatgcgcttcatacagctccacgcgacgcacgtcaaggaggccgtctccggcatgtcgtccccggtcgccgcggtcgtggtggactacttctgcaccaccctattcgacgtcgcgcgcgagctcgcgctgccggcgtacgcctacatgccgtccggcgcgtcgatggtcgcgctcatgctgcggttaccggcgctggacgggg

SEQ ID NO: 6570 - protein, 159 aa, Zea mays
  misc_feature: Ceres CLONE 337114-F
  misc_feature: SWISSPROT Homolog: EC 2.4.1.115 Anthocyanidin 3-O-glucosyltransferase
MAATAYPTVVLIPLCVPGHLASMIEAGKRLLGRSRCPMSLTVLITQMTMSANLMSDVDDIMRREADSGLDIRFVHLPAVELPTVHHGLEDFMMRFIQLHATHVKEAVSGMSSPVAAVVVDYFCTTLFDVARELALPAYAYMPSGASMVALMLRLPALDG

SEQ ID NO: 6571 - DNA, 497 bp, Zea mays
  misc_feature: Ceres CLONE 337148-F
  misc_feature: Encodes the peptide sequence at SEQ ID NO. 6572
gggtaaagacccacggaaatcaggacaagtttgcaaaacccccctctttgtgctgtttcttctcgccgccgccgccgccgccgccgctagccggcgtagctgataggaaacctgaccacctgagccttctgtagaccagctacagcgcaactcccaaccccttctcttatggcgctcctccttcgccgaggcgtggccatcgccgcccgctccttccgcgccgcggccgcctcctccgcttccaccactgtgcaccgcctcccagccggggcgtcccttgcgggcgccggggaattggctccggcgcagctcttcttcttcgagaaccgaagaggcttcgcgaaggggaagaaatcgaaggatgatcgaggtgacactgttcaagctgttcctgacattgggccaactgtcaaatcagctgccaccgcacaaatggacgctgcagtgatcgcactgtcacgagagctgagcaaactacggactggaagagctacacc

SEQ ID NO: 6572 - protein, 109 aa, Zea mays
  misc_feature: Ceres CLONE 337148-F
MALLLRRGVAIAARSFRAAAASSASTTVHRLPAGASLAGAGELAPAQLFFFENRRGFAKGKKSKDDRGDTVQAVPDIGPTVKSAATAQMDAAVIALSRELSKLRTGRAT

SEQ ID NO: 6573 - DNA, 475 bp, Zea mays
  misc_feature: Ceres CLONE 337167-F
  misc_feature: Translation starting site: 85
  misc_feature: SWISSPROT Homolog: EC 2.3.1.74 Naringenin-chalcone synthase
  misc_feature: SWISSPROT Homolog: EC 2.3.1.95 Trihydroxystilbene synthase
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagaccgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggaggcgtccctgtcgtgcgtccgctcgtggggcggcgcgctctcgtcc

SEQ ID NO: 6574 - DNA, 466 bp, Zea mays
  misc_feature: Ceres CLONE 337179-F
  misc_feature: Encodes the peptide sequence at SEQ ID NO. 6575
agtttgccgctctgtgagcctgctgccgtcttcttccgccgccgccgccgtcgtcgtcttcgtccgtagatcagagagcggggaggaagaaaaagcgatcgatggcgtccaactacgtggacacgccgggcgaggagggacggttccacggccctcacagccacagcaccagcacgaccccgacgggcggcgcggcggcggcggcggcatcgccgcgcaacttccggcgcagcttctcctccgcgtcctccgcgggccacagccacggcggcggcggcggcggggccaagtgcgtgtgcgcgcccgcgacccacgccgggtcgttcaagtgccggctccaccgcaccaactcccagggccacggccacggccacccgcacccgtccccgccggcctcccccgccgcgccggcgcagggcgtctcgtcttccgcttcctcccgcaccgtcgaggccctgtgagtgtc

SEQ ID NO: 6575 - protein, 119 aa, Zea mays
  misc_feature: Ceres CLONE 337179-F
MASNYVDTPGEEGRFHGPHSHSTSTTPTGGAAAAAASPRNFRRSFSSASSAGHSHGGGGGGAKCVCAPATHAGSFKCRLHRTNSQGHGHGHPHPSPPASPAAPAQGVSSSASSRTVEAL

SEQ ID NO: 6576 - DNA, 487 bp, Zea mays
  misc_feature: Ceres CLONE 337198-F
  misc_feature: Encodes the peptide sequence at SEQ ID NO. 6577
gtacattcccctccccccacacacacgccggtgcgtcgcctgcgcaatcatacttcctaccctccccacctcttccacggttccaccccgtccctctcctctcgagaagcacccgcaccatacatcttccggcgcccgacgcggacggcgagccgctgctgctgctgccgccggaggaggaagggcaccagggccagcgggtgcaggaggaggaggagcagcagcaggccgccggccgcttggggctgtgccacatgccgctctggggggccgccgcgtccgcggcgccggcagccgagggcgacgccgcccgcgcgccgtcgggatccggcggcggcgtcaaggtgatccggtcgctgctccccacccggcgccgcctccgcctagatccgcccgccaagctctacttcccatatgagcccggcaagcaagtccggagcgcggtcaggatcaagaacatcagcaagtctcatgtggccttcaagtt

SEQ ID NO: 6577 - protein, 77 aa, Zea mays
  misc_feature: Ceres CLONE 337198-F
MPLWGAAASAAPAAEGDAARAPSGSGGGVKVIRSLLPTRRRLRLDPPAKLYFPYEPGKQVRSAVRIKNISKSHVAFK

SEQ ID NO: 6578 - DNA, 391 bp, Zea mays
  misc_feature: Ceres CLONE 337221-F
  misc_feature: Encodes the peptide sequence at SEQ ID NO. 6579
aactaccgcaggccgcagcccagcaccggccgctctacgccggcacgtcctcgtttctgtccgaggtcatcgcctccgcaacttcgtggccggtgaggtcgcaccaccatggcgtcgctcctagcccggcaggcagcgcaggcgctccgcgcgaggcaaacggcgcagctcgggccggccgcgtcggcgatgcaagggcacctccgtacctacatgaacgcggggattcccaagcggttcaaagaggatgaggagaaagaacagcttgcaaaagatctcgcaaaagattggaatgctgtgtttgaaaggagcatcaatacattgtttttgactgaaatggtccgtggcttgatgctaactctcaagtacttctttgatagaaatgtcacaa

SEQ ID NO: 6579 - protein, 94 aa, Zea mays
  misc_feature: Ceres CLONE 337221-F
  misc_feature: SWISSPROT Homolog: EC 1.6.5.3 NADH dehydrogenase (ubiquinone)
MASLLARQAAQALRARQTAQLGPAASAMQGHLRTYMNAGIPKRFKEDEEKEQLAKDLAKDWNAVFERSINTLFLTEMVRGLMLTLKYFFDRNVT

SEQ ID NO: 6580 - DNA, 462 bp, Zea mays
  misc_feature: Ceres CLONE 337237-F
  misc_feature: Encodes the peptide sequence at SEQ ID NO. 6581
acaccgagaatcacaatacgaaacgaattaatccccaatcaacacagcaagtcagcaacaagcaaagcagcgacccgagagatggacgcgaggatgttcgggctggagaccccccgggtggcggcgctgcatcacctgctggacgtgcccgacggcgacaaggcgggcggcggcgccacgcgcacctacgtccgcgacgcgcgcgccatggcggccaccccggccgacgtcaaggagctcgcgggagcgtacgcgttcgtggtggacatgccggggctgagcacgggcgacatcagggtgcaggtggaggacgagcgggtgctggtgatcagcggcgagcggcgccgggaggagcgcgaggacgccaagtacctgcgcatggagcggcggatgggagttctggaacataatgtgaacctgtgtgtctgtgacctgagctttgaagatctcattatgtggtta

SEQ ID NO: 6581 - protein, 127 aa, Zea mays
  misc_feature: Ceres CLONE 337237-F
  misc_feature (49)..(125): Pfam Name: HSP20 Pfam Description: Hsp20/alpha crystallin family
MDARMFGLETPRVAALHHLLDVPDGDKAGGGATRTYVRDARAMAATPADVKELAGAYAFVVDMPGLSTGDIRVQVEDERVLVISGERRREEREDAKYLRMERRMGVLEHNVNLCVCDLSFEDLIMWL

SEQ ID NO: 6582 - DNA, 391 bp, Zea mays
  misc_feature: Ceres CLONE 337252-F
  misc_feature: Encodes the peptide sequence at SEQ ID NO. 6583
tagaaaaaactggtgggctgaccaatcagttcggagtctgccatcagcccatctctgtgcgcgactccccgtccgttcccctcttccactacgtgctcgcgagtcgcgtccgctcctcctctttccaaagggcgagttcgcatcgcagcgtcgcccgcagcagcagcggaccgcagaccacgccacctcagccagcgacagggagcgagggagcgattcgatcagaatcgacatggacggcggcgagcacgaagcggaggagtcctcctacaagcgccgggagcgcctgctygccctccgctccgccgcaaacgcgtctccggcaggggctcctccgccgacggccgcggggagcatcctcccggaccctgacctcccgggagacgaggcc

SEQ ID NO: 6583 - protein, 53 aa, Zea mays
  misc_feature: Ceres CLONE 337252-F
MDGGEHEAEESSYKRRERLLALRSAANASPAGAPPPTAAGSILPDPDLPGDEA

SEQ ID NO: 6584 - DNA, 645 bp, Zea mays
  misc_feature: Ceres CLONE 337258-R
ccgattgggtaccgggccccccctcgaggtcgacggtatcgataagcttttttttttttttttttaacaaaaagaacttgttttaagcttgccatttcgattcacatccagtcagcaggaaagaactgagctagaggttgaaacatctttagacaggatactgcatatctacatcagatgaggctaacatagtctagttgtccattaccacctgaatctaaagaacttcatgcatatatattacatagcacggcaacattcatcaaacatgctgcatcctatcttgaatctgttagttgaacttcatgcttcactgtcaggccactttcatagttgtcttaagcctctttgcagcttgcacaaagctgacaatgacctgcaactcatccaattgctgggccgtgaagtgcctttgaacagcatcaactaactgctccctggatggattagggcatgcatcgagattgaagtggcgccaatatctcaacagtgcagtcagttctaacttgctcaggtcaactttcgtgtgagctctcgaggaagatgaaacagacgtcttagattgggagtcacatgacattgaacggctaaaggattttctgtggaaacccctatgctgcctgctccttgacctttgtggctttg

SEQ ID NO: 6585 - DNA, 495 bp, Zea mays
  misc_feature: Ceres CLONE 337289-F
acaaccaagctcgatccatctcactctccgctggtcgctcactcttgcagctccacccttcactcagtcttagtctcttattagctctaggctctagctagccgcgccactccttcgtgtagccatcagccttctcatcgccaccaatggccactgcgaggtccagaccccgaccgtcgtggcggccgaggaagcgcccgtggtggagaccccgccgccggccgtcgtgcccgaggagtctgcccccgccgaggccgaggccgaggccgaggctgctgctcctgctgatcccgaggagcttcccgcggccgagcagcaggcagccgccgaggcggaggccgcggctcctgctggtgccgaggagcccgtcgcggccgaaccggccgccgaggcggaggctgctgctcctgctggtcccgaggagactcctgcggtcgagcaggaggcagccgccgaggaggaggctgctgctgctcctcctgctggtgcgaggag

SEQ ID NO: 6586 - DNA, 471 bp, Zea mays
  misc_feature: Ceres CLONE 337339-F
  misc_feature: Encodes the peptide sequence at SEQ ID NO. 6587
gttccgtcgccccgcattgctcgcccagagttcttgtttaggcaaaggcaaaagcaggagcaaaaaggtttcgttggcgatggcgagctcgtggacgcttcctgaccacccgaagctccccaaggggaagccggtggctgtcgtcgtgctggacggatggggcgaggccaaccccgaccagtacaactgcatccatgtcgctcagactcctgtcatggactcgttaaagaatggtgctcctgagaaatggagactagtgaaggctcatggaacagctgtgggtctcccatctgatgatgacatgggcaacagtgaagttggtcacaatgcacttggtgctggtcggattttcgcccaaggtgctaagcttgttgatcaagctcttgcctcaggaaagatttatgatggagatgggttcaactacatcaaagaatcttttgaaaatggtactcttccaccttattgggttgt

SEQ ID NO: 6587 - protein, 130 aa, Zea mays
  misc_feature: Ceres CLONE 337339-F
  misc_feature (15)..(127): Pfam Name: iPGM_N Pfam Description: BPG-independent PGAM N-terminus (iPGM_N)
  misc_feature: SWISSPROT Homolog: EC 5.4.2.1 Phosphoglycerate mutase
MASSWTLPDHPKLPKGKPVAVVVLDGWGEANPDQYNCIHVAQTPVMDSLKNGAPEKWRLVKAHGTAVGLPSDDDMGNSEVGHNALGAGRIFAQGAKLVDQALASGKIYDGDGFNYIKESFENGTLPPYWV

SEQ ID NO: 6588 - DNA, 478 bp, Zea mays
  misc_feature: Ceres CLONE 337355-F
  misc_feature: Encodes the peptide sequence at SEQ ID NO. 6589
aggaacagtgcaaactagaagaaacctccgtcatcagcgacctctccccaacggcgccgacgatggcgcaacagcagacgcagctaaccactggctcgggcatcctggatgccgtcccgctcttcgtcgtcatcctcctcgcggcccacgtcctggccctcgtgttctggatgtacaagctggcttccgagaagcaaccaccccggaggaagacacagtgacggcgccgatctacgccatcggcgatccttcgctagcctctttatcggttccattttcatgtgaaccagtaccctccagaacattcaggccgtcaattattcagagatatccatatagtctttcaatttgttttatttatacttattgcattttgggtattgtttgataacaacttagcgatattctatgaatcactatccgtttgggtgataaataaatgttcctagttttagaccatctcaatcatatcttttat

SEQ ID NO: 6589 - protein, 52 aa, Zea mays
  misc_feature: Ceres CLONE 337355-F
MAQQQTQLTTGSGILDAVPLFVVILLAAHVLALVFWMYKLASEKQPPRRKTQ

SEQ ID NO: 6590 - DNA, 295 bp, Zea mays
  misc_feature: Ceres CLONE 337356-F
  misc_feature: Encodes the peptide sequence at SEQ ID NO. 6591
acgagtaggattaaaaaaactcccaaacaggacctgttgaactgtccttgcttctaaacggagtgagtagcgatagtgacgcagtcgtcttgccgccgccgtcccaaacgtccgcgcggtcgtcctcgatcttcccgtaccatcccgacgcgatggccgccggcgcgaagcccgataccgccgcgcccccgcaagcgccttcggcggcgaagggggtcttcatgcgccgcatcttccccttcctcctcgcgacgaacgtcttcatcggaatttatgtatttgccaagacctacaa

SEQ ID NO: 6591 - protein, 47 aa, Zea mays
  misc_feature: Ceres CLONE 337356-F
MAAGAKPDTAAPPQAPSAAKGVFMRRIFPFLLATNVFIGIYVFAKTY

SEQ ID NO: 6592 - DNA, 421 bp, Zea mays
  misc_feature: Ceres CLONE 337367-F
  misc_feature: Encodes the peptide sequence at SEQ ID NO. 6593
gtcacaactcacatcgaggtctcagcttcaggaaagggaaggaagcatgttcgggcaccaccacggccacggcgggcaccaccaggccccgccgccgcacgagcagacgctgttcaggatcttctgccgcgccgacgaggcgtactgcctcaccgtgcgtcacgacgccgtcgtcctcgcgcccaccaacccccgcgacgagtaccagcactggtacaaggacatgaggcacagcacgaaggtgaaggacgcggagggccagccagcgttcgcgctcatcaacagggccaccggcctcgccatcaagcactcgctcggccagtcccatcccgtgaagctggtgcctacaacgcggastacctggacgagtckgtgctgtggacggagagccacgacgtgggcaagggcttccgctgcatcc

SEQ ID NO: 6593 - protein, 125 aa, Zea mays
  misc_feature: Ceres CLONE 337367-F
  misc_feature (104)..(104): Xaa is any aa, unknown, or other
  misc_feature (109)..(109): Xaa is any aa, unknown, or other
MFGHHHGHGGHHQAPPPHEQTLFRIFCRADEAYCLTVRHDAVVLAPTNPRDEYQHWYKDMRHSTKVKDAEGQPAFALINRATGLAIKHSLGQSHPVKLVPTTRXTWTSXCCGRRATTWARASAAS

SEQ ID NO: 6594 - DNA, 329 bp, Zea mays
  misc_feature: Ceres CLONE 337379-F
acacaaccaagctcgatccatctcactctccgctggtcgctcactcttgcagctccacccttcactcagtcttagtctctyattagctctaggctctagctagccgcgccactccttcgtgtagccatcagccttctcatcgccaccaatggccactgcgaggtccagaccccgaccgtcgtggcggccgaggaagcgcccgtggtggagaccccgccgccggccgtcgtgcccgaggagtctgcccycgccgaggccgaggccgaggccgaggctgctgctcctgctgatcccgaggagcttcccgcggccgagcagcaggcagccgc

SEQ ID NO: 6595 - DNA, 428 bp, Zea mays
  misc_feature: Ceres CLONE 337424-F
  misc_feature: Encodes the peptide sequence at SEQ ID NO. 6596
gactgtttgttttctaagctcgttcgccccctctcttctctccgtccaacgacggcgcgattcagatccaggcatacaggccatccttccgccgccgcggactgcgcttaatcttccttctccagcagccgggcgttcccgtcgtcctcgatcctcccctggactggatcgcaacggagatccagccggacctgcggtggtcccttccttttctcgatagcataatgagctcgccagtggagaggtgattcgtcaggctggtatcaagttcctagtccatggtgcctggatgagcagtagagatgctactggccgtggaaggaggagggttcttctcgtcttcagctacaggttacagccatggcctcgccctcttgctgctcggacgcaaagctgaggagaagcccgtaaaggtctcgccgtggaac

SEQ ID NO: 6596 - protein, 42 aa, Zea mays
  misc_feature: Ceres CLONE 337424-F
MLLAVEGGGFFSSSATGYSHGLALLLLGRKAEEKPVKVSPWN

SEQ ID NO: 6597 - DNA, 411 bp, Zea mays
  misc_feature: Ceres CLONE 337434-F
  misc_feature: Encodes the peptide sequence at SEQ ID NO. 6598
aaatcgcagccagcagcctcatccccttgcccacttctacagcccctctgctgcagcaagaaggaaagaagctagcgcttatagcttgtcagccatggccaccgccgccgcgtctagcctcctcaagtcctccttcgcgggctcccggctcccggccgccacgcggaccacaccggcgtccctcgtggtggccaccggcccgcgcggcgccggcgcggggcccatctgcgcgtccatgtccatgtcctcctccaacccgccctacgacctgacgtccttccggttcagccccatcaaggagtccatcgtgtcccgcgagatgacccgtcgctacatgacggacatgatcacctacgccgacaccgacgtcktcatcgtgggcgccggctccgcggggctgtcctgcgcgta

SEQ ID NO: 6598 - protein, 105 aa, Zea mays
  misc_feature: Ceres CLONE 337434-F
  misc_feature (93)..(93): Xaa is any aa, unknown, or other
MATAAASSLLKSSFAGSRLPAATRTTPASLVVATGPRGAGAGPICASMSMSSSNPPYDLTSFRFSPIKESIVSREMTRRYMTDMITYADTDVXIVGAGSAGLSCA

SEQ ID NO: 6599 - DNA, 516 bp, Zea mays
  misc_feature: Ceres CLONE 337442-F
  misc_feature: Encodes the peptide sequence at SEQ ID NO. 6600
aaatcaggacaggcatgctgaactaggcgaggtggactgggcgagcgagcgagatggagtggacgacggtggagacgagggacggcgcgaagctgagcgtgcggctgttcaagccccccgcgtccggaacggggttggagccggagccgagggaggatgtggcggtggtgctggtgcatccctacaccatcctcggcggcgtgcagggcctgctgcgggggatggcggagggcgtcgcgcggcggggttacaccgccgtcaccttcgacatgcgcggcgcgggccggtccagaacctgctcgaccacctcgccgaccccgtcaacaacaacgtgctcaccagcctcaagttccactagaacgttggtsgcatcagcatacctgctgccgccgccgccagttgtttgctgtggaaagctagatgcatgcgtgttgtaaaggaacckgaagcgttgcatcggtcatgattcatgcatggccagcctgctgcctgtaacaacaaactagtattgatctt

SEQ ID NO: 6600 - protein, 127 aa, Zea mays
  misc_feature: Ceres CLONE 337442-F
MEWTTVETRDGAKLSVRLFKPPASGTGLEPEPREDVAVVLVHPYTILGGVQGLLRGMAEGVARRGYTAVTFDMRGAGRSRTCSTTSPTPSTTTCSPASSSTRTLVASAYLLPPPPVVCCGKLDACVL

SEQ ID NO: 6601 - DNA, 479 bp, Zea mays
  misc_feature: Ceres CLONE 337444-F
ataccaccagggagtaaaggttaggatgttgttgtggtgcttgaacctggaagcatgctccaccgggacctgggttcggtcgagcaacaactagtccgctaatgacgccagtcgccggctgctgttcggaggctagcaaaagggcgagagggtttgctagtacgtacagagcgtgcgcgagtaagtggctgggagcccgccgttgtcaagagagaagttgcgaggggcagaggatcatggcgctagaacttgtcgatgcgcagggagttcgccgaagggcgttaaagagcaccgaagccttggcgagtttcctccatactccgaaatttgtcgtcgtgccgttacagcgtgggtcgacgtcactgcggtctcgttgccggtcaagaacaggtaccgcaggatgaggcgcatggaggatgctgtggcgagttcgcgagaggtctaggtcgtcgtctcccagtcaactttgggttgctgga

SEQ ID NO: 6602 - DNA, 482 bp, Zea mays
  misc_feature: Ceres CLONE 337460-F
  misc_feature: Encodes the peptide sequence at SEQ ID NO. 6603
actgccaaatcccccagaaagtcaactcctccccaattccacgctgccaccaactcgccgtcctccgcgccaagcaccaaagctccgatggcccgcacgaagcagacggcgcgcaagtcaacgggcggcaaggcgccccgcaagcagctggcgaccaaggcggcgcgcaagtctgcgccggccaccggcggcgtgaagaagccccaccgcttccgccccggcaccgtcgcgctccgggagattcgtaagtaccagaagagcacggagctgctcatccgcaagttgcccttccagcgcctcgtccgtgagatcgcgcaggacttcaagaccgatctccgcttccagtcctccgccgtctctgcgctgcaggaggccgccgaggcctacctcgtggggctctttgaggacactaacctgtgcgccatccacgccaagcgcgtcaccatcatgcccaaggacatccagctcgcgcgccgcatcag

SEQ ID NO: 6603 - protein, 131 aa, Zea mays
  misc_feature: Ceres CLONE 337460-F
  misc_feature (58)..(131): Pfam Name: Histone Pfam Description: Core histone H2A/H2B/H3/H4
MARTKQTARKSTGGKAPRKQLATKAARKSAPATGGVKKPHRFRPGTVALREIRKYQKSTELLIRKLPFQRLVREIAQDFKTDLRFQSSAVSALQEAAEAYLVGLFEDTNLCAIHAKRVTIMPKDIQLARRI

SEQ ID NO: 6604 - DNA, 416 bp, Zea mays
  misc_feature: Ceres CLONE 337482-F
  misc_feature: Encodes the peptide sequence at SEQ ID NO. 6605
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgca

SEQ ID NO: 6605 - protein, 110 aa, Zea mays
  misc_feature: Ceres CLONE 337482-F
  misc_feature (10)..(110): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MVSSSMDTTSDKRASSMLAPNPGKATILALGHAFPQQLVMQDYVVDGFMKNTNCDDPELKEKLTRLCKTTTVRTRYVVMSDEILKNYPELAQEGLPTMNQRLDISNAAVT

SEQ ID NO: 6606 - DNA, 482 bp, Zea mays
  misc_feature: Ceres CLONE 337483-F
  misc_feature: Encodes the peptide sequence at SEQ ID NO. 6607
ggagatccacacctgcagctgccacagcgggtggtgcctggcttggcggcctagcatagctgcgctgcgcatgctagtgaccaatggcgtccaccaaggtgccactgttcctcgtcctcaacctcctgctcttcgcggcggccaacgcctgcccttactgcccgggcaacaatggccacggtagcagcgggcaccatggcggcagtgggcatggcggcggtggcagcggcggttccggtggcggcagcagcggcggagggtacggtccgatcggtggtggtggcagcggcggcggcggcggaggagggtacggtccgatcggtgacggtggcagcggcggtgggatcggagtcggacccatcggaggcggcagcggggggatcggacccataggaggtggcagcggtggtgggtacggtcccatcggtggaggtggaggtgggatcggtggcggtggcagcgacggcacgagcggctggtac

SEQ ID NO: 6607 - protein, 133 aa, Zea mays
  misc_feature: Ceres CLONE 337483-F
MASTKVPLFLVLNLLLFAAANACPYCPGNNGHGSSGHHGGSGHGGGGSGGSGGGSSGGGYGPIGGGGSGGGGGGGYGPIGDGGSGGGIGVGPIGGGSGGIGPIGGGSGGGYGPIGGGGGGIGGGGSDGTSGWY

SEQ ID NO: 6608 - DNA, 447 bp, Zea mays
  misc_feature: Ceres CLONE 337492-F
  misc_feature: Encodes the peptide sequence at SEQ ID NO. 6609
aaggtgctcatgcgtactctgctctctgctctgcttacttgtggttgtggcgaaaatctgtgcaggtggcgagctggggcgcgtacctgctgtcgcgggacatcctggccatgtcgttcgcgccgcgggactctcacgaggcgcaggtgcagttcgcgctggagcgcggcgtgccggccatgatcggcgtgctcgcgtccaaccgcctcacctacccggcccgcgccttcgacatggcgcactgctcccgctgcctcatcccctggcaactctacgatggactgtacctgatcgaggttgaccgcgtgctgcgtcccggagggtactggatcctgtccgggccgccgatcaattggaagaagtactggaaggggtgggagcggaccaaggaggacctcaacgccgagcagcaggccatcgaggctgtcgccaggagcctctgctgga

SEQ ID NO: 6609 - protein, 148 aa, Zea mays
  misc_feature: Ceres CLONE 337492-F
  misc_feature (1)..(148): Pfam Name: DUF248 Pfam Description: Putative methyltransferase
  misc_feature: The sequence is a functional homolog of SEQ ID NO 758 in the 10/412,699 US patent application
  misc_feature: The sequence is a functional homolog of SEQ ID NO 1593 in the 11/479,226 US patent application
  misc_feature: The sequence is a functional homolog of SEQ ID NO 2740 in the 10/374,780 US patent application
  misc_feature: The sequence is a functional homolog of SEQ ID NO 388 in the 10/225,066 US patent application
  misc_feature: The sequence is a functional homolog of SEQ ID NO 2432 in the 10/374,780 US patent application
  misc_feature: The sequence is a functional homolog of SEQ ID NO 558 in the 10/412,699 US patent application
  misc_feature: The sequence is a functional homolog of SEQ ID NO 730 in the 10/225,066 US patent application
  misc_feature: The sequence is a functional homolog of SEQ ID NO 2546 in the 10/374,780 US patent application
  misc_feature: The sequence is a functional homolog of SEQ ID NO 760 in the 10/412,699 US patent application
  misc_feature: The sequence is a functional homolog of SEQ ID NO 824 in the 10/225,066 US patent application
  misc_feature: The sequence is a functional homolog of SEQ ID NO 560 in the 10/412,699 US patent application
  misc_feature: The sequence is a functional homolog of SEQ ID NO 354 in the 10/374,780 US patent application
  misc_feature: The sequence is a functional homolog of SEQ ID NO 72 in the 10/225,068 US patent application
  misc_feature: The sequence is a functional homolog of SEQ ID NO 910 in the 10/225,066 US patent application
  misc_feature: The sequence is a functional homolog of SEQ ID NO 64 in the 10/666,642 US patent application
GAHAYSALCSAYLWLWRKSVQVASWGAYLLSRDILAMSFAPRDSHEAQVQFALERGVPAMIGVLASNRLTYPARAFDMAHCSRCLIPWQLYDGLYLIEVDRVLRPGGYWILSGPPINWKKYWKGWERTKEDLNAEQQAIEAVARSLCW

SEQ ID NO: 6610 - DNA, 509 bp, Zea mays
  misc_feature: Ceres CLONE 337560-F
  misc_feature: Encodes the peptide sequence at SEQ ID NO. 6611
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcmgatggcgacggaggcgtcccttgtcgttgcgtccgctcgtggggcggccgcgctctcgtccatcacccasctcgtgtacgtctcgtcgagcga

SEQ ID NO: 6611 - protein, 141 aa, Zea mays
  misc_feature: Ceres CLONE 337560-F
  misc_feature (10)..(141): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
  misc_feature (111)..(111): Xaa is any aa, unknown, or other
  misc_feature (134)..(134): Xaa is any aa, unknown, or other
MVSSSMDTTSDKRASSMLAPNPGKATILALGHAFPQQLVMQDYVVDGFMKNTNCDDPELKEKLTRLCKTTTVRTRYVVMSDEILKNYPELAQEGLPTMNQRLDISNAAVTXMATEASLVVASARGAAALSSITXLVYVSSS

SEQ ID NO: 6612 - DNA, 468 bp, Zea mays
  misc_feature: Ceres CLONE 337595-F
  misc_feature: Encodes the peptide sequence at SEQ ID NO. 6613
atacatacatacaaaggtgagtgaggttcgcgtgcaagcagagccaatcgtgccgatcgagctatatacatagccggcggcgagggatgggagaagcggccgcggccgtggcggcgtcgaagaggggcggcgggccggcgccgttcctgaccaagacgcaccagatggtggaggagcggggcacggacgaggtgatctcgtgggcggagcagggccgctccttcgtggtgtggaagcccgtggagctggcgcgcgacctcctcccgctccacttcaagcactgcaacttctcctccttcgtccgccagctcaacacctacggtttccgaaaggtggtgccggaccggtgggagttcgcgaacgacaacttccgtcgaggcaagcagggtctcctgtccggcatccgccgcgcaagtcaacggcgctgcagatgtccaagtccggatccggcggcagcggcggcgtgaa

SEQ ID NO: 6613 - protein, 126 aa, Zea mays
  misc_feature: Ceres CLONE 337595-F
  misc_feature (17)..(121): Pfam Name: HSF_DNA-bind Pfam Description: HSF-type DNA-binding
  misc_feature: The sequence is a functional homolog of SEQ ID NO 194 in the 10/412,699 US patent application
  misc_feature: The sequence is a functional homolog of SEQ ID NO 2278 in the 10/374,780 US patent application
  misc_feature: The sequence is a functional homolog of SEQ ID NO 409 in the 11/479,226 US patent application
  misc_feature: The sequence is a functional homolog of SEQ ID NO 782 in the 10/225,066 US patent application
  misc_feature: The sequence is a functional homolog of SEQ ID NO 136 in the 10/225,066 US patent application
  misc_feature: The sequence is a functional homolog of SEQ ID NO 2276 in the 10/374,780 US patent application
  misc_feature: The sequence is a functional homolog of SEQ ID NO 40 in the 11/375,241 US patent application
  misc_feature: The sequence is a functional homolog of SEQ ID NO 1687 in the 10/412,699 US patent application
  misc_feature: The sequence is a functional homolog of SEQ ID NO 1026 in the 10/225,066 US patent application
  misc_feature: The sequence is a functional homolog of SEQ ID NO 110 in the 11/375,241 US patent application
  misc_feature: The sequence is a functional homolog of SEQ ID NO 2280 in the 10/374,780 US patent application
  misc_feature: The sequence is a functional homolog of SEQ ID NO 2201 in the 10/666,642 US patent application
  misc_feature: The sequence is a functional homolog of SEQ ID NO 865 in the 10/666,642 US patent application
  misc_feature: The sequence is a functional homolog of SEQ ID NO 1686 in the 10/412,699 US patent application
  misc_feature: The sequence is a functional homolog of SEQ ID NO 2203 in the 10/666,642 US patent application
  misc_feature: The sequence is a functional homolog of SEQ ID NO 2205 in the 10/666,642 US patent application
  misc_feature: The sequence is a functional homolog of SEQ ID NO 2207 in the 10/666,642 US patent application
  misc_feature: The sequence is a functional homolog of SEQ ID NO 1685 in the 10/412,699 US patent application
  misc_feature: The sequence is a functional homolog of SEQ ID NO 2660 in the 10/374,780 US patent application
  misc_feature: The sequence is a functional homolog of SEQ ID NO 74 in the 10/225,066 US patent application
  misc_feature: The sequence is a functional homolog of SEQ ID NO 926 in the 10/412,699 US patent application
  misc_feature: The sequence is a functional homolog of SEQ ID NO 404 in the 11/479,226 US patent application
  misc_feature: The sequence is a functional homolog of SEQ ID NO 832 in the 11/435,388 US patent application
  misc_feature: The sequence is a functional homolog of SEQ ID NO 2282 in the 10/374,780 US patent application
  misc_feature: The sequence is a functional homolog of SEQ ID NO 872 in the 10/225,066 US patent application
  misc_feature: The sequence is a functional homolog of SEQ ID NO 918 in the 11/435,388 US patent application
  misc_feature: The sequence is a functional homolog of SEQ ID NO 2794 in the 10/374,780 US patent application
  misc_feature: The sequence is a functional homolog of SEQ ID NO 82 in the 10/225,066 US patent application
  misc_feature: The sequence is a functional homolog of SEQ ID NO 882 in the 11/435,388 US patent application
  misc_feature: The sequence is a functional homolog of SEQ ID NO 1418 in the 10/666,642 US patent application
  misc_feature: The sequence is a functional homolog of SEQ ID NO 422 in the 10/666,642 US patent application
  misc_feature: The sequence is a functional homolog of SEQ ID NO 816 in the 11/435,388 US patent application
  misc_feature: The sequence is a functional homolog of SEQ ID NO 142 in the 10/666,642 US patent application
  misc_feature: The sequence is a functional homolog of SEQ ID NO 200 in the 10/225,068 US patent application
  misc_feature: The sequence is a functional homolog of SEQ ID NO 2428 in the 10/374,780 US patent application
  misc_feature: The sequence is a functional homolog of SEQ ID NO 942 in the 11/435,388 US patent application
  misc_feature: The sequence is a functional homolog of SEQ ID NO 1805 in the 10/374,780 US patent application
  misc_feature: The sequence is a functional homolog of SEQ ID NO 1233 in the 11/479,226 US patent application
  misc_feature: The sequence is a functional homolog of SEQ ID NO 144 in the 10/666,642 US patent application
  misc_feature: The sequence is a functional homolog of SEQ ID NO 378 in the 10/374,780 US patent application
  misc_feature: The sequence is a functional homolog of SEQ ID NO 80 in the 10/225,066 US patent application
  misc_feature: The sequence is a functional homolog of SEQ ID NO 950 in the 10/412,699 US patent application
MGEAAAAVAASKRGGGPAPFLTKTHQMVEERGTDEVISWAEQGRSFVVWKPVELARDLLPLHFKHCNFSSFVRQLNTYGFRKVVPDRWEFANDNFRRGKQGLLSGIRRASQRRCRCPSPDPAAAAA

SEQ ID NO: 6614 - DNA, 455 bp, Zea mays
  misc_feature: Ceres CLONE 337608-F
  misc_feature: Encodes the peptide sequence at SEQ ID NO. 6615
aaaaaaattccgtcgtcgtcatcagcagcttctgcttgctctggggggaaggagagagagagagagcgagagagagatctagtagagaggctagtaggtggtcctcgaacgaagatgttggcggtgttcagcgggcaggtggtggaggtgccggcggagctggtggcggcgggcagccggacgccgtcgcccaagacgaaggcgtcgcagctggtggggcgcttcctggccgcgtccgagccggccgtgtccgtgcagctcggcgaccacggccacctcgcctactcccacaccaaccaggcgctcctccgccccaggtcgttcgcggtcaaggacgaggtgttctgcctgttcgagggggtgctggacaacctgggtcgtctgagccagcagcacgggctgtcaagcaagggcgccaacgaggtgctcctcgtcatcgaggcccacaagacgct

SEQ ID NO: 6615 - protein, 113 aa, Zea mays
  misc_feature: Ceres CLONE 337608-F
MLAVFSGQVVEVPAELVAAGSRTPSPKTKASQLVGRFLAASEPAVSVQLGDHGHLAYSHTNQALLRPRSFAVKDEVFCLFEGVLDNLGRLSQQHGLSSKGANEVLLVIEAHKT

SEQ ID NO: 6616 - DNA, 464 bp, Zea mays
  misc_feature: Ceres CLONE 337614-F
  misc_feature: SWISSPROT Homolog: EC 3.2.1.14 Chitinase
  misc_feature: The sequence is a functional homolog of SEQ ID NO 12 in US patent 7087810
aaatcacctcacaacaagctgccccgcagcaacgaacacgaaccttggcagaacgaagctgaagtagttcgttgtgaacccagtatggcaasrcgcgccgaggatcctggccctcggcctgctagcgctcctgtgcgctgccgccggcccggccgccgcgcagaactgcggctgccagcctaacttctgctgcagcaagttcggctactgcggcacgaccgacgcctactgcggcgacgggtgccagtcgggcccgtgccgctcgggcggcggcggcggcggcggcggcggcggaggcggcggaggcagtggcggtgcgaacgtggctaatgtggtcaccgacgcgttcttcaacggcatcaagaaccaggccgggagcgggtgcgagggcaagaacttctacacccggagcgcgttctgagcgccgtcaacgcgtacccgggcttcgcccatggcgggacgga

SEQ ID NO: 6617 - DNA, 506 bp, Zea mays
  misc_feature: Ceres CLONE 337697-F
  misc_feature: Encodes the peptide sequence at SEQ ID NO. 6618
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacscagatggcgacggaggcgtccctgtcgtgcgtccgctcgtggggcggcgcgctctcgtccatcacccacctcgtgtacgtctcgtcgagcga

SEQ ID NO: 6618 - protein, 140 aa, Zea mays; identical to SEQ ID NO: 5477
  misc_feature: Ceres CLONE 337697-F
  misc_feature (10)..(140): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase

SEQ ID NO: 6619 - DNA, 590 bp, Zea mays
  misc_feature: Ceres CLONE 337713-R
  misc_feature (92)..(92): n is a, c, t, g, unknown, or other
  misc_feature (400)..(400): n is a, c, t, g, unknown, or other
ccaattgggtaccgggccccccctcgaggtcgacggtatcgataagcttttttttttttttttttgttctttcagagttacaggtattactnacgttcacttagaatttacaacacacgctacgcggaatatgtagctcagattatcgatcgcactatttctggcctcaattctagctgaggtaaacacacacctctcgaagcggggaaaaaaagatctcaacctccaatatatttacagatcttgcgacatgtatgatcttatagtaacacaagtgtcacgtacaaatacatgctcttcactcagcactgcaagtacgtacgtacgtacggtacgtgacgagtagtcatgacctccgcgaccagcgagttcggagtcgtccatgtttgacggggagccnaccctgccagggccccaacccccaccggggacccccccggtttccccaaacgggggggggggggcccccttttggccccttttaaaaaaaaagggggaaaaaccccctggggtctcccctttggccccccccccaaaaaagccccccgggggggggccccgaaaaaaacatcccctccccgtgggggggc

SEQ ID NO: 6620 - DNA, 214 bp, Zea mays
  misc_feature: Ceres CLONE 337756-F
  misc_feature: Encodes the peptide sequence at SEQ ID NO. 6621
aatccgctctcctacaagaagacggcaagtcggcaaccccgaggtctcagaacgcccaggcaaacgccaacatagcagagaagccatggccggtccgccgctcttgagcttccccttcttcttccttctctgcgtcgccgtcgcctggagcgaggcgtatggggcaagcggtggctacgggctcggcgtcaactacggccgggtggcggacgac

SEQ ID NO: 6621 - protein, 43 aa, Zea mays
  misc_feature: Ceres CLONE 337756-F
MAGPPLLSFPFFFLLCVAVAWSEAYGASGGYGLGVNYGRVADD

SEQ ID NO: 6622 - DNA, 370 bp, Zea mays
  misc_feature: Ceres CLONE 337860-F
  misc_feature: Encodes the peptide sequence at SEQ ID NO. 6623
  misc_feature (321)..(321): n is a, c, t, g, unknown, or other
aaaaaaaaaatcgccgcctgctctctacctctgcactccaatcagatcatcagatagatcactggccccgtgctgattaccgcgcttcccatctgagcagccagcctcccaggctacagggagagacgcaraggagacagctgctgcctggctgaracgatggccggaggcggcgaccactcccagacgaacggaggccacgtcgaccagagggccttggaggagggcaggaaggaggagttcgctgaccagggctgcgccgccatggtcgtctccgtcccatttatccagaagatcatcgcggaratcttcggcacctanttcctgatgttcgcgggktgcggcccggtgacgatchrcgcgagcaaga

SEQ ID NO: 6623 - protein, 70 aa, Zea mays
  misc_feature: Ceres CLONE 337860-F
  misc_feature (54)..(54): Xaa is any aa, unknown, or other
  misc_feature (67)..(67): Xaa is any aa, unknown, or other
MAGGGDHSQTNGGHVDQRALEEGRKEEFADQGCAAMVVSVPFIQKIIAEIFGTXFLMFAGCGPVTIXASK

SEQ ID NO: 6624 - DNA, 528 bp, Zea mays
  misc_feature: Ceres CLONE 337878-F
  misc_feature: Encodes the peptide sequence at SEQ ID NO. 6625
tcctgggtcctggcttctccttccactccggagatcgacggctgcttgccgcactcgcgctcgctcccacggccggcaaccatggccgccgccgctgccgcggtgccagccaccttcctctcgggcctcccctctccacggaccccgtctcctgtgctccactcgcccgtacagagagcccatcccgtcgccgctcctctcttcctctccgccaagcgccgcgcctatgcctgcgccgccacggcctccggctccttctattcctccaactcaggaaatcaaacctcactgatgccgtcgttcagctttgcatttgacgaaggttcttctagttccaaaaggctatatagatggaagagggtattgcttaaagtaagtggagaagctcttgccggcgaccacacagaaaacatcgacccaaagattacaatggctattgcaagagaggttgcttctgtcaccaagctaggtgtagaggttgctattgttgttggcggtggcaatatctttcgtggggcctcttgggct

SEQ ID NO: 6625 - protein, 149 aa, Zea mays
  misc_feature: Ceres CLONE 337878-F
MAAAAAAVPATFLSGLPSPRTPSPVLHSPVQRAHPVAAPLFLSAKRRAYACAATASGSFYSSNSGNQTSLMPSFSFAFDEGSSSSKRLYRWKRVLLKVSGEALAGDHTENIDPKITMAIAREVASVTKLGVEVAIVVGGGNIFRGASWA

SEQ ID NO: 6626 - DNA, 490 bp, Zea mays
  misc_feature: Ceres CLONE 337896-F
  misc_feature: Encodes the peptide sequence at SEQ ID NO. 6627
aaatatacgattgtgtcgactaattatcgcgtcggggcctcgggggcacggcgtgtcttccatcgctccccttcctcgtgtgcggtgagcgtcgtggggtcgtgcgtcgtggccttgtagacgatttcgagggagagaggcaaagaaacggagcgcgtgcggcgttcgtcggcaacgttggcgtccatggagagcaccgcgggtccgagaaagaggcagaaggccgcctcggcctctggatccgtggccccgtacttgccccaggatctcgtacggaacatcctcctccgcctgccttccaggtccgtcctccgcttccgcgccgtttgcaaggactggctccggatcgtctccgacccgcgagttcgcggccgaccacaaccgccaccagccggcgatgccctcgtctccttcctccgcagcgccgccggtagcaagagggggcagacggactgctgcgtcgacgcatttgacctcagcgccggacagt

SEQ ID NO: 6627 - protein, 101 aa, Zea mays
  misc_feature: Ceres CLONE 337896-F
  misc_feature (19)..(66): Pfam Name: F-box Pfam Description: F-box domain
MESTAGPRKRQKAASASGSVAPYLPQDLVRNILLRLPSRSVLRFRAVCKDWLRIVSDPRVRGRPQPPPAGDALVSFLRSAAGSKRGQTDCCVDAFDLSAGQ

SEQ ID NO: 6628 - DNA, 506 bp, Zea mays
  misc_feature: Ceres CLONE 337990-F
  misc_feature: Encodes the peptide sequence at SEQ ID NO. 6629
ataacaattctgattacgcgactcgctgatcgccagctcgtggtcgcgatgccgtacaccggatatcctctagcgccttcccacaatcgcgcttctgcggttctgccgccgccgtccgcgccgcccaccccctcgaccgcgtccctcgctgctttgccctctccaccctccgccatcaccgccgcggcgtccttctgtaccggatccgtcgcagccaccgctccgcagatccgctgggttgacgtccagagagctgctccggggatgtcgtcctccgtttccagcgtcgagggcgacgccgccggagagttcacggaggtcgtaatcgtgcgtcacggcgagacgtcatggaacgcctcgcgcatcatacagggacacttggatgcagagcttaatgatattggaaggcagcaagctgttgcggttgctcatcgtctttctaaagaagtgaaaccagttgccatatactcttctgatctgaagcgagcagcagagactgcgcaaac

SEQ ID NO: 6629 - protein, 80 aa, Zea mays
  misc_feature: Ceres CLONE 337990-F
  misc_feature (18)..(80): Pfam Name: PGAM Pfam Description: Phosphoglycerate mutase family
  misc_feature: SWISSPROT Homolog: EC 5.4.2.1 Phosphoglycerate mutase
MSSSVSSVEGDAAGEFTEVVIVRHGETSWNASRIIQGHLDAELNDIGRQQAVAVAHRLSKEVKPVAIYSSDLKRAAETAQ

SEQ ID NO: 6630 - DNA, 431 bp, Zea mays
  misc_feature: Ceres CLONE 338035-F
acaggcagtgagtgggcagcagccactcgctctccccacctcgtctctcttccactcatcccctccctcgccccttcgcctcgcctctcttcttcggatcgagcagcagtactgcactgcatgccgccgatacaaatcccatcctctccctcctctactgcacctgcaccacagtagctagctagctatctttgctacggcggctctgtaatctggtccactagcgctccattcgaccccacccacagccatggctgccgtgaccgcggcggcgtctctctgccctcctcctcctcctcccctgccgccgccaaggccaaggcgtccgcgtccgcgtccccgtcgtctccatgcggccacctccagttcccgcggcggcacggcggctcgcgcgctgtgcggctgcgcgtgcaggtgtccaccaccgagac

SEQ ID NO: 6631 - DNA, 525 bp, Zea mays
  misc_feature: Ceres CLONE 338044-F
  misc_feature: Encodes the peptide sequence at SEQ ID NO. 6632
aaaaatttcgatctcatttgaaatcaacccatcctcgtttcctccgtctagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggactccaagacccttctctttggtgagaaggaggttgctgtgtttggctgcaggaaccctgaggagatcccatggggttcggttggcgctgaatatgttgttgagtctactggtgttttcactgaccaggagaaggctgcagctcacttgaagggtggtgccaagaaggttgtcatttctgctcctagcaaggatgcccccatgttcgttgttggtgtccacgagaaggagtacaagtctgacatcaacattgtctctaatgctagc

SEQ ID NO: 6632 - protein, 153 aa, Zea mays
  misc_feature: Ceres CLONE 338044-F
  misc_feature (4)..(153): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
MAKIKIGINGFGRIGRLVARVALQSDDVELVAVNDPFISTDYMTYMFKYDTVHGQWKHHEVKVKDSKTLLFGEKEVAVFGCRNPEEIPWGSVGAEYVVESTGVFTDQEKAAAHLKGGAKKVVISAPSKDAPMFVVGVHEKEYKSDINIVSNAS

SEQ ID NO: 6633 - DNA, 508 bp, Zea mays
  misc_feature: Ceres CLONE 338058-F
  misc_feature: Encodes the peptide sequence at SEQ ID NO. 6634
aaaaatttcgatctcatttgaaatcaacccatcctcgtttcctccgtctagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggactccaagacccttctctttggtgagaaggaggttgctgtgtttggctgcaggaaccctgaggagatcccatggggttcggttggcgctgaatatgttgttgagtctactggtgttttcactgaccaggagaaggctgcagctcacttgaagggtggtgccaagaaggttgtcatttctgctcctagcaaggatgcccccatgttcgttgttggtgtcaacgagaaggagtacaagtctgacatcaaca

SEQ ID NO: 6634 - protein, 147 aa, Zea mays
  misc_feature: Ceres CLONE 338058-F
  misc_feature (4)..(145): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
MAKIKIGINGFGRIGRLVARVALQSDDVELVAVNDPFISTDYMTYMFKYDTVHGQWKHHEVKVKDSKTLLFGEKEVAVFGCRNPEEIPWGSVGAEYVVESTGVFTDQEKAAAHLKGGAKKVVISAPSKDAPMFVVGVNEKEYKSDIN

SEQ ID NO: 6635 - DNA, 491 bp, Zea mays
  misc_feature: Ceres CLONE 338074-F
  misc_feature: Encodes the peptide sequence at SEQ ID NO. 6636
attcaaacttcacatagagccgttgctcagcactcgcgacccactaccaatcctccaagcacaacaaccaatctttgcaagccgtccaaagccgccgccgacgccatggggaaactcggagccaagtccgactacgagagtctccgcgacgcccgcatctccgagaacatggcccggatggagatgctcggccttctccgctgcgcgggggagctcagcgacatcgcctccgcctccagccaccgcgcggcagggagcgcgacgcctcggaagacccccaggccacgggtgacgagcatgaccccgctccgccgctccggccgcctcctcgccgcgacgccgacccgcccgaccggatccgcgtcgacgcaccgctgttccactcggctgaatggacagggcacaggggttctgagtaagttgacggcggcgggatcggaggaggaggatgatacatgggaagatgathaggaggggaagtgggcggtggc

SEQ ID NO: 6636 - protein, 128 aa, Zea mays
  misc_feature: Ceres CLONE 338074-F
  misc_feature (122)..(122): Xaa is any aa, unknown, or other
MGKLGAKSDYESLRDARISENMARMEMLGLLRCAGELSDIASASSHRAAGSATPRKTPRPRVTSMTPLRRSGRLLAATPTRPTGSASTHRCSTRLNGQGTGVLSKLTAAGSEEEDDTWEDDXEGKWAV

SEQ ID NO: 6637 - DNA, 492 bp, Zea mays
  misc_feature: Ceres CLONE 338093-F
  misc_feature: Encodes the peptide sequence at SEQ ID NO. 6638
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggaggcgtccctgtcgtgcgtccgctcgtggggcggcgcgctctcgtcatcacccacctcgtgtacg

SEQ ID NO: 6638 - protein, 136 aa, Zea mays
  misc_feature: Ceres CLONE 338093-F
  misc_feature (10)..(132): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MVSSSMDTTSDKRASSMLAPNPGKATILALGHAFPQQLVMQDYVVDGFMKNTNCDDPELKEKLTRLCKTTTVRTRYVVMSDEILKNYPELAQEGLPTMNQRLDISNAAVTQMATEASLSCVRSWGGALSSSPTSCT

SEQ ID NO: 6639 - DNA, 409 bp, Zea mays
  misc_feature: Ceres CLONE 338181-F
  misc_feature: Encodes the peptide sequence at SEQ ID NO. 6640
catcgcctccaccgttctctcttcctctgctcttctctgcctgcctgagctcaccgcacctcgcctcctcaccgcgtttcctccgttaatccggtagaaaatggccgatgccgaggatatccagcccctcgtctgcgacaacggaactggcatggtcaaggctgggttcgccggcgacgacgccccgagggccgtcttccccagcatcgtggggcgcccgcgccacactggtgtcatggtcgggatgaggcagaaggacgcctacgtcggtgacgaggcgcagtccaagaggggtatcctgaccctcaagtaccccatcgagcacgggatcgtcagcaactgggacgacatggagaagatctggcatcacaccttctacaacgagctccgcgtggctcccgaggagcac

SEQ ID NO: 6640 - protein, 103 aa, Zea mays
  misc_feature: Ceres CLONE 338181-F
  misc_feature: SWISSPROT Homolog: EC 2.7.10.2 Non-specific protein-tyrosine kinase
MADAEDIQPLVCDNGTGMVKAGFAGDDAPRAVFPSIVGRPRHTGVMVGMRQKDAYVGDEAQSKRGILTLKYPIEHGIVSNWDDMEKIWHHTFYNELRVAPEEH

SEQ ID NO: 6641 - DNA, 502 bp, Zea mays
  misc_feature: Ceres CLONE 338229-F
  misc_feature: Encodes the peptide sequence at SEQ ID NO. 6642
agaggaggaaaagcacgcgagagcttgtcggagggctctctgtctctgtgataaaccgatacgcagaggaagctgcggagaggtgtccctgctctgccggtgagctgcggccagcgggtgaagagaagtggaccggacggggacgaaggagagagagaagaagaaaaaggcgccgcgggggccatggctggacacgcgccggcgagggacaagaccaccaccggcttcgccgctacgtgcagcctgctgagccagtttctcaaggagaagaagggcggcctgcagggcctcggcggcctcgccatggcgccggcgccggcagctggagcaggggctttccggccgccgaccaccatgaacttgctgtccgcgctcgacgcggccaaggccaccgtcggggagccagaaggccatggccaacgcaccggcgggaatccaagggaggcagctggggaggaggcgcagcagctgaccatcttctacgggcggaaaagtggtcgtc

SEQ ID NO: 6642 - protein, 106 aa, Zea mays
  misc_feature: Ceres CLONE 338229-F
MAGHAPARDKTTTGFAATCSLLSQFLKEKKGGLQGLGGLAMAPAPAAGAGAFRPPTTMNLLSALDAAKATVGEPEGHGQRTGGNPREAAGEEAQQLTIFYGRKSGR

SEQ ID NO: 6643 - DNA, 429 bp, Zea mays
  misc_feature: Ceres CLONE 338235-F
  misc_feature: Encodes the peptide sequence at SEQ ID NO. 6644
atcgcctccaccgttctctcttcctctgctcttctctgcctgcctgagctcaccgcacctcgcctcctcaccgcgtttcctccgttaatccggtagaaaatggccgatgccgaggatatccagcccctcgtctgcgacaacggaactggcatggtcaaggctgggttcgccggcgacgacgccccgagggccgtcttccccagcatcgtggggcgcccgcgccacactggtgtcatggtcgggatggggcagaaggacgcctacgtcggtgacgaggcgcagtccaagaggggtatcctgaccctcaagtaccccahcgagcacgggatcgtcagcaactgggacgacatggagaagatctggcatcacaccttctacaacgagctccgcgtggctcccgaggagcaccccgtcctcctcaccgaggcg

SEQ ID NO: 6644 - protein, 110 aa, Zea mays
  misc_feature: Ceres CLONE 338235-F
  misc_feature (4)..(110): Pfam Name: Actin Pfam Description: Actin
  misc_feature: SWISSPROT Homolog: EC 2.7.10.2 Non-specific protein-tyrosine kinase
  misc_feature (73)..(73): Xaa is any aa, unknown, or other
MADAEDIQPLVCDNGTGMVKAGFAGDDAPRAVFPSIVGRPRHTGVMVGMGQKDAYVGDEAQSKRGILTLKYPXEHGIVSNWDDMEKIWHHTFYNELRVAPEEHPVLLTEA

SEQ ID NO: 6645 - DNA, 389 bp, Zea mays
  misc_feature: Ceres CLONE 338265-F
  misc_feature: Encodes the peptide sequence at SEQ ID NO. 6646
ataaaaacgcccacggacggcgactggcctttcgattcgcccagggcaatattccccccggaccaaactagatcagcgaaacccactccgctctcccgagatcggacacatggcggcggcggcagtgacgtccaacggcggcgcagtggccgcgaacgggccggcgcccggcaggctggcctccgtgtacagcgaggtgcagacgagccggctcctgcacacgctgcccctcccctccgtcctccgctccaacttctcggtcgtcgacggccccgccagctccgccgcgggtaayccgatgagatcgccaagctcttccccaacctgttcggccagccctcggcgtcgctggtgccttcggccgagcccgcggcgaccaggccgctaaa

SEQ ID NO: 6646 - protein, 92 aa, Zea mays
  misc_feature: Ceres CLONE 338265-F
  misc_feature: SWISSPROT Homolog: EC 2.7.1.90 Diphosphate--fructose-6-phosphate 1-phosphotransferase
MAAAAVTSNGGAVAANGPAPGRLASVYSEVQTSRLLHTLPLPSVLRSNFSVVDGPASSAAGNPMRSPSSSPTCSASPRRRWCLRPSPRRPGR

SEQ ID NO: 6647 - DNA, 493 bp, Zea mays
  misc_feature: Ceres CLONE 338270-F
  misc_feature: Encodes the peptide sequence at SEQ ID NO. 6648
cgcaaacaacacacgaacaccgcaccgcaacgtagccggctaggggaagagctctttccttcagctgtgccgtgcacaacgcacggcacgctggtttggtttgcatcgcccccgccaagaaagacgctgccgtgagcgggctgagcgggcgggaagctgcagctggacctggtccacatcctctgctcggcgttcctggtcgtcttcgtcggcaccgtgtacgtgatgtcgcggcccaggccggtgtacctggtggactacgcctgctacaagccccccgccagctgccgcgtgcccttcgccaccttcatggagcacacgcgcctcatcagcgacgacgacaagagcgtgcgcttccagaccaggatcctggagcgctcggggctcggcgaggacacgtgcctcccgcccgccaaccactacatcccgcccaaccccagcatggaggcctcgcgcgccgaggcgcagctcgtcatcttctccgccatcgacg

SEQ ID NO: 6648 - protein, 89 aa, Zea mays
  misc_feature: Ceres CLONE 338270-F
  misc_feature (1)..(89): Pfam Name: FAE1_CUT1_RppA Pfam Description: FAE1/Type III polyketide synthase-like protein
  misc_feature: SWISSPROT Homolog: EC 2.3.1.119 Icosanoyl-CoA synthase
MSRPRPVYLVDYACYKPPASCRVPFATFMEHTRLISDDDKSVRFQTRILERSGLGEDTCLPPANHYIPPNPSMEASRAEAQLVIFSAID

SEQ ID NO: 6649 - DNA, 481 bp, Zea mays
  misc_feature: Ceres CLONE 338272-F
  misc_feature: Encodes the peptide sequence at SEQ ID NO. 6650
atatacgagccccgcagcccccgtccccgtccccgtcctcctcctcttcttcccccttcctagcggcacggcaccaggcccgccctggtggcatctccgtaatttcgcgcctcttcgccgccaaggggtggggccgtgggggtggcaagaggaagaggtatgggcaacgccagcggccgcgaggaggacgctgcagctgttgacggcgacggcgccgacgtggaggacggcggaggggactcgtcggtccgctcgtcggagcgcgcctttccgccgtacggcagcgtaggagccaaccacgtgcggcgcgcgtgctcggtgggtgtcgtaggtggcggtggaggcgccggatcgccacccgggagtcctggccactcgctctcgccgcggatgttcgtgccccagacccctgtacctccactgcaaagggctgctgatgtaactccagtgttcaaccagatattgatgaatgatcaagaag

SEQ ID NO: 6650 - protein, 107 aa, Zea mays
  misc_feature: Ceres CLONE 338272-F
MGNASGREEDAAAVDGDGADVEDGGGDSSVRSSERAFPPYGSVGANHVRRACSVGVVGGGGGAGSPPGSPGHSLSPRMFVPQTPVPPLQRAADVTPVFNQILMNDQE

SEQ ID NO: 6651 - DNA, 511 bp, Zea mays
  misc_feature: Ceres CLONE 338341-F
  misc_feature: Translation starting site: 126
atccttccactcaaacgatcgcaacacgatccaaagaacgacgtgggggagcgagcgatagagccagaacaagaggagcgatccagaggagaagacgaaagagtcaggggagctgctaaggaccgatggccgaccccagctattggatagggatggacatcgaaacctccgtcacgatgctcgtcatctgtctcgccgccgccgtcgtgagcgtgtgcctcttcttcattttcatgtgcatcgtgcaatggttggactcgccacggatgcgcgtcttcaggctcggcggcgtcaccacctgaggcagaacctggactacacctgcaccctgtgccaaaacagcatggaggccggcgagaaggtccgcacgctctcctgcgaccacgtgttccactgcggcggcagcgtcaagtgcgagggaatcgaccactgccttcgcaccggaccgatggagcgctgcccgacctgtgaccgggttccccatcccgtgccctggaagcggacaccgcca

SEQ ID NO: 6652 - DNA, 528 bp, Zea mays
  misc_feature: Ceres CLONE 338452-F
  misc_feature: Encodes the peptide sequence at SEQ ID NO. 6653
aacctctagctgattgatctctggttyaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggaggcgtcctgtcgtgcgtccgctcgtggggcggcgcgctctcgtccatcacccacctcgtgtacgtctcgtcgagcgaggcgcgcttcccgggcggcgact

SEQ ID NO: 6653 - protein, 148 aa, Zea mays
  misc_feature: Ceres CLONE 338452-F
  misc_feature (10)..(148): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MVSSSMDTTSDKRASSMLAPNPGKATILALGHAFPQQLVMQDYVVDGFMKNTNCDDPELKEKLTRLCKTTTVRTRYVVMSDEILKNYPELAQEGLPTMNQRLDISNAAVTQMATEASCRASARGAARSRPSPTSCTSRRARRASRAAT

SEQ ID NO: 6654 - DNA, 456 bp, Zea mays
  misc_feature: Ceres CLONE 338519-F
  misc_feature: Encodes the peptide sequence at SEQ ID NO. 6655
agccgcagtaccaccagtccagcctccagctaggggaagggggcgaggaaggagccagagcagacccaaaccctcaatggcttcctctcgcgctctcgctttcttcctcctctgcgccctgctgcccgcgcccccagtctcggccacattgctgttcggcggcggcaagtcggccaagaaggcgggcgtcgacgcggagtggcggccggccaccgcgacgtggtacggcgaggccgagggcgacggcagcgacggcggcgcgtgcggctacgggacgctggtggatgtggtgccgatgaaggcgcgggtggggtcggtgagccccgtgctgttcaaggacggcgagggctgcggcgcctgctacaaggtcaggtgcctggaccgcggcgtgtgctcgcgccgggccgtcacggtggtcgtcacggacgagtgccccggcgggctgtgcgcgttcgg

SEQ ID NO: 6655 - protein, 126 aa, Zea mays
  misc_feature: Ceres CLONE 338519-F
MASSRALAFFLLCALLPAPPVSATLLFGGGKSAKKAGVDAEWRPATATWYGEAEGDGSDGGACGYGTLVDVVPMKARVGSVSPVLFKDGEGCGACYKVRCLDRGVCSRRAVTVVVTDECPGGLCAF

SEQ ID NO: 6656 - DNA, 506 bp, Zea mays
  misc_feature: Ceres CLONE 338521-F
  misc_feature: Encodes the peptide sequence at SEQ ID NO. 6657
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggaggcgtccctgtcgtgcgtccgctcgtgcggcggcgcgctctcgtccatcayccacctcgtgtacgtctcgtcgagcga

SEQ ID NO: 6657 - protein, 140 aa, Zea mays
  misc_feature: Ceres CLONE 338521-F
  misc_feature (10)..(140): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
  misc_feature (132)..(132): Xaa is any aa, unknown, or other
MVSSSMDTTSDKRASSMLAPNPGKATILALGHAFPQQLVMQDYVVDGFMKNTNCDDPELKEKLTRLCKTTTVRTRYVVMSDEILKNYPELAQEGLPTMNQRLDISNAAVTQMATEASLSCVRSCGGALSSIXHLVYVSSS

SEQ ID NO: 6658 - DNA, 468 bp, Zea mays
  misc_feature: Ceres CLONE 338592-F
  misc_feature: Encodes the peptide sequence at SEQ ID NO. 6659
ctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacscagatggcgacggaggcgtccctgtcgtgcgtccgctcgtggggcggcscgctctcg

SEQ ID NO: 6659 - protein, 129 aa, Zea mays
  misc_feature: Ceres CLONE 338592-F
  misc_feature (10)..(129): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
  misc_feature (127)..(127): Xaa is any aa, unknown, or other
MVSSSMDTTSDKRASSMLAPNPGKATILALGHAFPQQLVMQDYVVDGFMKNTNCDDPELKEKLTRLCKTTTVRTRYVVMSDEILKNYPELAQEGLPTMNQRLDISNAAVTQMATEASLSCVRSWGGXLS

SEQ ID NO: 6660 - DNA, 510 bp, Zea mays
  misc_feature: Ceres CLONE 338599-F
  misc_feature: Encodes the peptide sequence at SEQ ID NO. 6661
atcgaacaccaatggcattcttgcattgaaggaaccttccctccacctccaccgcccgagagcgagcggccggacggggttttggttgggcatggctgccccggcgatgctccaagtggtgatcctcgccgcggtcctccttctcccgttcctcagcgtgccgggcgccgaggcacagaccaagaagttctgcctcacgcagttcgccatcgctagccaggcctgcgccatcctgccacccaccagtcctgagcaccaccaccatcatcacgatgacgaggacaatgacgaggacaacgacgaagatgaggacgaagacgaggacaacgatgaagatgaagaccgccgggcacgcacgcctgcatatggcgcgagagcgactagcttaattgtatacgtacgtgctgtgcccatacatgcgcatatatacggtaacggtatatagatactgactgctacatgattcgagagcgacgacsatcgaggattcgaggtcgtctggccttttcc

SEQ ID NO: 6661 - protein, 117 aa, Zea mays
  misc_feature: Ceres CLONE 338599-F
MAAPAMLQVVILAAVLLLPFLSVPGAEAQTKKFCLTQFAIASQACAILPPTSPEHHHHHHDDEDNDEDNDEDEDEDEDNDEDEDRRARTPAYGARATSLIVYVRAVPIHAHIYGNGI

SEQ ID NO: 6662 - DNA, 413 bp, Zea mays
  misc_feature: Ceres CLONE 338651-F
  misc_feature: Encodes the peptide sequence at SEQ ID NO. 6663
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccktggccacgccttcccgcrgcmgmttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgac

SEQ ID NO: 6663 - protein, 109 aa, Zea mays
  misc_feature: Ceres CLONE 338651-F
  misc_feature (10)..(109): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
  misc_feature (30)..(30): Xaa is any aa, unknown, or other
  misc_feature (36)..(36): Xaa is any aa, unknown, or other
  misc_feature (37)..(37): Xaa is any aa, unknown, or other
  misc_feature (38)..(38): Xaa is any aa, unknown, or other
MVSSSMDTTSDKRASSMLAPNPGKATILAXGHAFPXXXVMQDYVVDGFMKNTNCDDPELKEKLTRLCKTTTVRTRYVVMSDEILKNYPELAQEGLPTMNQRLDISNAAV

SEQ ID NO: 6664 - DNA, 1288 bp, Zea mays
  misc_feature: Ceres CLONE 338736
  misc_feature: Encodes the peptide sequence at SEQ ID NO. 6665
acacacacagcaccatgcttcacaggaggagccgcacgctgggagggagctccgatcgacctgcgcgccgagctgtcgcggtgaagagcggcagggggagcaatggcgcggccacragacctgctcgtctgcttcccgtcgcgggcgcacctcgccctcatgccgcccaaggccatctgcagcccgtcgcggccgtcggcgtccgagccggtcaagcgccggcacagcaccagccggccgcccagcgggctctacaagtcggccgcgggcgcggccaggaacccgagccgccgcggcgcggacgtccccgtggacgacgagccgacgtcgcccaaggtgacgtgcgtggggcagatcaaggcccgccaggccaagcccaagggccccgggcccggcggtggcggtggcggtggcaagaagaccaagaaggccacgtggctgcaggcgctggggatcaagaaggacgccctggcgctcttggacgccctgcacggcgctttcaggttcaacgttgccggatgcttcggcagcttccccggcgccgtgggcgtggggtacacttccggggaggacgacgaagacgaggaacacgatgcgccgcgcaccgagaaggaaacagaacacggcgcggcattggcccggtggttcatggtattggaggaaggcaagaaggtgtctgccaagaagctgcagggccaaaaaccggaacagagccaccaggaggaggacagggaggaagacgcggccccgccggcgaacgcgctgatgctgatgcggtgccggtcggcaccggcgaagggattagcgaggaggctagagacagaggaggagcgcaatgatgtgaagggcgccgccaagaagactccagatcaggaagagaaggagaacgagggcctggtgctcatgacatactcgccggacttcttcaaggtgtcccttgacattgccaaggagacttggatcgtcggcggtgatgacgcggtcctgcgctgccggagctggaagagatgatcgcagtgactgttcaacaaggaatgtatgtgccttttgttttaccttttactcctccgcttgcttttttttcttctttttttcccggacactcttgatgattactactactcttgcataaggctcgtgtgaagggtacgatcagcacacagcagaattggtttagccaaggccactgtatgtctgtattggcctcaccctgcaaaacattcctgctctgtaaatagtgctgtaaagtcccttgttaaatgttgcccaggcaaaaaaaaaaaaaaaa

SEQ ID NO: 6665 - protein, 302 aa, Zea mays
  misc_feature: Ceres CLONE 338736
  misc_feature (5)..(5): Xaa is any aa, unknown, or other
MARPXDLLVCFPSRAHLALMPPKAICSPSRPSASEPVKRRHSTSRPPSGLYKSAAGAARNPSRRGADVPVDDEPTSPKVTCVGQIKARQAKPKGPGPGGGGGGGKKTKKATWLQALGIKKDALALLDALHGAFRFNVAGCFGSFPGAVGVGYTSGEDDEDEEHDAPRTEKETEHGAALARWFMVLEEGKKVSAKKLQGQKPEQSHQEEDREEDAAPPANALMLMRCRSAPAKGLARRLETEEERNDVKGAAKKTPDQEEKENEGLVLMTYSPDFFKVSLDIAKETWIVGGDDAVLRCRSWKR

SEQ ID NO: 6666 - DNA, 480 bp, Zea mays
  misc_feature: Ceres CLONE 338754-F
  misc_feature: Translation starting site: 140
atcaccatttcgctagctccatagcacttgttccagctagctaggagagagagctttgtttaggcggcggcaagatgaacaggaggccaggagactgggactgcagggcgtgaccagcacctcaacttcagccgtcgggatgcatgccagcgctgcagtgaaccacgtggagttggtgatcgtagcggcggtggtggcgacttgggtgggcgtggtggttcctccttcggcggtggctttggtgctggctctgatgtccgccctggtgactggtactgctcctgcggcgcacacaacttcgccagccgctccaactgcttcaggtgctctgcctacaaggaggaggctgccggcgcctttgatagtgacatgtcacgctcacgcggctacgccggcttcggcagcggcgctgccgcccgtaccaaccgccccggttggaagtctggagactggatctgcaccaggtgctgcgtcgtgttt

SEQ ID NO: 6667 - DNA, 227 bp, Zea mays
  misc_feature: Ceres CLONE 338803-F
  misc_feature: Encodes the peptide sequence at SEQ ID NO. 6668
aattcccgaatctcacacccaaaagtttcccactgccctggtcccccattcaattcttccaactccgccgcttcgcctcgttccgtccgccgcccccatggcgtccgccgccgccacgaccacctccgcccccgcccagaacctcaatccccttagtatcaacatcaagctccccccatggctcagcgggctgcgctgccccttcaccttcgtctgcccgcccccgc

SEQ ID NO: 6668 - protein, 43 aa, Zea mays
  misc_feature: Ceres CLONE 338803-F
MASAAATTTSAPAQNLNPLSINIKLPPWLSGLRCPFTFVCPPP

SEQ ID NO: 6669 - DNA, 505 bp, Zea mays
  misc_feature: Ceres CLONE 338820-F
  misc_feature: Encodes the peptide sequence at SEQ ID NO. 6670
atttaccacaccctgctctcgctcttgttgtgacggtcgattcgcttgtacaagtgaccacccttccgctcccttctcacctatagctagcaaccttgagatccagccaagatccagccatgagggagattctccacatccagggtggacagtgcggcaaccagatcggttccaagttctgggaggtcgtctgcgacgagcatggtatcgaccccaccggacgctatgtcggcacctccgacctccagctcgagcgcgtcaatgtctactacaacgaggcctcatgcggccgcttcgtgccgcgcgccgtgctcatggacctcgagcccggcaccatggacagcgtccgcaccgggccgtacggccagatcttccgccccgacaacttcgtcttcggccagtctggcgcggggaacaactgggccaagggccactacacagagggcgctgagctcatcgactctgtgcttgacgtcgtgaggaaagaggcggagaactgcgactg

SEQ ID NO: 6670 - protein, 128 aa, Zea mays
  misc_feature: Ceres CLONE 338820-F
  misc_feature (45)..(128): Pfam Name: Tubulin Pfam Description: Tubulin/FtsZ family, GTPase domain
MREILHIQGGQCGNQIGSKFWEVVCDEHGIDPTGRYVGTSDLQLERVNVYYNEASCGRFVPRAVLMDLEPGTMDSVRTGPYGQIFRPDNFVFGQSGAGNNWAKGHYTEGAELIDSVLDVVRKEAENCD

SEQ ID NO: 6671 - DNA, 890 bp, Zea mays
  misc_feature: Ceres CLONE 338910
  misc_feature: Encodes the peptide sequence at SEQ ID NO. 6672
aaaagcccaagccaaaccaaacaatttcacctcacgcacgaaaccgggaagcaagcaaggtcctcccaactcccagcaacccaaggtagcgcgcggcagcagcaagcagctcgacggcgacgatggcggcaacagcggttactactccagtaggcacgggcggcgctgcggcagcgagaagccggttcgcggcggcgtgcggggcgctcagccagtacgtcaaggcggccgaatccgagaggatgcacgcgaggccgcccgcgcctctgcggccgctcccgctcatgccgggcgccgacgtcgacgccagccctgccgacctagacctgcctcaggcggcgccggcgccggcgccggcgcagttgaccatcgtgtacggagggcgtgtgctggtgctcgctgacgtccccgccgacaaggcggcgggcctgcttcgcctcgccgccggcgcagcagcggaacgtgcagaaacagaggcgatcggtgccaagcgccgcgaccatgtctccggctctgcgtctgcgggcgctgacctgccagttgcgaggaaggcgtcgctgcagcggttcatggagaagcgcaaggctcgggtcgccgccgtccgcacggagccgtaccgacggccggacgtcagcgactcctgtcctgacaacctcaagcttgcgctctgattcctgttccgtgtccctacgcactttctataattttgtaggcgaggtataggattataggaagagcrgcgaaacatgggtgtaccaagtgaaatccagatctgaacaaagttttctgaaaaacacagttgcacgtgctttctacggcattattttgtaaatctccagctttaaccacaacacaactgtttctcaataaagaaaaaaaaaaaaaaaaaa

SEQ ID NO: 6672 - protein, 182 aa, Zea mays
  misc_feature: Ceres CLONE 338910
MAATAVTTPVGTGGAAAARSRFAAACGALSQYVKAAESERMHARPPAPLRPLPLMPGADVDASPADLDLPQAAPAPAPAQLTIVYGGRVLVLADVPADKAAGLLRLAAGAAAERAETEAIGAKRRDHVSGSASAGADLPVARKASLQRFMEKRKARVAAVRTEPYRRPDVSDSCPDNLKLAL

SEQ ID NO: 6673 - DNA, 308 bp, Zea mays
  misc_feature: Ceres CLONE 338936-F
  misc_feature (110)..(110): n is a, c, t, g, unknown, or other
gcgattgacgattccaccgcttgtacatttcccctccccccacacacacgccggtgcgtcgcctgcgcaatcatacttcctaccctccccacctcttccacggttccacnmcgtccctctcctctcgagaagcacccgcaccatacatcttccggcgcccgacgcggacggcgagccgctgctgctgctgcgccggaggaggaagggcaccagggccagcgggtgcaggaggaggaggagcagcagcaggccgccggccgcttggggctgtgccacatgccgctctggggggccgctgcgtccgcggc

SEQ ID NO: 6674 - DNA, 483 bp, Zea mays
  misc_feature: Ceres CLONE 338940-F
  misc_feature: Encodes the peptide sequence at SEQ ID NO. 6675
aaaaaaccgttcgtctagcttggctcgtccctgtccggtaccttctctcaagccgcgcagttgtcgaagtcgaaactatccgctgctgtagtagagatgctctcgatgcggccacccagcaccaccttgtcgcgccccttgatttggccgagacggggtcgcctcgggggagccgccgcgccgcaatatgttagcgccgcggcaccggcgcccgctctggagccagctgcgcctccggagagcgtctcctttccgattctggtgaatggctgcactggtaacatggggttatctgtcgctgaggctgctgctctgaggggccttcacctagtccctgtttcattcagtagtagagagaaggttgaaaaaacaatacaagttggacaaacagacattcaaatatatggtccttctaaaagagaagatgttgtttcatctattgctgatgaattcccagatgtcattgttgtggactacacagga

SEQ ID NO: 6675 - protein, 129 aa, Zea mays
  misc_feature: Ceres CLONE 338940-F
  misc_feature: SWISSPROT Homolog: EC 1.3.1.26 Dihydrodipicolinate reductase
MLSMRPPSTTLSRPLIWPRRGRLGGAAAPQYVSAAAPAPALEPAAPPESVSFPILVNGCTGNMGLSVAEAAALRGLHLVPVSFSSREKVEKTIQVGQTDIQIYGPSKREDVVSSIADEFPDVIVVDYTG

SEQ ID NO: 6676 - DNA, 291 bp, Zea mays
  misc_feature: Ceres CLONE 338957-F
  misc_feature: Encodes the peptide sequence at SEQ ID NO. 6677
mcagttcaaacagtgcagcgtcggcggtggcggggacgacgacgcgatgaacgccttcttcacgtccctggcgcgcgggctggacgacctgggccgtgcgggcgggctgtcgtcgctgtcragctctgctgcgggcggccgcgctgctcagggggctgcactcgcagctcacgctcatggtcggccagctccacctgccgccgggcggccgctggctcgacgagtacatggacgagacggcccgcctctgggacgcttgcctcgccctcaagctcggcctcgcctccgtcg

SEQ ID NO: 6677 - protein, 38 aa, Zea mays
  misc_feature: Ceres CLONE 338957-F
MVGQLHLPPGGRWLDEYMDETARLWDACLALKLGLASV

SEQ ID NO: 6678 - DNA, 513 bp, Zea mays
  misc_feature: Ceres CLONE 338995-F
  misc_feature: Encodes the peptide sequence at SEQ ID NO. 6679
gactaggccaagaaaatctgtcaaacttccgcgcactgccgtctgtccactatggccttcgccgcctccccttccctctccgcactcgcttcctcctcgtcgtccaccgccgccgcccccacgccttcttccaaccctttgcacgagccgaggcttctccacctctcgctcaagcccgtcttacccctccccaagccgcatgcgctctcctgctccgcgccgcacatcccccgcgccgccgctggggacggatcgggcgtcgggaatgaggcaaggatggaggcggcggcgggggtggcgaggatgaagacgactgcgacgatgcggacttcggcccgctgctcggcttccacgaggtgctgcacctcgccgcggcgcgcggcgttgcgctcccgggcgacatgctggaggcggccaaggacgccggcatccgggaagtcctcttgctccgctacttcgatctgcaggccgcgcccgtggccactaggcgtgttgatccgcgccttctcgatg

SEQ ID NO: 6679 - protein, 37 aa, Zea mays
  misc_feature: Ceres CLONE 338995-F
MLEAAKDAGIREVLLLRYFDLQAAPVATRRVDPRLLD

SEQ ID NO: 6680 - DNA, 520 bp, Zea mays
  misc_feature: Ceres CLONE 339070-F
  misc_feature: Translation starting site: 106
  misc_feature: SWISSPROT Homolog: EC 2.7.11.1 Non-specific serine/threonine protein kinase
attcaaacttcacatagagccgttgctcagcactcgcgacccactaccaatcctccaagcacaacaaccaatctttgcaagccgtccaaagccgccgccgacgccatggggaaactcggagccaagtccgactacgagagtctccgcgacgcccgcatctccgagaacatggcccggatggagatgctcggccttctccgctgcgcgggggagctcagcgacatcgcctccgcctccagccaccgcgcggcagggagcgcgacgcctcggaagacccccaggccacgggtgacgagcatgaccccgctccgccgctccggccgcctcctcgccgcgacgccgacccgcccgaccggatccgcgtcgacgcaccgctgttccactcggctgaatggacagggcacaggggttctgagtaagttgacggcggcgggatcggaggaggaggatgatacatgggaagatgataaggaggggaagtgggcggtggcggtgaccaaggagagggtacaggcgctgc

SEQ ID NO: 6681 - DNA, 491 bp, Zea mays
  misc_feature: Ceres CLONE 339101-F
  misc_feature: Encodes the peptide sequence at SEQ ID NO. 6682
aaaccttctagckgattgyatctctggtttaccactctttccttccctccttcaattctaaataccacaaakcaaagttgctttgcgatggtgagcagcagcatggacacgacgagtgacaaacgtgcgtcatccatgctggckcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaakacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggakgcgtccctgtcgtgcgtccgctcgtggggcggcgcgctctcgtccatcacccacctcgt

SEQ ID NO: 6682 - protein, 134 aa, Zea mays
  misc_feature: Ceres CLONE 339101-F
  misc_feature (10)..(134): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
  misc_feature (68)..(68): Xaa is any aa, unknown, or other
  misc_feature (115)..(115): Xaa is any aa, unknown, or other
MVSSSMDTTSDKRASSMLAPNPGKATILALGHAFPQQLVMQDYVVDGFMKNTNCDDPELKEKLTRLCXTTTVRTRYVVMSDEILKNYPELAQEGLPTMNQRLDISNAAVTQMATXASLSCVRSWGGALSSITHL

SEQ ID NO: 6683 - DNA, 1359 bp, Zea mays
  misc_feature: Ceres CLONE 339104
  misc_feature: Encodes the peptide sequence at SEQ ID NO. 6684
attggtttgtatcccgtatccgtccttcgctcctagtgaatgtggtgcacgacggtggaaactgagtcacgtaatccctactgttgtttctccgattctccttacgacccgccggcgttgggcaaaagcggccggtgctggtcctctcctcttgcagaaggcaaccggcggcgatccccatctacagcaaaaaaacgaccggcggggagcctcttccccggaaaataatttgacgagtgtatagaaaatgtcaaggttggagctagtgttcaaaagaccacatatacaatgaagagagacatgctcaccgctcacggagagaaggtcattcttcgtgcccttgaaattgagaaatcccggctgccacactcaaagggtatttgagtacctgtggatcttctgtatccataaaggatcagatcccaaaacccattggtcaaactactgaatgcagtaaacagggcatatcttatatctgagattatagatccaagatgcagatcagcggctttgtcacccctattggtcctttatctgaagaaaatcacacgatcgacaagaatttgttgccgctggagtgtgaagggacaatggaatgccacacacgagacaacgatgctgttgggttggatgcaagagcggaaggtgttgtctgtgagctcacagaccttcagaataacatacaagtttatgatatcgagttgactgttctaggaaactacacaggtcacggcttgccccttgatttccttgagagtaaaacgactggtggacccatcaagggctaccctgttgttgtggatgttttagaggattgttcttcagtgagtattcatgatcacctcccagtggctaggagagttgggaagaagaggcagagacgcagacatgatggaaggtggacgaagaggaccccgctacgttttccggctgcgtccacggctgtgcgtgccatttccaccaccgtgcagacaaaaaagaactcaaacaaggacccggtactcgaggaatgctccctgctattggctctagctgcgaaagcctccctgctgcatacatgaagacccctaggtgacgcagttgactccagcggcatagaagtgtatcatgtttcatgtgagaacgactgctgatttctttctggttcgtgtggctcacctttgccccttacacctgacgcgaggtcgaccaggagcagcaaggactgcaatgctgcacttctttgtaatttatgttctgcctcccctctgtgtgctcctgtgcgcttggtttagtgcagtcgtgaggataagttggggctagttatggttggaagaacatgaaagatcgaattttatttaaacaaaaaaaaaaaaaaaa

SEQ ID NO: 6684 - protein, 188 aa, Zea mays
  misc_feature: Ceres CLONE 339104
MQISGFVTPIGPLSEENHTIDKNLLPLECEGTMECHTRDNDAVGLDARAEGVVCELTDLQNNIQVYDIELTVLGNYTGHGLPLDFLESKTTGGPIKGYPVVVDVLEDCSSVSIHDHLPVARRVGKKRQRRRHDGRWTKRTPLRFPAASTAVRAISTTVQTKKNSNKDPVLEECSLLLALAAKASLLHT

SEQ ID NO: 6685 - DNA, 482 bp, Zea mays
  misc_feature: Ceres CLONE 339187-F
aagcgaacagcctgcgggcctggcgctctgcctctccctctcgccgtgcagggcttcaggccatccgggctccggcttccggcatccatcaggcgtcctcataagatggtgtagggcagcgagcgccgagcagagcagcaaggcagagcagcgagcagccgagcagcgaggcagcgggcgtcctcagaatccgggctgccgagccgccgagcagagcagccgagagcagcgaggcagcgagaacggcccacgagaaggcccgtgcgggtgcggtcgccctgggccgaacaaccccggaccgccgtccgctgcttcctactcttcaccgcttcaccccgcgtgcgcgctttctctgttgctctgctacaactgcggcgccgccgcgccgccgccctacgccagttgccgagcccttcatcgctcttctcgccggcgacgagcacccacacaacaagtctttcacccacagaaggcaaagatga

SEQ ID NO: 6686 - DNA, 492 bp, Zea mays
  misc_feature: Ceres CLONE 339242-F
  misc_feature: Encodes the peptide sequence at SEQ ID NO. 6687
ttcgatatgtacgtacgtactcctccgcgcgccacgctcttggcgcgccacggctacccgtcccgtcatcggaccccgtcgcgccgccagcccgccaccgcgcacgcccgcgcgcatcgcctataaattcttgcaccgatccgcgcacacacgcacaagccaaacgtgcagctgagggaaccgcaccggcagtgacgtgtgcgttgccaaataaagctactactagtcaccgctcgattgtcgtcgcagccgccctcccgccggagatgggtgcgccggcgctgtcgtccgtcgtcgtggtggccacggcggcagtggtttgcctgtgcggggcctttgcgcgggcgcaggacatggacagcgagtgggcgcggccgccctaccgcgggttcttcggcgccccggccgggtcgctgctgccgcagtcggacgtggacctgctggagttcccgctgaacctggagtacctggagacggagttcttctgctggt

SEQ ID NO: 6687 - protein, 75 aa, Zea mays
  misc_feature: Ceres CLONE 339242-F
MGAPALSSVVVVATAAVVCLCGAFARAQDMDSEWARPPYRGFFGAPAGSLLPQSDVDLLEFPLNLEYLETEFFCW

SEQ ID NO: 6688 - DNA, 456 bp, Zea mays
  misc_feature: Ceres CLONE 339277-F
  misc_feature: Encodes the peptide sequence at SEQ ID NO. 6689
aacacggtggcatcgcagggtcagcagcatcattagaaaacgacgtctcgccgttcttcgtcttcagatctagggttctctcgtgctctgttctcatcttctgctcgctggtgtcccctccctctcacccatggcttcggcggcggcggcaactcaggtggggacttacttcctgcggaactactacaacctgctgcaacaaacccccgatgtcgtccaccagttctacagcgaagccagcaccatggtccgcgtcgacgacctcaccggcacgaccgcggctgccaacaacatgatggacatacactcactcatcatgtctttgaacttcacccaaattgagatcaagactgccaattttgtgaactcatggggcgatggggtgctagttatggtctctggtctagtgcagaccaaggagtacagccaccaaaggaaatttatccagatgttctt

SEQ ID NO: 6689 - protein, 108 aa, Zea mays
  misc_feature: Ceres CLONE 339277-F
  misc_feature (10)..(108): Pfam Name: NTF2 Pfam Description: Nuclear transport factor 2 (NTF2) domain
MASAAAATQVGTYFLRNYYNLLQQTPDVVHQFYSEASTMVRVDDLTGTTAAANNMMDIHSLIMSLNFTQIEIKTANFVNSWGDGVLVMVSGLVQTKEYSHQRKFIQMF

SEQ ID NO: 6690 - DNA, 652 bp, Zea mays
  misc_feature: Ceres CLONE 339308-R
  misc_feature (1)..(1): n is a, c, t, g, unknown, or other
ncgattgggtaccgggccccccctcgaggtcgacggtatcgataagctttttttttttttttttcaactcatgagatgaatttgagttcgtaagggcaagtatccccgtcttcaaacattatcatcaagaacatcggagtcgggtaacatatccagaattacaaatagcgctgacgagttatgaatctgaaatatctagaatccattcgggtttagaaatacataaagcaaagcaaaacaggtgctcctgacaaaatgggctgaaaacaacagccatctgaacagcccttggatgtccttccttcagaaacggcgaggggggaaccggtccatgagactggcagagggacactcataagccatgtggccacggccgccacagttgtggcagatcatgaaggcaccagccatgcaatcacgactcgtatggccaatctggttgcaggcccggcagaccacgtcactgaagccaccacggaagggagcgccaacatcatggaagggagcgccaacaccacggaagggaggaggcccacccctctcacccaatgtatcagacttggggcactgacgggccagatggccagcaacattgcacaggttgcaaacaggatcattggtgcagttacgggcaaggtggccgctctgccgg

SEQ ID NO: 6691 - DNA, 414 bp, Zea mays
  misc_feature: Ceres CLONE 339317-F
  misc_feature: Encodes the peptide sequence at SEQ ID NO. 6692
aagaggaaaagggcaaaagcaaaaggcatcaccgccgcgacgacgacgacgatggcagcctcgctccaakccgcggcaccctgatgcagccggccaagatcggcggccgggcgccctttgcctcgctgccggtcccgcccgtcgtcgcaactcgcctgcagggcgttcggcgtcgacccggcgccgccaggatcacgtgctccctgcaggacgtcgccagcaggtgcgtcgacgccgcgaagctcgccggcttcgcgctcgccacctcggcgctcctcgtctcgggcgcgagsgcggagggcacgcccaagaggctgacctacgacgagatccagagcaaaacgtacatggaggtgaagggcacgggcacggcgaaccagtgcccgaccatcgacggcggcgtggagtcgttcc

SEQ ID NO: 6692 - protein, 137 aa, Zea mays
  misc_feature: Ceres CLONE 339317-F
  misc_feature (23)..(23): Xaa is any aa, unknown, or other
  misc_feature (97)..(97): Xaa is any aa, unknown, or other
EEKGKSKRHHRRDDDDDGSLAPXRGTLMQPAKIGGRAPFASLPVPPVVATRLQGVRRRPGAARITCSLQDVASRCVDAAKLAGFALATSALLVSGAXAEGTPKRLTYDEIQSKTYMEVKGTGTANQCPTIDGGVESF

SEQ ID NO: 6693 - DNA, 451 bp, Zea mays
  misc_feature: Ceres CLONE 339356-F
  misc_feature: Encodes the peptide sequence at SEQ ID NO. 6694
acgaattccccattcccttcccccatcgcatcgagagccaggccagccagccacctctgctaggtctccatggccgccgcgctcaggtccccggcctcggccaaggtctcgagccccgccgccgcctccaaggtgcccaggcgtccagagtcgcggtgggcgggttccggcagcatccgcggagccgtgtcggccccgtggccgtgcgggcgtcgctgttctcgcccaagcccgcggcggccaaggacgcgcggccgaccaaggtgcaggagctgtacgtgtacgagatgaacgagcgggaccgcgagagccccgcgtacctgcgcctcagcgccaagcagacggagaacgcgctgggcgacctggtccccttcacaaacaaggtttacaacggcagcctggacaagcggctgggcatcaccgccggcatctgcgtgctcatccagcacgt

SEQ ID NO: 6694 - protein, 149 aa, Zea mays
  misc_feature: Ceres CLONE 339356-F
  misc_feature: SWISSPROT Homolog: EC 5.3.99.6 Allene-oxide cyclase
EFPIPFPHRIESQASQPPLLGLHGRRAQVPGLGQGLEPRRRLQGAQASRVAVGGFRQHPRSRVGPVAVRASLFSPKPAAAKDARPTKVQELYVYEMNERDRESPAYLRLSAKQTENALGDLVPFTNKVYNGSLDKRLGITAGICVLIQH

SEQ ID NO: 6695 - DNA, 1779 bp, Zea mays
  misc_feature: Ceres CLONE 339397
  misc_feature: Encodes the peptide sequence at SEQ ID NO. 6696
agatcaggtaaaccagtcactctactactcgatggaacaagctacatgggccgcgttcctcggcattgtcctttgcgcagcgctcttccacaggaccttccttgcgcgcggccggcgccgggccaacaaccccccgcccggccccaagccatggccgatcatcggcaacctaaacctcgtgggcgagctcccccaccgctccatgaacgagctctccaagcggtacggtccgctcatgcagctccggttcgggtcgttgcctgttgtcgtcggcgcgtcggttgagatggcaaagctcttcctcaagaccaatgacgcggcgttctccgaccggccgaggttcgcagtcggcaagtacatcgcgtacgacttctccgaggttcgccaggcacgtaggatctgcgccaccgagctcttcagcgccacgcggctcgagtcattcgagcacatccgcgacgaggaggtgcgcgtgatgctgcaacagctgcgccaagcggctgggcgcaccgtgctgctcagggactacctgcagatgttgacgctcggcgtgatctcgcgcatagttctgggcaagaagtacgtccaggaggaggcggcggacggtgagggggactcagcgccggcgatgacgcctgccgagttcggggagatggtggacgagttcttggtgcttcacggtgtgtttaacattggtgattacatcccatggctagattggctggacctgcagggctacgttgctaggatgaagagaatgaaggcgaggtttggtcgactcctggaacgactcctggacgtgcacaacgagcggcggctacgcgagggagggaacttcgtggcaaaggatatgttggacgtgctgctgcagctggccgatgatactagtcttgaagtccagctcaacagggacaatgttaaggctatcacacaggacctaatcattggaggcacggatactagtgcaaaggccctggagtgggctgtctcggagctgctcaagaaccccaaggtcttagccaaggccacagaagagctggaccacgtcatagggccggaccgactggtgacagaaagcgacctccctcgcctcccctacatcgaggctgtgctcaaggagaccctgcgcctgcaccctgccgcgccgatgctggcaccccacgtggcccgcgaggacacatccgtggacggctacgacgtgctcgctggcacggtcgtgttcatcaacgtgtgggcaatcggccgcgaccctgcgctgtgggacgcgccggaggagttccggccggagcggttcttcgagagcaagatcggcgtgaggggccatgacttccagctgctgccgttcggctctggccggcgaatgtgccccgggatcaacctcgcgctaaaggtgatggctttgacccttgccaatctgcttcacggcttcaagtggaggcttccggacggcgtgacggcggaggagctgagcatggaggaggccttccagctcacggtaccgcgtaagttcccgctcgaggccgtggtcgagcccaggttgccagaccgcctgtatacgggcgcttgatcgatgcccgtacctgtgttggacacttggactgttggcatgtgtggagcacagcacgtgattgttcagctcttggaaaatwaatgttgtgtctcgtatacaaattaattatggtagtgcatatataatgcacggtttgtgagagtttgatgtttcagatctatacgttgaattaggcctttatgccttgttcggtcaaaaaaaaaaaaaaaaaa

SEQ ID NO: 6696 - protein, 510 aa, Zea mays
  misc_feature: Ceres CLONE 339397
  misc_feature (35)..(494): Pfam Name: p450 Pfam Description: Cytochrome P450
  misc_feature: SWISSPROT Homolog: EC 1.14.13.21 Flavonoid 3'-monooxygenase
MEQATWAAFLGIVLCAALFHRTFLARGRRRANNPPPGPKPWPIIGNLNLVGELPHRSMNELSKRYGPLMQLRFGSLPVVVGASVEMAKLFLKTNDAAFSDRPRFAVGKYIAYDFSEVRQARRICATELFSATRLESFEHIRDEEVRVMLQQLRQAAGRTVLLRDYLQMLTLGVISRIVLGKKYVQEEAADGEGDSAPAMTPAEFGEMVDEFLVLHGVFNIGDYIPWLDWLDLQGYVARMKRMKARFGRLLERLLDVHNERRLREGGNFVAKDMLDVLLQLADDTSLEVQLNRDNVKAITQDLIIGGTDTSAKALEWAVSELLKNPKVLAKATEELDHVIGPDRLVTESDLPRLPYIEAVLKETLRLHPAAPMLAPHVAREDTSVDGYDVLAGTVVFINVWAIGRDPALWDAPEEFRPERFFESKIGVRGHDFQLLPFGSGRRMCPGINLALKVMALTLANLLHGFKWRLPDGVTAEELSMEEAFQLTVPRKFPLEAVVEPRLPDRLYTGA

SEQ ID NO: 6697 - DNA, 408 bp, Zea mays
  misc_feature: Ceres CLONE 339496-F
  misc_feature: Encodes the peptide sequence at SEQ ID NO. 6698
aatagagttttaaaaagagagtaatatagggagtgatatagaagtttgctatcaatttttcttctctcgtggctccgacgctccgtttctttctcggaggcgacagctcgaactcgaatccctcatccagcctggcgctggcgtcgccggtcgccgccgctcgattgcctccgcctgaatatcccttgccccataaggcctgaccttgaaagcctcgcctcttgatcccggcggcggcggaggggagggcgatgccgaagcggacgacacacacctactcgagcgaggacgcactgccggagggccccgagtccgaccttttcgtatactactgcaagcactgcgcctcacatgtcctcatcaccgatacccaattgcagaaaatgcccaagcgaaagabtgacagag

SEQ ID NO: 6698 - protein, 52 aa, Zea mays
  misc_feature: Ceres CLONE 339496-F
  misc_feature (50)..(50): Xaa is any aa, unknown, or other
MPKRTTHTYSSEDALPEGPESDLFVYYCKHCASHVLITDTQLQKMPKRKXDR

SEQ ID NO: 6699 - DNA, 136 bp, Zea mays
  misc_feature: Ceres CLONE 339557-F
  misc_feature: Encodes the peptide sequence at SEQ ID NO. 6700
agaacccatcaaaagcgaggctgcgagagatagagagagagagagagagagagagagagagagagcgagagagagagagagagagagagagagagagagagagagagagagagagagagagagagtagtgtgtgtg

SEQ ID NO: 6700 - protein, 45 aa, Zea mays
  misc_feature: Ceres CLONE 339557-F
EPIKSEAARDRERERERERERARERERERERERERERERERVVCV

SEQ ID NO: 6701 - DNA, 397 bp, Zea mays
  misc_feature: Ceres CLONE 339570-F
  misc_feature: Encodes the peptide sequence at SEQ ID NO. 6702
catcgcctccaccgctctctcttcctctgctcttctctgcctgcctgagctcaccgcacctcgcctcctcaccgcgtttcctccgttaatccggtagaaaatggccgatgccgaggatatccagcccctcgtctgcgacaacggaactggcatggtcaaggctgggttcgctggcgacgacgccccgagggcgtcttccccagcatcgtggggcgcccgcgccacactggtgtcatggtcgggatggggcagaaggacgcctacgtcggtgacgaggcgcagtccaagaggggtatcctgaccctcaagtaccccatcgagcacgggatcgtcagcaactgggacgacatggagaagatctggcatcacaccttctacaacgagctccgcgtggctc

SEQ ID NO: 6702 - protein, 54 aa, Zea mays
  misc_feature: Ceres CLONE 339570-F
  misc_feature: SWISSPROT Homolog: EC 2.7.10.2 Non-specific protein-tyrosine kinase
MVGMGQKDAYVGDEAQSKRGILTLKYPIEHGIVSNWDDMEKIWHHTFYNELRVA

SEQ ID NO: 6703 - DNA, 485 bp, Zea mays
  misc_feature: Ceres CLONE 339593-F
  misc_feature: Encodes the peptide sequence at SEQ ID NO. 6704
atctatctttgtggtcgtggtcctcccgtcgtcgtcgactcgtcgtcgtcggtgttgctccgatgggcaaggactcgaagccgaaggacgccaaggggaagggcaagcaggcggccggctcctctggcggcgacgacggcggcggcaagggaggcaagggcaagggcaagggcaagggcggcaagtccgctgacggactcggcacttgcacctacgtcaaagctaggcacgtattgtgtgagaagcaggggaagatcaatgaagcttataagaagttgcaggatggatggctgaataatggggacaaagttcctcctgctgagtttgctaaggtagcacaagagtattctgaatgcccatcagggaagaaaggtggagatcttggttggttcccgcgtggcaagatggctggtcctttccaggaggttgctttcaacacacctgagggaaactgttagcgcaccattcaagtccacgcacgggta

SEQ ID NO: 6704 - protein, 131 aa, Zea mays
  misc_feature: Ceres CLONE 339593-F
  misc_feature (56)..(130): Pfam Name: Rotamase Pfam Description: PPIC-type PPIASE domain
  misc_feature: SWISSPROT Homolog: EC 5.2.1.8 Peptidylprolyl isomerase
MGKDSKPKDAKGKGKQAAGSSGGDDGGGKGGKGKGKGKGGKSADGLGTCTYVKARHVLCEKQGKINEAYKKLQDGWLNNGDKVPPAEFAKVAQEYSECPSGKKGGDLGWFPRGKMAGPFQEVAFNTPEGNC

SEQ ID NO: 6705 - DNA, 510 bp, Zea mays
  misc_feature: Ceres CLONE 339668-F
  misc_feature: Encodes the peptide sequence at SEQ ID NO. 6706
atcacttttccttccgatcagatcctctcagttatcatggcgggcggcgccttcaccgagaagggcaagcaatatccggggaagatgacggtgttcgtcttcctcgcctgcctcgtcgcctcctccggcggcctcatcttcggatacgacattggcatctcaggcggcgtgacgtccatggacccgttcttgaagcgcttcttcccgtcggtgtacgccaaggagcaggaggtggtggagaccaaccagtactgcaagttcgacagcgtgctgctgacgctcttcacctcctcgctctacctcgcggcgctcgtcgcctccctcttcgccggctacatcaccaagaggtgcggccgcagggtgtccatgctcggcggcggcgccatcttcctcgtcggcgccgtcctcaacggcctcgcccagaacgtggccatgctcatcatcggcaggatctttctcggcattggcgtcggattcagcaatcagtccgtgccactgtacctgtcggag

SEQ ID NO: 6706 - protein, 158 aa, Zea mays
  misc_feature: Ceres CLONE 339668-F
MAGGAFTEKGKQYPGKMTVFVFLACLVASSGGLIFGYDIGISGGVTSMDPFLKRFFPSVYAKEQEVVETNQYCKFDSVLLTLFTSSLYLAALVASLFAGYITKRCGRRVSMLGGGAIFLVGAVLNGLAQNVAMLIIGRIFLGIGVGFSNQSVPLYLSE

SEQ ID NO: 6707 - DNA, 528 bp, Zea mays
  misc_feature: Ceres CLONE 339768-F
  misc_feature: Encodes the peptide sequence at SEQ ID NO. 6708
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggaggcgtccctgtcgtgcgtccgctcgtggggcggcgcgctctcgtccatcacccacctcgtgtacgtctcgtcgagcgaggcgcgcttcccgggcggcgac

SEQ ID NO: 6708 - protein, 148 aa, Zea mays; identical to SEQ ID NO: 6153
  misc_feature: Ceres CLONE 339768-F
  misc_feature (10)..(148): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase

SEQ ID NO: 6709 - DNA, 514 bp, Zea mays
  misc_feature: Ceres CLONE 339789-F
  misc_feature: Encodes the peptide sequence at SEQ ID NO. 6710
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggaggcgtcctgtcgtgcgtccgctcgtggggcggcgcgctctcgtccatcacccacctcgtgtacgtctcgtcgagcgaggcgcgctt

SEQ ID NO: 6710 - protein, 143 aa, Zea mays
  misc_feature: Ceres CLONE 339789-F
  misc_feature (10)..(137): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MVSSSMDTTSDKRASSMLAPNPGKATILALGHAFPQQLVMQDYVVDGFMKNTNCDDPELKEKLTRLCKTTTVRTRYVVMSDEILKNYPELAQEGLPTMNQRLDISNAAVTQMATEASCRASARGAARSRPSPTSCTSRRARRA

SEQ ID NO: 6711 - DNA, 502 bp, Zea mays
  misc_feature: Ceres CLONE 339811-F
  misc_feature: Encodes the peptide sequence at SEQ ID NO. 6712
ctagcagccacccggttctccctcgctccagatctcccttcgcagccggccagggaccccttcacagcgcgggagatggctgatcaggaggccccagttgcagttgaggcaccaaccccagttcttggagagccaatggacttgatgactgcgctgcagctggtgatgaagaagtcaagtgctcatgatggacttgtgaagggtcttcgcgaggctgccaaggccattgagaagcatgctgctcagctttgcgttcttgctgaggactgtgaccagccagattatgtcaagctggtgaaggcgctctgtgctgaacacaatgttcaccttgtcactgttcctgctgctaagactcttggcgagtgggctgggctttgcaagattgactccgagggcaaggcaaggaaggttgtaggctgctcctgtgtcgttgtcaaggactacggtgaagaatctgagggccttaacatagtgcaggagtatgtcaagtcgcactagatgt

SEQ ID NO: 6712 - protein, 140 aa, Zea mays; identical to SEQ ID NO: 4593
  misc_feature: Ceres CLONE 339811-F
  misc_feature (25)..(120): Pfam Name: Ribosomal_L7Ae Pfam Description: Ribosomal protein L7Ae/L30e/S12e/Gadd45 family

SEQ ID NO: 6713 - DNA, 361 bp, Zea mays
  misc_feature: Ceres CLONE 339864-F
  misc_feature: Translation starting site: 118
atcgaaatcaatcgtgttcctcgcctgcacgcctagagcccgagaccaatccagccgccgccgccgcctccgcctccgccttcgcctcgcctagtattccctccgattcagaggccgatggagtgcatcgccgagatgccccgcgcgccgctggacagcaggctgcgcaagcgtcagcgtctcggctgggacgtcggccctgccgagatgtataaggccgtgcggccgcggcacgggtgggacgtcggccccgccgagatgtatcagttaggacttagtggacaagaagttgtgaatgccatcagtgctgcagcgttgggcctttcgtcaggctgtgtttcttctcaagtcaaacaagagc

SEQ ID NO: 6714 - DNA, 506 bp, Zea mays
  misc_feature: Ceres CLONE 340003-F
  misc_feature: Encodes the peptide sequence at SEQ ID NO. 6715
acattgtccacgtctgccatcgccttgccggttcctctcgtcaagccctagctccaaccaacccgtttccatgggtgccatacgagttgcaagccttctactcgtcgctggggtaatctggctgtcgcgagcgatgttcggcgccgaggccgccggcacgacggtgttcacgctgcacaacaactgcacccacacggtctggccggccacactgtccgggaacagcgcggcggccgtcgggggcgggggcttcgagctgtcgcccggcgccaccgtctcgttcccggcgccggcgggctggtcgggccgcctgtgggcgcgcacgggctgcgtcgcgtcgtcgtcccccggccccaccggccgcctctcgtgcgccacgggcgactgcagcggcgccgcgagctgctccctgggcggggcgccgcccgtcaccctggcggagttcaccctgggcggcgccgacggcaaggacttctacgacgtgagcctggtggacgggtacaacg

SEQ ID NO: 6715 - protein, 145 aa, Zea mays
  misc_feature: Ceres CLONE 340003-F
  misc_feature (37)..(145): Pfam Name: Thaumatin Pfam Description: Thaumatin family
MGAIRVASLLLVAGVIWLSRAMFGAEAAGTTVFTLHNNCTHTVWPATLSGNSAAAVGGGGFELSPGATVSFPAPAGWSGRLWARTGCVASSSPGPTGRLSCATGDCSGAASCSLGGAPPVTLAEFTLGGADGKDFYDVSLVDGYN

SEQ ID NO: 6716 - DNA, 499 bp, Zea mays
  misc_feature: Ceres CLONE 340013-F
  misc_feature: Encodes the peptide sequence at SEQ ID NO. 6717
gtgctctctcagaggtgggctggcttctcctccccctcttaccaagtcctcctcgggttagggttccttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggcggtcgcggcggcggcggctatggtggcgggcgccgtgacggcggttatggcggcggtggcggctacggcggtcggcgcgagggtggtggccggcggctggagggactgatgtgtggg

SEQ ID NO: 6717 - protein, 137 aa, Zea mays
  misc_feature: Ceres CLONE 340013-F
  misc_feature (10)..(81): Pfam Name: RRM_1 Pfam Description: RNA recognition motif. (a.k.a. RRM, RBD, or RNP domain)
  misc_feature (48)..(133): Pfam Name: GRP Pfam Description: Glycine rich protein family
  misc_feature: SWISSPROT Homolog: EC 5.2.1.8 Peptidylprolyl isomerase
MAAADVEYRCFVGGLAWATSNESLENAFASYGEILDSKVITDRETGRSRGFGFVTFSSENSMLDAIENMNGKELDGRNITVNQAQSRGGGGGGGGYGGGRGGGGYGGGRRDGGYGGGGGYGGRREGGGRRLEGLMCG

SEQ ID NO: 6718 - DNA, 436 bp, Zea mays
  misc_feature: Ceres CLONE 340069-F
  misc_feature: Encodes the peptide sequence at SEQ ID NO. 6719
gaaaactaatcaaaagtcttcccgcttccagcgcacccccatcttgagtctcgccgccgcaagcttgtgtaaggtgtaaccctaaccctaaaacacttaccttcgcctccagcaccacgcttccatggaggggcgcggaggctaagtatagccaacctctacaccatatccccatggattgagcggattcccaaggcatgggtacaaaccctcacctgcaagagctggccgcttcggcggtggcggcttctgaaccaccaccgcgggcgcgcgtggtgcggatcctagtgcacgatgctgacgccaccgattcgtcctccagcgaggatgaggcaccgccacttcttcctcggcggaggtcgaggggtggtagcagcagcctgagcgtgaggcgccgtgttatggaaccggctggggcaagctcggccgttcggtt

SEQ ID NO: 6719 - protein, 79 aa, Zea mays
  misc_feature: Ceres CLONE 340069-F
MGTNPHLQELAASAVAASEPPPRARVVRILVHDADATDSSSSEDEAPPLLPRRRSRGGSSSLSVRRRVMEPAGASSAVR

SEQ ID NO: 6720 - DNA, 537 bp, Zea mays
  misc_feature: Ceres CLONE 340101-F
  misc_feature: Encodes the peptide sequence at SEQ ID NO. 6721
gtgctttcttagaggtgggttggcttctcctccccctccggttcgggttcgggttcgtgaggttctccggggttcggtttcgtgggtgagcggatcgagatggcggcggatgttgagtaccgctgcttcgtcggcggcctcgcctgggccacggacgaccactccctccacaacgccttcagcacctacggcgaggtcctcgagtccaagatcatcctcgatcgggagacgcagaggtccctcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacgacggtggcgggcgccgtgatggcggcggcggctacggcggtggcggcggcggctacggtggcggccggcggctacggtggtggtggcggcsccacaattcccgttcctatgccaccgcttca

SEQ ID NO: 6721 - protein, 146 aa, Zea mays
  misc_feature: Ceres CLONE 340101-F
  misc_feature (9)..(80): Pfam Name: RRM_1 Pfam Description: RNA recognition motif. (a.k.a. RRM, RBD, or RNP domain)
  misc_feature (48)..(128): Pfam Name: GRP Pfam Description: Glycine rich protein family
  misc_feature: SWISSPROT Homolog: EC 5.2.1.8 Peptidylprolyl isomerase
  misc_feature (136)..(136): Xaa is any aa, unknown, or other
MAADVEYRCFVGGLAWATDDHSLHNAFSTYGEVLESKIILDRETQRSLGFGFVTFSTEEAMRNAIEGMNGKELDGRNITVNEAQSRGGRGGGGGGYGGGRGGGGYDGGGRRDGGGGYGGGGGGYGGGRRLRWWWRXHNSRSYATAS

SEQ ID NO: 6722 - DNA, 523 bp, Zea mays
  misc_feature: Ceres CLONE 340121-F
  misc_feature: Encodes the peptide sequence at SEQ ID NO. 6723
agaattttggttggaggcgacgacgatttgtttcttgctctcgtggtttcggacttctggtctggaggtcccccagcagcccaggctccacctctccacggcagcaccaacgctccattctgttagccacagcccacgccgctgaacggccggagatcgccccccactccctctcgccggacggttgcagatcaggtctaccagatccgtctcagattaggtggcaggagaggaggaattcgggtctgaatctgatcgatatgcggcagcagcggggcggggccggggccgggaggagggcggacgacccggggctcctcaagagggccttcgacagggtgttccgcttcgtccgcctcgccgagttcgagatcttcttcgtcctcttcttcctcatcgccttcttcctcttcaaggacctcatggcacggcctcaatacaatcagctgtttgtcaagaagcctgatctagatgattcctggccttagtacccaaataacctggtatttttctttgagctgtg

SEQ ID NO: 6723 - protein, 75 aa, Zea mays
  misc_feature: Ceres CLONE 340121-F
MRQQRGGAGAGRRADDPGLLKRAFDRVFRFVRLAEFEIFFVLFFLIAFFLFKDLMARPQYNQLFVKKPDLDDSWP

SEQ ID NO: 6724 - DNA, 487 bp, Zea mays
  misc_feature: Ceres CLONE 340123-F
  misc_feature: Encodes the peptide sequence at SEQ ID NO. 6725
ataaccacagaaatccttccacaaacaactgagaagagctgcggctgcgggaaagggagaacatggtggggaagaagaggggtattatctccccgctggaccatctcgctgggctgctggaggtgcgcgtggtgaggggagtggacctcgccatccgcgacctccgatccagcgacccctacgtcgtccttcgcatcggcaaggcgcagaaagtgaagacgcgagtggtcaagaagagcatcaatccggaatggaacgaaaaactcaccctctctattgaagaccctgccgttcctattagactggaagtatttgacaaggacactttcgttgatgatgcaatgggtaacgcggaggtggacatccgcccgttagtcgagattgtgaagatgaagctccagggtgtcgctgacaaaacggtggtaaagaagctggtgcccaacagacagaactgcctagccgaggagagctcgatatacatatcgga

SEQ ID NO: 6725 - protein, 141 aa, Zea mays
  misc_feature: Ceres CLONE 340123-F
  misc_feature (19)..(98): Pfam Name: C2 Pfam Description: C2 domain
  misc_feature: SWISSPROT Homolog: EC 3.1.4.4 Phospholipase D
MVGKKRGIISPLDHLAGLLEVRVVRGVDLAIRDLRSSDPYVVLRIGKAQKVKTRVVKKSINPEWNEKLTLSIEDPAVPIRLEVFDKDTFVDDAMGNAEVDIRPLVEIVKMKLQGVADKTVVKKLVPNRQNCLAEESSIYIS

SEQ ID NO: 6726 - DNA, 468 bp, Zea mays
  misc_feature: Ceres CLONE 340161-F
  misc_feature: Encodes the peptide sequence at SEQ ID NO. 6727
gtcgaagcccacgcctacacctccatttcgtcgaaaccagttctgccgtgtttcataatctcaataatctctcgaggaggataccacctcccgaacatggtgcgtcgacgacccgccaccggggcagcccagagaccccaactcgccgccgtcggtcgcgggctgctcctcgcgtccgtcctcgcggccgctgcctcctccctcccagtagccgagtcgtcctgcccgcgagacaactcactggtgagagacataagccgaatgcagcagagcaactacgggagggaaggattctcgcatataactgtcacaggtgctcttgctcacgggacgaaggaggtggaagtgtggctacaaacatttggtccaggtcaaaggaccccaatccacaggcattcttgtgaagaggtyttcattgtcctcaaggggaaaggcacgctcttactcgggtcgagctcgctgaagtac

SEQ ID NO: 6727 - protein, 124 aa, Zea mays
  misc_feature: Ceres CLONE 340161-F
  misc_feature (39)..(124): Pfam Name: Auxin_BP Pfam Description: Auxin binding protein
MVRRRPATGAAQRPQLAAVGRGLLLASVLAAAASSLPVAESSCPRDNSLVRDISRMQQSNYGREGFSHITVTGALAHGTKEVEVWLQTFGPGQRTPIHRHSCEEVFIVLKGKGTLLLGSSSLKY

SEQ ID NO: 6728 - DNA, 458 bp, Zea mays
  misc_feature: Ceres CLONE 340186-F
  misc_feature: Encodes the peptide sequence at SEQ ID NO. 6729
  misc_feature (236)..(236): n is a, c, t, g, unknown, or other
aatgcagagcgcacactgttggatgttaggattttgtttgggacctattttctgtccgtttttaaaattaggggcgcaattacaaggaactatcgtggagttgctcatagtaacagccaggactttagcagsctccacccttgagcaatttgcagctaatttgtaatagtcaggactttagcagccaccctcacctcacccttttgtatcaggctgtcagcttgcttgcaatgcantacgaggaggagcagggcagcaggtctctccatggatgcaagccaagatgtgtgggactgggactgggagctggtcctgccagaccacaggagcttctccttgagcaatggcggcaagaatcttgatgataaagaaacagaggagcatgatytgctgcccccgtcaggagacgttgacgtgcacgacgagtgcaagggcatcggcgtcgtgctggatgagac

SEQ ID NO: 6729 - protein, 63 aa, Zea mays
  misc_feature: Ceres CLONE 340186-F
MDASQDVWDWDWELVLPDHRSFSLSNGGKNLDDKETEEHDLLPPSGDVDVHDECKGIGVVLDE

SEQ ID NO: 6730 - DNA, 400 bp, Zea mays
  misc_feature: Ceres CLONE 340193-F
  misc_feature: Encodes the peptide sequence at SEQ ID NO. 6731
  misc_feature (382)..(382): n is a, c, t, g, unknown, or other
agaccggtcctgccagtagccagttcgacacgaaacacacagcaaaaccggaacagaaagcctgtggaagagccgaggcggaagcagaactgggaaggggagaagattccgatggggactaagaaacagggaggaggcggaggagaccagaaggtcctcctctggaggctgccggaggtcacctctaaggagctcggcaagataggccccgccctcggaatcggcatcggctgcggcgccggcgcaggcatcggattcttcggtggtgcaggcttaggctatggatttcctggactcacattaggctttggagttggagctggatgtggtgtgggaattggctttggttatgggttgggcaaaggaattgcatatgatgaanagaawaaatactccaatg

SEQ ID NO: 6731 - protein, 96 aa, Zea mays
  misc_feature: Ceres CLONE 340193-F
  misc_feature (91)..(91): Xaa is any aa, unknown, or other
  misc_feature (92)..(92): Xaa is any aa, unknown, or other
MGTKKQGGGGGDQKVLLWRLPEVTSKELGKIGPALGIGIGCGAGAGIGFFGGAGLGYGFPGLTLGFGVGAGCGVGIGFGYGLGKGIAYDEXXKYSN

SEQ ID NO: 6732 - DNA, 405 bp, Zea mays
  misc_feature: Ceres CLONE 340204-F
  misc_feature: Encodes the peptide sequence at SEQ ID NO. 6733
caaaaattcgctcgtggttgcgccatccctcactctcctccgaagccatcgtccccgtcccagcctccccggactccaggggcaaaagctgcagcgtcgagatggtgaaggggcgcacggggcagcgcgtgaggctctacgtccggggcaccgtccttggatacaagcggtccaagtcgaaccagtacgagactacgtcgctggtgcagatcgagggggtgaacaccaaggaggacgtcgcgtggtactgcgggaagcggatggcctacatctacaaggccaagaccaagagcagcggcacccactaccgctgcatctggggcaaggtcgcccgcccgcatggcaactccggcgtcgtccgcgccaagttcaggtccaacctgccgccggaatccatgggccgta

SEQ ID NO: 6733 - protein, 101 aa, Zea mays
  misc_feature: Ceres CLONE 340204-F
  misc_feature (12)..(101): Pfam Name: Ribosomal_L35Ae Pfam Description: Ribosomal protein L35Ae
MVKGRTGQRVRLYVRGTVLGYKRSKSNQYETTSLVQIEGVNTKEDVAWYCGKRMAYIYKAKTKSSGTHYRCIWGKVARPHGNSGVVRAKFRSNLPPESMGR

SEQ ID NO: 6734 - DNA, 472 bp, Zea mays
  misc_feature: Ceres CLONE 340308-F
  misc_feature: Encodes the peptide sequence at SEQ ID NO. 6735
aggcagcagcaacgatgccgcagccatggttagttgtttgtataataatactctgccgttttgcacccctagctagcgctacaactcctccgccgcctatccaccacatctatttcgccctatccaccaggacttacgatgatctgtatagcgaggagcaggtcggcatacgatccccggcccacacgtgatgcaaagataatacatccatgtcgtcggcgccggggaagaagacaaggtaactctggccatagccatcgattgccttatatattatcggcttcagtaacgccaccggccattggtgcaagtttagtggtggagacttgttcttgttcaaaggtctgccggtgccgggagccaccgagctccccggtcacaatgaactatggacaactgatccagggagggcacaccgagcttaatttggcgggttsstctgggccgggaagaagtcagccatacatgcatg

SEQ ID NO: 6735 - protein, 58 aa, Zea mays
  misc_feature: Ceres CLONE 340308-F
MPQPWLVVCIIILCRFAPLASATTPPPPIHHIYFALSTRTYDDLYSEEQVGIRSPAHT

SEQ ID NO: 6736 - DNA, 438 bp, Zea mays
  misc_feature: Ceres CLONE 340326-F
  misc_feature: Encodes the peptide sequence at SEQ ID NO. 6737
atcttcacgctagtagtgtatcataatacggtcagcgctgactagcaaggagccaagcaggacataatactgaagcaggctgcggctgcggctgcagcaacaagtcaaggaggttgaaggcgaattagagagaagaggaagatgttggcggcgacggatccgatgctgtggcacaaggtggccgccgtctccggggttgccgctttggggctcggcacctacggcgcgcacatgttccgccccaagaaccccgcgtacaaagaggtttggcacacggcgtccctgtaccatctcgtccacaccgcggcgctgctcggggcgcccatcaccaagcgccccaacgttttcggagggctcctcactgctggaattgtgctcttctctggaacgtgctacaccgtggcttatcttgaagacaggaagttttcttcaccggca

SEQ ID NO: 6737 - protein, 99 aa, Zea mays
  misc_feature: Ceres CLONE 340326-F
  misc_feature (10)..(90): Pfam Name: DUF423 Pfam Description: Protein of unknown function (DUF423)
MLAATDPMLWHKVAAVSGVAALGLGTYGAHMFRPKNPAYKEVWHTASLYHLVHTAALLGAPITKRPNVFGGLLTAGIVLFSGTCYTVAYLEDRKFSSPA

SEQ ID NO: 6738 - DNA, 462 bp, Zea mays
  misc_feature: Ceres CLONE 340347-F
  misc_feature (335)..(335): n is a, c, t, g, unknown, or other
gagacacccgtgcgaaccaagcagaccacatgcaagaagcgtagtcgtcgccggaaggaaaggcgccgagcaagatgtcgtggcaggcgtacgtcgatgagcacctgatgtggcgagatcgaaggacaacatctcagcgccgccgccatcgtcggtcacgacggcagcgcttgggcgcagtccgagagcttccccgagttaaagcctgaggaggttgctggtatcataaaggactttgatgaaccyggtactcttgcaccaactggtcttttcgttggaggtacaaagtacatggtgatccaaggtgaacctggagttbtcatccgaggaaagangggcactgggggcattactactgaagaaaaccggcatgtccttgattattggtgtctacghbgagcchatgactccagggcaatgcaacatggtggtggagaggctcggcgattactgatcgagcag

SEQ ID NO: 6739 - DNA, 454 bp, Zea mays
  misc_feature: Ceres CLONE 340412-F
aacttgggtaggacaaacccttgggcctagccgcctcggcgcctgatgagtgaacgaaacgggagacgataacgagacagcaagagccaagaggtggtgagagagaggaccgaggagggaaacagagaagatgacgacgaagcgcgacaccgagtcggacggcgaawggctccaaccccgtcggtggtggcgcgactccgccgcccctagccgccgcccctgtcgtatgcctcctccgctccgccggggacttcggtggcggcgccttcgttggatccatcttcggatatggacaaggcttgatcaccaagaagggttttaagggctcattcagcaatgcagggtcctctgccaagacttttgcaattctctctggcgttcagagtttggttttgtgcttgttgcgaaggctacgtggcaaggatgacattgtcaatgctggtatagctggttg

SEQ ID NO: 6740 - DNA, 96 bp, Zea mays
  misc_feature: Ceres CLONE 340422-F
atttttcttctgacgttcaccccgagtgggcgaccgcggccgccggccggcgcgccccacgccaggtgcacagatcttcgtcgggcccttgcccgg

SEQ ID NO: 6741 - DNA, 495 bp, Zea mays
  misc_feature: Ceres CLONE 340428-F
  misc_feature: Encodes the peptide sequence at SEQ ID NO. 6742
  misc_feature (458)..(458): n is a, c, t, g, unknown, or other
tcacacaaccaagctcgatcgatctcactctcagctggtcgctcactcttgcagctccacccttcactcagtcttaggctcttagctctaggctctagctagccgcgccactccttcgtgtagccatcagccttctcatcgccaccaatggccactgcgaggtccagaccccgaccgtcgtggcggccgaggaagcgccagtggtggagaccccgccgccggccgtcgtgcccgaggagtctgcccccgccgaggccgaggctgaggctgaggctgaggctgctgctcctgctgatcccgaggagcttcccgcggccgagcagcaggcagccgccgagcccgaggccgctgctcctgctggtgccgaggagcccgcggcggccgaaccggccgctgaggcggaggctgctgctcctgctggtcccgaggagactcctgcggtcgagcaggaggcagcngccgaggaggaggctgctgctgctcctcctgctggtg

SEQ ID NO: 6742 - protein, 116 aa, Zea mays
  misc_feature: Ceres CLONE 340428-F
  misc_feature (104)..(104): Xaa is any aa, unknown, or other
MATARSRPRPSWRPRKRQWWRPRRRPSCPRSLPPPRPRLRLRLRLLLLLIPRSFPRPSSRQPPSPRPLLLLVPRSPRRPNRPLRRRLLLLLVPRRLLRSSRRQXPRRRLLLLLLLV

SEQ ID NO: 6743 - DNA, 466 bp, Zea mays
  misc_feature: Ceres CLONE 340467-F
  misc_feature: Pfam Name: LTV Pfam Description: Low temperature viability protein
aaatagattatagagtccagtttcaccacgttttcattcttcctattgtcagcatcgctctccaaatcccaaaaccctaayctatccatctcgccaccgtttaccgtcgctgccgccaatatgggagcaagaggaggaggaggaggcggccgcaaggcccgcaactttgcgaccttcgcgcctcttcccgcgcgccggcgcgccgaccccaacgaccgcgtgttcgtacgcgtcgacaacaacgactacactgtccccgggttcgccgsacgaggackccttcgacccatcccggtccgacccttccgccggcaatggaaacttcggctccgcatccggccccctcccggagcacgtccgccgcgagatcctcgagctcggcctccctgacgacggttacaactacctctcccacctccgcgagctccgtcccgccgccgccgcagcctcatccttcgtccccagc

SEQ ID NO: 6744 - DNA, 485 bp, Zea mays
  misc_feature: Ceres CLONE 340569-F
  misc_feature: Encodes the peptide sequence at SEQ ID NO. 6745
agttcatccctcacctcatctaaccaagctcccgagagcagagagctgagagagggagagaaaaagtaatccgacggaaacgacaagggcgcggcgagggcggggacgggaaggccctgggcgcggaggcgccgagcacatggcatcgtcgagggtgataccgtcgtcctcgccgtcgcacacggcctcggatctcgcgcgcctagcgcaggccgccagcaggcccggcggcgggggcagcgggccgggctccatgaacgtcgagaagctcctccgcggcatctacagcgacatgcccaccccggcgccgcccgcgtcggaacccggacgcccgatgcccccggccccggcgccggtgagcgccacgcggaagacggcggaggaggtgtggaaggagatcactggcggaggtggcagtggggaagccgtggctcccgtggcggctcacgctgtcgctcccgatggtggcgctggcacaggcggcc

SEQ ID NO: 6745 - protein, 115 aa, Zea mays
  misc_feature: Ceres CLONE 340569-F
MASSRVIPSSSPSHTASDLARLAQAASRPGGGGSGPGSMNVEKLLRGIYSDMPTPAPPASEPGRPMPPAPAPVSATRKTAEEVWKEITGGGGSGEAVAPVAAHAVAPDGGAGTGG

SEQ ID NO: 6746 - DNA, 100 bp, Zea mays
  misc_feature: Ceres CLONE 340645-F
  misc_feature: Encodes the peptide sequence at SEQ ID NO. 6747
acacgcacaccgcgacccagtccagagccagtacgtgcgaagcagcacgcacgctgctggtccgcgtagcagagacgtaggtcggccggtgcttttcagt

SEQ ID NO: 6747 - protein, 33 aa, Zea mays
  misc_feature: Ceres CLONE 340645-F
HAHRDPVQSQYVRSSTHAAGPRSRDVGRPVLFS

SEQ ID NO: 6748 - DNA, 1087 bp, Zea mays
  misc_feature: Ceres CLONE 340653
  misc_feature: Encodes the peptide sequence at SEQ ID NO. 6749
ccattccatccccctctcctctctatcatcctcggcatccgtcccgctttgcccttgtttaattccaaaggtttcattttctgcagggataacatttgtggggggtggtgagccggccggccctatagaatcctgctcctgcgccaacgcctgcgcccgcccccttttcatgttgctttccctttcctcctcctcctcctcctcctcttcttcctcctcacctcacctcctatttagccgtccgaattgcttgtcagcatcttcccagcttcttcttcttcttccaaccgcgctactctctctcgtctccgttgctcggttggattcttcttctctcttcataggaaggaaggattggctaccgagatattcctactagggctgtagtgcagccagtaccagtaccagtaccagtaccccagcagccggtgaggagaggagacggagagagcgagcggaggagggccatggaaggcgacagcttctccggcggcgccatggcgaacggcggcggcggaggcggcggcggcgggcaggtggtggacgggaagctgatccacacgttccacaggagcttcgtgcaggtgcagagcctgctggaccagaaccggatgctcatcagcgagatcaaccagaaccacgagtcccgggcgcccgacaacctcacccgcaacgtcggcctcatccgcgagctcaacaacaacatccgccgcgtcgtcggcctctacgccgacctctccgcctccttcgcgcgcaccatggaccacgcgtcctccgagggcgactcctcgggcaccggcaccggcaccggcaacggccgcgccggcgccggccacaagcgcgtccgccccgcctagctagctagcttttagtttttcttttgctgggtcttggcgtggcaatcctaggtgctgccattgccattgccactaggaggcgtatttaatttagtctttttctcttgcggttcttcttgttcgccttcttcctttgtgctcgctagctgcgacgaacgcttctgcgtcggtgattaattagtgtatggtaatttagtgacaaacagagagctgcaaaaaaaaaaaaaaaa

SEQ ID NO: 6749 - protein, 129 aa, Zea mays
  misc_feature: Ceres CLONE 340653
  misc_feature (22)..(111): Pfam Name: DUF1313 Pfam Description: Protein of unknown function (DUF1313)
MEGDSFSGGAMANGGGGGGGGGQVVDGKLIHTFHRSFVQVQSLLDQNRMLISEINQNHESRAPDNLTRNVGLIRELNNNIRRVVGLYADLSASFARTMDHASSEGDSSGTGTGTGNGRAGAGHKRVRPA

SEQ ID NO: 6750 - DNA, 529 bp, Zea mays
  misc_feature: Ceres CLONE 340658-F
  misc_feature: Encodes the peptide sequence at SEQ ID NO. 6751
agagagagagagagagagagatcggccatcagttgagtgagcgggcgagagcgagcgagcggtagtacgtgctgcgaccggagctagtgtgtgtgtgcagtgtagtgtaggtgcatgcatgcctgaccgacgatcggaggcgacggcggagtccatggagcggcaggccggggcagggagagatgagggcgaggcagcggcggcgccgcggaagggctgcatccgctcgacgcaagggccgtggacggtgcggcgccgcggccggggcggcgggctgacgacgtcgctgcggcacccgacgccccgcgagcgggagaacaaccggcagcgcgagcgccggcggcgccaggttgccgccaggatctacgccggcctgcgcgcccgcgccgggtacgcgctgcccaagcacgccgaccagaacgacgtgctccgcgcgctctgcgcagaggccggctaccacgtcgacgacgagggcaacgtcacgcgtcaccagggtgtcagcgacggcgcggcgggcccaagctgcagc

SEQ ID NO: 6751 - protein, 125 aa, Zea mays
  misc_feature: Ceres CLONE 340658-F
  misc_feature (42)..(125): Pfam Name: DUF822 Pfam Description: Plant protein of unknown function (DUF822)
MERQAGAGRDEGEAAAAPRKGCIRSTQGPWTVRRRGRGGGLTTSLRHPTPRERENNRQRERRRRQVAARIYAGLRARAGYALPKHADQNDVLRALCAEAGYHVDDEGNVTRHQGVSDGAAGPSCS

SEQ ID NO: 6752 - DNA, 542 bp, Zea mays
  misc_feature: Ceres CLONE 340675-F
  misc_feature: Encodes the peptide sequence at SEQ ID NO. 6753
agctctagggctgaaaccagcaaagccaacagaactgcacagtgtagtagttgcacataggcgtccgcgcgtcgtcctagctatggatccatatcactaccaaaccatgtatgacccacgcggcttccccatcatccacccgcagccttacctccagcacccggtggccggcgccctcggtgacagcagggtgcgcggcggcggcagtggcgcgcggcggcgtcctggcgccaagctctccacggacccgcagagcgttgcggcgcgcgagcggcggcaccgcatcagcgaccgcttccgcgtgctccgcagcctcgtccccggcggcagcaagatggacactgtgtccatgctcgagcaggccatccactacgtcaagttcctcaagacgcagatcagcctgcatcaggccgcgctgatgcagcacgaggaaggatgccatgctgagctcgccgcctattccgcggtggcggtggttggtgacaacgaggtgacactcgcgtcccatggtcgtaccggcgcatgcgacgagatgatgcagc

SEQ ID NO: 6753 - protein, 153 aa, Zea mays
  misc_feature: Ceres CLONE 340675-F
  misc_feature (55)..(102): Pfam Name: HLH Pfam Description: Helix-loop-helix DNA-binding domain
  misc_feature: The sequence is a functional homolog of SEQ ID NO 1208 in the 10/666,642 US patent application
MDPYHYQTMYDPRGFPIIHPQPYLQHPVAGALGDSRVRGGGSGARRRPGAKLSTDPQSVAARERRHRISDRFRVLRSLVPGGSKMDTVSMLEQAIHYVKFLKTQISLHQAALMQHEEGCHAELAAYSAVAVVGDNEVTLASHGRTGACDEMMQ

SEQ ID NO: 6754 - DNA, 293 bp, Zea mays
  misc_feature: Ceres CLONE 340759-F
atcacaattyactccactcatcttttctcgtttagaamctctaaaawtttccccamtcgccagtcgcagcagcacctgtagcagtcatggacgccagcgggarccggtagcaaggggaagaagggggcggccgggcgcaaggcaggcggccccaggaagaagtcggtgacgcggtccgtcaaggccgggctgcagttccccgtcggccggatcgggcgctacctcaagaagggccggtacgcgcagcgcgtgggcactggcgcccccgtctacctcgccgccgaggaacgccg

SEQ ID NO: 6755 - DNA, 501 bp, Zea mays
  misc_feature: Ceres CLONE 340811-F
  misc_feature: Encodes the peptide sequence at SEQ ID NO. 6756
aacttccacactcaccaccacggaaccctaaccaagaatccgacccggcgctagacgattcggacggaaggaagacgagaaggccccgaggcgagcgggggatcaaagaagaagatgaaggtccgtgcggcggtgaagcgcctgtgccggttctgcaaggtggtgaagcgccggggaatcgtcttcgtccaatgcacggccaacgccaagcacaagcagcgccagggcttctccaccatcgccgaagcagccgccgtctcgtgcgttcacctgcctccgccgccgccccctagcggttccgcctccgccgcagcgttcgcagaggcttcgaaggtggcgaggcaagagatgtctatgaagttcaattggcggctgggtttagctgccctgttcaagaatggagaaaaataatgtatcaggcctactaccatacgctaacattttyaagcagatgttgaatagggccagttggtatgatgatatcaagagaagtatgtagca

SEQ ID NO: 6756 - protein, 98 aa, Zea mays
  misc_feature: Ceres CLONE 340811-F
  misc_feature (1)..(38): Pfam Name: Ribosomal_L36 Pfam Description: Ribosomal protein L36
MKVRAAVKRLCRFCKVVKRRGIVFVQCTANAKHKQRQGFSTIAEAAAVSCVHLPPPPPPSGSASAAAFAEASKVARQEMSMKFNWRLGLAALFKNGEK

SEQ ID NO: 6757 - DNA, 493 bp, Zea mays
  misc_feature: Ceres CLONE 340820-F
  misc_feature: Encodes the peptide sequence at SEQ ID NO. 6758
acacaaatacagctcagagcaactcacacacaggctcctctcccccgttgcgcaacgcgctttcccccacttcacccgcctcggcgccatggctaagctcgcgctggcgctcctcctcctgctggccgtggcggcgtccgcgtcggccagcagcgggagccacctggatctcgacctgggcttcctctcctctggggaacgccggagggagtgccgcggcacggtggccgagtgcctcgccgaggagtcggatgaggagggccttgacctggccggatcccaccgccgcgcgctctacggcggcgggtacatcagctacggcgcgctgcggcgggacaacgtgccctgctcccgccgcggcgccagctactacaactgccgcccgggcggccaggccaacccctaccaccgcggctgctcccgcatcacccgctgccgcggctgaggcggctccggatccgcccgactgccgaggaaaggtctggttggtcaa

SEQ ID NO: 6758 - protein, 118 aa, Zea mays
  misc_feature: Ceres CLONE 340820-F
  misc_feature (53)..(118): Pfam Name: RALF Pfam Description: Rapid ALkalinization Factor (RALF)
MAKLALALLLLLAVAASASASSGSHLDLDLGFLSSGERRRECRGTVAECLAEESDEEGLDLAGSHRRALYGGGYISYGALRRDNVPCSRRGASYYNCRPGGQANPYHRGCSRITRCRG

SEQ ID NO: 6759 - DNA, 478 bp, Zea mays
  misc_feature: Ceres CLONE 340846-F
  misc_feature: Encodes the peptide sequence at SEQ ID NO. 6760
aatttcctccacctcccgaaccctaccggcggcgcagcagcatcacaaccaccacccgaagatggtgaagtttctgaagcccggcaaggccgtaatcctcctccagggcagattcgccggccggaaggcggtgatcgtgcgcgtgttcgaggagggcacccgcgaccgtccctatgggcactgcctcgtcgccggcctggccaagtaccccaagaaggtgatccgcaaggactccgccaagaagacggccaagaagtcccgcgtcaagtgcttcatcaagctcgtcaatttcactcacctcatgcccacccgctacaccctcgacgtcgacttcaaggacgtcgcctcgggcgggcccgacgctctctccacccgggacaagaaggtcgaggcctgcaaggccgccaaggcgcgcctcgaggagaggttcaagaccggcaagaacaggtggttctttaccaagctccgcttctaggcg

SEQ ID NO: 6760 - protein, 137 aa, Zea mays; identical to SEQ ID NO: 5495
  misc_feature: Ceres CLONE 340846-F
  misc_feature (52)..(137): Pfam Name: Ribosomal_L27e Pfam Description: Ribosomal L27e protein family
  misc_feature (7)..(40): Pfam Name: KOW Pfam Description: KOW motif

SEQ ID NO: 6761 - DNA, 509 bp, Zea mays
  misc_feature: Ceres CLONE 340849-F
  misc_feature: Encodes the peptide sequence at SEQ ID NO. 6762
aatctttgtggtcgtggtcctcccgtcgtcgtcgactcgtcgtcgtcggtgttgctccgatgggcaaggactcgaagccgaaggacgccraggggaagggcaagcaggcggccggcacctctggcggcgacgacggcggcggcaagggaggcaagggcaagggcaagggcaagggcggcaagtccgctgacggactcggcacttgcacctacgtcaaagctaggcacgtattgtgtgagaagcaggggaagatcaatgaagcttataagaagttgcaggatggatgcctgaataatggggacaaagttcctcctgctgagtttgctaaggtagcacaagagtattctgaatgcccatcagggaagaaaggtggagatcttggttggttcccgcgtggcaagatggctggtcctttccaggaggttgctttcaacacacctgagggaactgttagcgcaccattcaagtccacgcacgggtatcactttatcctctgcgaaggaaggaag

SEQ ID NO: 6762 - protein, 150 aa, Zea mays
  misc_feature: Ceres CLONE 340849-F
  misc_feature (56)..(148): Pfam Name: Rotamase Pfam Description: PPIC-type PPIASE domain
  misc_feature: SWISSPROT Homolog: EC 5.2.1.8 Peptidylprolyl isomerase
  misc_feature (11)..(11): Xaa is any aa, unknown, or other
MGKDSKPKDAXGKGKQAAGTSGGDDGGGKGGKGKGKGKGGKSADGLGTCTYVKARHVLCEKQGKINEAYKKLQDGCLNNGDKVPPAEFAKVAQEYSECPSGKKGGDLGWFPRGKMAGPFQEVAFNTPEGTVSAPFKSTHGYHFILCEGRK

SEQ ID NO: 6763 - DNA, 543 bp, Zea mays
  misc_feature: Ceres CLONE 340855-F
  misc_feature: Encodes the peptide sequence at SEQ ID NO. 6764
agtttgccgctctgtgagcctgctgccgtcttcttccgccgccgccgccgtcgtcgtcttcgtccgtagatcagagagcggggaggaagaaaaagcgatcgatggcgtccaamtacgtggacacgccgggcgaggagggacggttccacggccctcacagccacagcaccagcacgaccccgacgggcggcgcggcggcggcggcggcatcgccgcgcaacttccggcgcagcttctcctccgcgtcctccgcgggccacagccacggcggcggcggcggcggggccaagtgcgtgtgcgcgcccgcgacccacgccgggtcgttcaagtgccggctccaccgcaccaactcccagggccacggccacggccacccgcacccgtccccgccggcctcccccgccgcgccggcgcagggcgtctcgtcttccgcttcctcccgcaccgtcgaggccctgtgagtgtccgaggccaaagacgggcgaggcgtggggaaagtgagaagatgatgggatatacttgtcgtgtcagtctgtcagaagg

SEQ ID NO: 6764 - protein, 119 aa, Zea mays
  misc_feature: Ceres CLONE 340855-F
  misc_feature (4)..(4): Xaa is any aa, unknown, or other
MASXYVDTPGEEGRFHGPHSHSTSTTPTGGAAAAAASPRNFRRSFSSASSAGHSHGGGGGGAKCVCAPATHAGSFKCRLHRTNSQGHGHGHPHPSPPASPAAPAQGVSSSASSRTVEAL

SEQ ID NO: 6765 - DNA, 106 bp, Zea mays
  misc_feature: Ceres CLONE 340896-F
atagtcgaragctacgaacactcgccgccactcaccagcaaattcccaagccgccccttgcccccakctctttgcgcgccccatttgatcgattcctgatggcgcc

SEQ ID NO: 6766 - DNA, 404 bp, Zea mays
  misc_feature: Ceres CLONE 341029-F
  misc_feature: Encodes the peptide sequence at SEQ ID NO. 6767
gccatcaccaatcagtcagtcacagctcacagcaaacaccgcgaagccgcccccgctcccaaacccgaccgagcaaagcgcaaagccscccaaccgcggatcaatccgcagcatcgatggcgcccaaggcggagaaaaagccggcggcgaagaagcccgcggaggaggagcccgcgaccgagaaggcggagaaggctccggcagggaagaagccgaaggcggagaaacgcctccccgcgggcaagtccggcgccggcgagggcaagaagggcaagaagaaagccaagaagagcgtggagacctacaagatctacatcttcaaggtgctcaagcaggtgcaccccgacatcggcatctcgtccaaggccatgtccatcatgaattccttcatcaacgacatcttg

SEQ ID NO: 6767 - protein, 96 aa, Zea mays
  misc_feature: Ceres CLONE 341029-F
MAPKAEKKPAAKKPAEEEPATEKAEKAPAGKKPKAEKRLPAGKSGAGEGKKGKKKAKKSVETYKIYIFKVLKQVHPDIGISSKAMSIMNSFINDIL

SEQ ID NO: 6768 - DNA, 431 bp, Zea mays
  misc_feature: Ceres CLONE 341115-F
  misc_feature: Encodes the peptide sequence at SEQ ID NO. 6769
cacagactcagactcaggctctaggaggagtgatgagctctgcagccagtgacccctgtcggcggcggtagcttaaattggccacsatgtcgccacgatccatcggactcctctgcaaataaagccatcgggggagtgactgactgagtcagtgagtgggtgtgaggagagctttgaggggaggggagctagctagctactgcctactggaggagggcttcctccgacgccggacatgggggaggtgaagcacctgtgcctggccaagttcaaggagggcgtcgtggtggacgacgtgctcaagggcatgaccgacctcgccgccgggatggacacggtcaagtctttcgagtggggccaggacgtgctgaaccaggagatgctgacgcagggcttcacgcacgtcttctcgctcaccttcgcatccgccg

SEQ ID NO: 6769 - protein, 65 aa, Zea mays
  misc_feature: Ceres CLONE 341115-F
MGEVKHLCLAKFKEGVVVDDVLKGMTDLAAGMDTVKSFEWGQDVLNQEMLTQGFTHVFSLTFASA

SEQ ID NO: 6770 - DNA, 385 bp, Zea mays
  misc_feature: Ceres CLONE 341138-F
  misc_feature: Encodes the peptide sequence at SEQ ID NO. 6771
acacccacacagcaagccagcagagcagaaagcagccgcagccccagcccccacaagacgaggcaacaatggcgctagaagcagccaccgccccccgcgcactcctcgccgcgtgcctcgtcctgctggtcctcggcggcggcaccggcccgtcgtcggtgctgcgcggcgccggggcgcaggccggcgggcagtgcctgccgcagctgaaccgcctcctggcgtgccgcgcgtacctggtgcccggcgcgccggaccccagcgcggactgctgcagcgcgctgagcgccgtgtcgcacgagtgcgcctgcagcaccatgggcatcatcaacagcctgcccggccggtgccacctcgcccaagccaactgctccgcttgaagcag

SEQ ID NO: 6771 - protein, 103 aa, Zea mays; identical to SEQ ID NO: 6200
  misc_feature: Ceres CLONE 341138-F
  misc_feature (43)..(101): Pfam Name: Tryp_alpha_amyl Pfam Description: Protease inhibitor/seed storage/LTP family

SEQ ID NO: 6772 - DNA, 508 bp, Zea mays
  misc_feature: Ceres CLONE 341163-F
  misc_feature: Encodes the peptide sequence at SEQ ID NO. 6773
atacggcataccacactagagccgccgccgccgccgtttcgcgcaccgtaccctagccctcgtcagcggcggcttcgagctcatccagccatgacgttcaagcggaggaatggcggacgcaacaagcacgggcgcggccacgtcaagtacatccgctgctccaactgcgccaagtgctgccccaaggataaggctatcaagcggttcttggtgaggaacattgttgagcaggctgccgtgagagatgtgcaggaggcctgtgtacatgatggatatgttctacccaaattgtatgcaaaggttcatcactgtgtctcatgtgcaatccatgcgcacattgtccgggtccgctctcgtgagaacaggaggaaccgtgagcccccgcagcgcttcagacgccgggatgatggcccaaggcctggtcagggcccgccgcgcccaggcggtgcagctcctgcagctgcagctgctgctgctcctcgtacctaagttctggaattagtttcgg

SEQ ID NO: 6773 - protein, 132 aa, Zea mays
  misc_feature: Ceres CLONE 341163-F
  misc_feature (1)..(114): Pfam Name: Ribosomal_S26e Pfam Description: Ribosomal protein S26e
MTFKRRNGGRNKHGRGHVKYIRCSNCAKCCPKDKAIKRFLVRNIVEQAAVRDVQEACVHDGYVLPKLYAKVHHCVSCAIHAHIVRVRSRENRRNREPPQRFRRRDDGPRPGQGPPRPGGAAPAAAAAAAPRT

SEQ ID NO: 6774 - DNA, 490 bp, Zea mays
  misc_feature: Ceres CLONE 341237-F
  misc_feature: Encodes the peptide sequence at SEQ ID NO. 6775
agcctccgcccatacacacacagccccatcccgccgccgcaggcgagaaccagcgccaccttaggttagggcggccgccgccggagaagtgcgcggttgccaagatgcagatcttcgtgaagaccctgacggggaagaccatcacgctggaggtggagtcctcggacaccatcgacaacgtgaaggccaagatccaggacaaggagggcatcccgccggaccagcagcgcctcatcttcgccggcaagcagctcgaggatggccgcaccctcgccgactacaacatccagaaggagtcgacgctgcacctggtgctccgcctcaggggaggcgccaagaagcgcaagaagaagacgtacaccaagcccaagaagatcaagcacaagcacaagaaggtgaagctcgccgtsctccagttctacaaggttgacgacgccaccggcaaggtcacccgcctccgcaaggagtgcccaacgccgagtgcggcgcg

SEQ ID NO: 6775 - protein, 128 aa, Zea mays
  misc_feature: Ceres CLONE 341237-F
  misc_feature (6)..(74): Pfam Name: ubiquitin Pfam Description: Ubiquitin family
  misc_feature: SWISSPROT Homolog: EC 3.1.2.15 Ubiquitin thiolesterase
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDDATGKVTRLRKECPTPSAA

SEQ ID NO: 6776 - DNA, 390 bp, Zea mays
  misc_feature: Ceres CLONE 341241-F
  misc_feature: Encodes the peptide sequence at SEQ ID NO. 6777
  misc_feature (258)..(258): n is a, c, t, g, unknown, or other
agttctctcgtgaccgccttccctcctctcctgcgtcccaactgggcaattccccaaacctaactaacctttgccaccgcgggagcaccatgggtggccagatgccggacgccgacgggaaggcccgctcggcggactcctcgtcctcttacgggtacacgccgtcggcgccgccgcagcaccagtacggcacctttggccccccatccggagcctccggggagtttccgcagccggcggtcgggttcccccagccgncgccgccgcctgggttgcagcactacccgcagcctccgccggcgtcgtatgccgtctacccacccccgcagcaaccctactcgaccgccgcgccgtactacgcccaaggctaccagatcgctcaaggttata

SEQ ID NO: 6777 - protein, 100 aa, Zea mays
  misc_feature: Ceres CLONE 341241-F
  misc_feature (57)..(57): Xaa is any aa, unknown, or other
MGGQMPDADGKARSADSSSSYGYTPSAPPQHQYGTFGPPSGASGEFPQPAVGFPQPXPPPGLQHYPQPPPASYAVYPPPQQPYSTAAPYYAQGYQIAQGY

SEQ ID NO: 6778 - DNA, 470 bp, Zea mays
  misc_feature: Ceres CLONE 341417-F
  misc_feature: Encodes the peptide sequence at SEQ ID NO. 6779
agtttgccgctctgtgagcctgctgccgtcttcttccgccgccgccgccgtcgtcgtcttcgtccgtagatcagagagcggggaggaagaaaaagcgatcgatggcgtccaactacgtggacacgccgggcgaggagggacggttccacggccctcacagccacagcaccagcacgaccccgacgggcggcgcggcggcggcggcggcatcgccgcgcaacttccggcgcagcttctcctccgcgtcctccgcgggccacagccacggcggcggcggcggcggggccaagtgcgtgtgcgcgcccgcgacccacgccgggtcgttcaagtgccggctccaccgcaccaactcccagggccacggccacggccacccgcacccgtccccgccggcctcccccgccgcgccggcgcagggcgtctcgtcttccgcttcctcccgcaccgtcgaggcctgtgagtgtccgagg

SEQ ID NO: 6779 - protein, 123 aa, Zea mays
  misc_feature: Ceres CLONE 341417-F
MASNYVDTPGEEGRFHGPHSHSTSTTPTGGAAAAAASPRNFRRSFSSASSAGHSHGGGGGGAKCVCAPATHAGSFKCRLHRTNSQGHGHGHPHPSPPASPAAPAQGVSSSASSRTVEACECPR

SEQ ID NO: 6780 - DNA, 489 bp, Zea mays
  misc_feature: Ceres CLONE 341493-F
  misc_feature: Encodes the peptide sequence at SEQ ID NO. 6781
aacttgggtaggacaaacccttgggcctagccgcctcggcgcctgatgagtgaacgaaacgggagacgataacgagacagcaagagccaagaggtggtgagagagaggaccgaggagggaaacagagaagatgacgacgaagcgcgacaccgagtcggacggcgaaggctccaaccccgtcggtggtggcgcgactccgccgcccctagccgccgcccctgtcgtatgcctcctccgctccgccggggacttcggtggcggcgccttcgttggatccatcttcggatatggacaaggcttgatcaccaagaagggttttaagggctcattcagcaatgcagggtcctctgccaagacttttgcaattctctctggcgttcagagtttggttttgtgcttgtgcgaaggctacgtggcaaggatgacattgtcaatgctggtatagctggttgttgtactggcctcgcttttgggctttccaggggcgcc

SEQ ID NO: 6781 - protein, 104 aa, Zea mays
  misc_feature: Ceres CLONE 341493-F
MTTKRDTESDGEGSNPVGGGATPPPLAAAPVVCLLRSAGDFGGGAFVGSIFGYGQGLITKKGFKGSFSNAGSSAKTFAILSGVQSLVLCLCEGYVARMTLSMLV

SEQ ID NO: 6782 - DNA, 391 bp, Zea mays
  misc_feature: Ceres CLONE 341506-F
  misc_feature: Encodes the peptide sequence at SEQ ID NO. 6783
acctaaacctcctcactcctcagactcctctccgcacacaccctccctacctcgccgtcgccgtcgcatctgccatgggggcgtacaagtacgtctcggagttatggagaaggaagcaatccgacgtgatgcggttcgttcaacgcgtgcgctgttgggagtacaggcagcagccggccatcgtccgcctcacaaggcccacccgccccgacaaggcccgccgcctcggcttcaaggccaagcaggggtatgttgtttaccgcgtccgtgtgaggcgtggtggcaggaagaggcctgtgccgaagggtattgtctatggcaagcccaagcaccagggtatcacccagctcaagttccagaggaacaagagatctgttgctgaggaacgggc

SEQ ID NO: 6783 - protein, 105 aa, Zea mays
  misc_feature: Ceres CLONE 341506-F
  misc_feature (2)..(105): Pfam Name: Ribosomal_L15e Pfam Description: Ribosomal L15
MGAYKYVSELWRRKQSDVMRFVQRVRCWEYRQQPAIVRLTRPTRPDKARRLGFKAKQGYVVYRVRVRRGGRKRPVPKGIVYGKPKHQGITQLKFQRNKRSVAEER

SEQ ID NO: 6784 - DNA, 469 bp, Zea mays
  misc_feature: Ceres CLONE 341509-F
  misc_feature: Encodes the peptide sequence at SEQ ID NO. 6785
acacaaccaagctcgatcgatctcactctcagctggtcgctcactcttacagctccacccttcactcagtcttaggctcttagctctaggctctagctagccgcgccactccttcgtgtagccatcagccttctcatcgccaccaatggccactgcgaggtccagaccccgaccgtcgtggcggccgaggaagcgccagtggtggagaccccgccgccggccgtcgtgcccgaggagtctgcccccgccgaggccgaggctgaggctgaggctgaggctgctgctcctgctgatcccgaggagcttcccgcggccgagcagcaggcagccgccgagcccgaggccgctgctcctgctggtgccgaggagcccgcggcggccgaaccggccgctgaggcggaggctgctgctcctgctggtcccgaggagactcctgcggtcgagcaggaggcagccgccgaggaggagg

SEQ ID NO: 6785 - protein, 108 aa, Zea mays
  misc_feature: Ceres CLONE 341509-F
MATARSRPRPSWRPRKRQWWRPRRRPSCPRSLPPPRPRLRLRLRLLLLLIPRSFPRPSSRQPPSPRPLLLLVPRSPRRPNRPLRRRLLLLLVPRRLLRSSRRQPPRRR

SEQ ID NO: 6786 - DNA, 532 bp, Zea mays
  misc_feature: Ceres CLONE 341587-F
  misc_feature: Encodes the peptide sequence at SEQ ID NO. 6787
  misc_feature (333)..(333): n is a, c, t, g, unknown, or other
acacaggaaaagaaagggcatatcgaggaggtttttagggtggtggtggtgttgtgaggagctgctgccgctgctctccagtctccaccgatggcgatcaagaacatgacggtggcggcgacgacgcggtcgctggacgcggacatgacggtggacgagttcaaggagtggctgcggcggttcgacacggaccaggacgggcgcatcagccgcgacgagctgcggcgcgccctgcgtgccatccgctcccggttcacggggtggaggagcaggcagggcatcagttacgccgacgctgacggcgacggctacatcgacgacagcgaggtcganggcctcatcgagttcgcgcagaagaacctcggcctcaagatcgtcgcctactgatctcacatggggcgcggcgcgcggcggtcggggggtgggacgcactagctcgccatgagctagctatagcgacaatgcaactcaccatcactctctccggctaaaataagagctgcttgatytatcatcgcttgtctgttaaaaa

SEQ ID NO: 6787 - protein, 98 aa, Zea mays
  misc_feature: Ceres CLONE 341587-F
  misc_feature (23)..(51): Pfam Name: efhand Pfam Description: EF hand
  misc_feature (81)..(81): Xaa is any aa, unknown, or other
MAIKNMTVAATTRSLDADMTVDEFKEWLRRFDTDQDGRISRDELRRALRAIRSRFTGWRSRQGISYADADGDGYIDDSEVXGLIEFAQKNLGLKIVAY

SEQ ID NO: 6788 - DNA, 431 bp, Zea mays
  misc_feature: Ceres CLONE 341617-F
  misc_feature: Encodes the peptide sequence at SEQ ID NO. 6789
aaagaaaacagtcgtctccagtttccatgcagagcagaaaagatcagctagcgagagaagcaatggcgtcggctcctgcgttctgcgtcgcgctgctgctggcttccgtcgctgccgtccaagcggtgccgccccaggccggcacgtcgtccacctgcagcactgacctcctccgcctcctcccctgcctgcccttcatcgagggcaccgccaccgtgccagcggacacctgttgcgccaacctgggcagcatggtgcacgacgagccgcagtgcctctgccaggccctcagcaaccccagcacggcccccgtcgccgtcaacatgacgcgcgtgatggccatgcctcggctctgccgcctcgacctcccgcccgccaccggcgcctgcgcagttgcgggtcttcttccccatggaccatcaccgccgctg

SEQ ID NO: 6789 - protein, 135 aa, Zea mays
  misc_feature: Ceres CLONE 341617-F
  misc_feature (44)..(121): Pfam Name: Tryp_alpha_amyl Pfam Description: Protease inhibitor/seed storage/LTP family
MQSRKDQLAREAMASAPAFCVALLLASVAAVQAVPPQAGTSSTCSTDLLRLLPCLPFIEGTATVPADTCCANLGSMVHDEPQCLCQALSNPSTAPVAVNMTRVMAMPRLCRLDLPPATGACAVAGLLPHGPSPPL

SEQ ID NO: 6790 - DNA, 443 bp, Zea mays
  misc_feature: Ceres CLONE 341635-F
  misc_feature: Encodes the peptide sequence at SEQ ID NO. 6791
gatctaggtctcgtctagacgaaaagactcatcttctctggtactctggttacggcagaacggtcggatctcccccaccgatggccgcctcccagtcagccacgctcctccttctcgccgtcgtcctcgccgccgtcgcaccaggcccctccagcgcgcgccacgtcatcaatttcgccccttcccgcgccgtcaaccccgcgtccctcgcttgggaccctacggcgcagcacttcgtcgtcgcaggcggcggtgatgccgtcctttgcgtctccgacgctggggtcaccgagtcgatcgtctcctctggcgcctcctccgtcgccgtcgacgaccgccgacgccgcctgctcgtcgcttccccgggatccgtctccgccttcgacctccggtccccgcgcccgcaccgcctcatcctctccacgccggtcccggaccccgcc

SEQ ID NO: 6791 - protein, 121 aa, Zea mays
  misc_feature: Ceres CLONE 341635-F
MAASQSATLLLLAVVLAAVAPGPSSARHVINFAPSRAVNPASLAWDPTAQHFVVAGGGDAVLCVSDAGVTESIVSSGASSVAVDDRRRRLLVASPGSVSAFDLRSPRPHRLILSTPVPDPA

SEQ ID NO: 6792 - DNA, 486 bp, Zea mays
  misc_feature: Ceres CLONE 341690-F
  misc_feature: Encodes the peptide sequence at SEQ ID NO. 6793
agcagcctcccgaatccccaaagcctccgacccccttcctctctccctccgccgccgctgcgcacgcagggaacaagcgacatgggcgtctacaccttcgtgtgccgcaacaacggcggcgagtggaccgccaagcagcactccggcgagatcgaggcttccgccgctaccccatacgagctgcagcgccgcctcgtcgccgctgcctccgcggccgactctgcctacggcgtccagtcgtccttctccatggtcacccccagctccgccgtgttccaggtgatcgtcggtgctgttggtggtggtgcaatgatggtgagcggaggtggcggcggtgctgctgcatctggtggtgctgctgcgaggctcccaaggaggagaagaaggaagatkgwgaaggaagagagcgacgacgacatgggattctccctgttcgactagagttgtgtgtgtcatctggatctcagaagtggtggtttggtcctg

SEQ ID NO: 6793 - protein, 119 aa, Zea mays
  misc_feature: Ceres CLONE 341690-F
  misc_feature (25)..(118): Pfam Name: Ribosomal_60s Pfam Description: 60s Acidic ribosomal protein
  misc_feature (104)..(104): Xaa is any aa, unknown, or other
  misc_feature (105)..(105): Xaa is any aa, unknown, or other
MGVYTFVCRNNGGEWTAKQHSGEIEASAATPYELQRRLVAAASAADSAYGVQSSFSMVTPSSAVFQVIVGAVGGGAMMVSGGGGGAAASGGAAARLPRRRRRKXXKEESDDDMGFSLFD

SEQ ID NO: 6794 - DNA, 406 bp, Zea mays
  misc_feature: Ceres CLONE 341704-F
  misc_feature: Encodes the peptide sequence at SEQ ID NO. 6795
gatctaggtctcgtctagacgaaaagactcatcttctctggtactctggttacggcagaacggtcggatctcccccaccgatggccgcctcccagtcagccacgctcctccttctcgccgtcgtcctcgccgccgtcgcaccaggcccctccagcgcgcgccacgtcatcaatttcgccccttcccgcgccgtcaaccccgcgtccctcgcttgggaccctacggcgcagcacttcgtcgtcgcaggcggcggtgatgccgtcctttgcgtctccgacgctggggtcaccgagtcgatcgtctcctctggcgcctcctccgtcgccgtcgacgaccgccgacgccgcctgctcgtcgcttccccgggatccgtctccgccttcgacctccggtccccgcgcccgca

SEQ ID NO: 6795 - protein, 108 aa, Zea mays
  misc_feature: Ceres CLONE 341704-F
MAASQSATLLLLAVVLAAVAPGPSSARHVINFAPSRAVNPASLAWDPTAQHFVVAGGGDAVLCVSDAGVTESIVSSGASSVAVDDRRRRLLVASPGSVSAFDLRSPRP

SEQ ID NO: 6796 - DNA, 495 bp, Zea mays
  misc_feature: Ceres CLONE 341937-F
  misc_feature: Encodes the peptide sequence at SEQ ID NO. 6797
cacaaagcacaaacaacgccactcctgcactctcactcgattcacctaccagcaactcgccacttcctccgtgagaaactgagaaatggcaccgcctcacagtcacagaagcttccgcggctggcagaacgcgagccacgtcgcgcttgtgcttgtgctggtgtccgtgctgttcctgagcaaggcacgtccctccgcgggcgccaggagcctgctggagctgtacaagccgccggccagcgcgctcctcacgtaccacaacggcgccgtgctgcagggccgcatcccggtgaccatcctctggtacggccgcttcacgccggcgcagaaggccgtggtcacgacttcctccagtcgctcaccaccaccgccacctcgccgacggcgccgcgtccccgtccgtgtcgcagtggtggggcaccatcgaccagctgtacctgtccaaggcgcggagcggcggcggcagcgacgaccggcagcgcgcaggtggcgctc

SEQ ID NO: 6797 - protein, 136 aa, Zea mays
  misc_feature: Ceres CLONE 341937-F
MAPPHSHRSFRGWQNASHVALVLVLVSVLFLSKARPSAGARSLLELYKPPASALLTYHNGAVLQGRIPVTILWYGRFTPAQKAVVTTSSSRSPPPPPRRRRRVPVRVAVVGHHRPAVPVQGAERRRQRRPAARRWR

SEQ ID NO: 6798 - DNA, 209 bp, Zea mays
  misc_feature: Ceres CLONE 342170-F
  misc_feature: Encodes the peptide sequence at SEQ ID NO. 6799
acgaaacccacagcaaaaccggaacagaaagccttggaagcctaggcggaagcagaactgggaaggggagaagattctgatggggactaagaaacagggaggaggcggaggaaaccagaaggtcctcctctggaggctgccggtggtcacctctaaggagctcggcaagataggccccgccctcggaatcggcatcggctgcggcgccg

SEQ ID NO: 6799 - protein, 43 aa, Zea mays
  misc_feature: Ceres CLONE 342170-F
MGTKKQGGGGGNQKVLLWRLPVVTSKELGKIGPALGIGIGCGA

SEQ ID NO: 6800 - DNA, 473 bp, Zea mays
  misc_feature: Ceres CLONE 342248-F
  misc_feature: Translation starting site: 83
  misc_feature: SWISSPROT Homolog: EC 3.4.21.97 Assemblin
aagacgccgtcgccgctcttgttgtttccgatcccaaaccccaaacacgctccaccggcacctccgctcccacaccacaccgatggcccgcacgaagcagacggcgcgcaagtccaccggaggcaaggcgccgcggaagcagctggcgaccaaggcagcgcgcaagtcggccccggcaaccggcggcgtgaagaagccgcaccgcttccgcccgggcaccgtggcgctccgcgagatccgcaagtaccagaagagcacggagctgctcatccgcaagctccccttccagcgcctggtccgcgagatcgcgcaggacttcaagaccgacctccgcttccagtcctccgccgtcgccgcgctgcaggaggccgcggaggcctacctcgtcggcctcttcgaggacaccaacctctgcgccatccacgccaagcgcgtcaccatcatgcccaaggacattcagctcgcccgccgca

SEQ ID NO: 6801 - DNA, 408 bp, Zea mays
  misc_feature: Ceres CLONE 342277-F
  misc_feature: Encodes the peptide sequence at SEQ ID NO. 6802
  misc_feature (393)..(393): n is a, c, t, g, unknown, or other
agggcctgatccgtttcgtagttttttttcctcggtaatccagccgtttcccctttccccagagattcgcatattctcgcgatgggagcggaggaagcagagggtactcccccgccgctgcccgccaccggsagcccgcaaccacggcaagggcgcassaatatctgcagcacaattcctctcctggaagcagcgcaagtaggatgcagaggtagccgtaagaaagctgaagcagctcagaagcgagctgatgatatcgcttcgggagcggtgcagatgaacggccgcgagctgttccaacaagagccctgggtgtttgacaaccacatttactgagatcgtgtcgggctactgttcctgcattagtccaagctccagcgttggtttcatttngtactgctatatcag

SEQ ID NO: 6802 - protein, 84 aa, Zea mays
  misc_feature: Ceres CLONE 342277-F
  misc_feature (26)..(26): Xaa is any aa, unknown, or other
MGAEEAEGTPPPLPATGSPQPRQGRXNICSTIPLLEAAQVGCRGSRKKAEAAQKRADDIASGAVQMNGRELFQQEPWVFDNHIY

SEQ ID NO: 6803 - DNA, 334 bp, Zea mays
  misc_feature: Ceres CLONE 342281-F
  misc_feature: Translation starting site: 131
  misc_feature (88)..(88): n is a, c, t, g, unknown, or other
  misc_feature (115)..(115): n is a, c, t, g, unknown, or other
ctgttctctcactcctgtttccccgccgccgcctccaagcgcccccgcgagccagctccggcgaagtcgacagcaccaagcatggcgnacacgaaggcgtcacccgcgstssacncgcacgcgcaagttcatgaccaaccgcctcctctcccgcaagcagttcgtgctcgaggttctccaccccggccgcgccaacgtctctaaggcggasstcaaggagaggctggctaagatgtacgtaggtgaaggatcccaactgcatctgcgtcttcaagttccgcacccacttcggaggcggcaagtctaccggattcggtctcatctacgacaacgt

SEQ ID NO: 6804 - DNA, 426 bp, Zea mays
  misc_feature: Ceres CLONE 342301-F
  misc_feature: Encodes the peptide sequence at SEQ ID NO. 6805
  misc_feature (80)..(80): n is a, c, t, g, unknown, or other
  misc_feature (109)..(109): n is a, c, t, g, unknown, or other
atcacaattcactccactcatcttttctcgtttagaacctctaaaatttcccccactcgccagtcgcagcagcacctgtnagcagtcatggacgccagcggasscggtnagcaaggggaagaagggggcggccgggcgcaaggtcaggctggccccaggaagaagtcggtgacgcggtccgtcaaggccgggctgcagttccccgtbmggccggatcgggcgctacctcaagahgggccggtacgcvscvscgtgggcactggcgcccccgtctacctcgccgccgtcctggagtacctcgccgccgaggttctggagttggcagggaacgcggcgaaagacaacaagaagacgcgcatcatcccgcgccacgtgctcctggcgatccgcaacgacgaggagctcgggaagctgctggccggcgtc

SEQ ID NO: 6805 - protein, 113 aa, Zea mays
  misc_feature: Ceres CLONE 342301-F
  misc_feature (30)..(103): Pfam Name: Histone Pfam Description: Core histone H2A/H2B/H3/H4
  misc_feature (6)..(6): Xaa is any aa, unknown, or other
  misc_feature (8)..(8): Xaa is any aa, unknown, or other
  misc_feature (49)..(49): Xaa is any aa, unknown, or other
  misc_feature (54)..(54): Xaa is any aa, unknown, or other
  misc_feature (55)..(55): Xaa is any aa, unknown, or other
MDASGXGXQGEEGGGRAQGQAGPRKKSVTRSVKAGLQFPVRPDRALPQXGPVRXXVGTGAPVYLAAVLEYLAAEVLELAGNAAKDNKKTRIIPRHVLLAIRNDEELGKLLAGV

SEQ ID NO: 6806 - DNA, 202 bp, Zea mays
  misc_feature: Ceres CLONE 342308-F
  misc_feature: Encodes the peptide sequence at SEQ ID NO. 6807
  misc_feature (57)..(57): n is a, c, t, g, unknown, or other
aaaaaggccacacacagtcgcactcgcacagccgccaccaccacctggtccacgtcnccggcggaatgtgggcgcacctggccgtcgcgctgttcatggcgttacgtggcctcccccggcccgcggctccgacgtgccttcgttcccgctgtcgcaggcgcagtccccgtccaactcctcgtctccgtccaacgccgcctcg

SEQ ID NO: 6807 - protein, 67 aa, Zea mays
  misc_feature: Ceres CLONE 342308-F
  misc_feature (19)..(19): Xaa is any aa, unknown, or other
KRPHTVALAQPPPPPGPRXRRNVGAPGRRAVHGVTWPPPARGSDVPSFPLSQAQSPSNSSSPSNAAS

SEQ ID NO: 6808 - DNA, 524 bp, Zea mays
  misc_feature: Ceres CLONE 342311-F
  misc_feature: Encodes the peptide sequence at SEQ ID NO. 6809
gaagcatcacacactaatcaacaagcaggaccagctagctagctcctctcactgctatcacccgcccagccatctcgctgaaagagaaaagcgcmsscatgaagactactagctcgggcattgcagtcgtcctactggtggccatgctggcagtccattccgcgttggccgacatctcgtgctccgacgtgctcaacgacctgtcgccgtgcctgcccttcctgcagggcaaggcagccaaacccagcgagagcaacaaccagtgctgcgacggcgtgagggccctgtacgcggcggcggacaccaggcccgacaggcaggccacgtgccggtgcctcaaggcggcctacgttcaggtccacgctgtgctctccgcggcgcaggagctgcccggcgactgcggcctctcgctgtcctacaacatcacccccgacatcgactgcgacaagatcgaatgaagggatactgttcccttaccagaatccatacgacgggatggtgatgttcagtgccctgctagcagt

SEQ ID NO: 6809 - protein, 119 aa, Zea mays; identical to SEQ ID NO: 566
  misc_feature: Ceres CLONE 342311-F
  misc_feature (28)..(115): Pfam Name: Tryp_alpha_amyl Pfam Description: Protease inhibitor/seed storage/LTP family

SEQ ID NO: 6810 - DNA, 418 bp, Zea mays
  misc_feature: Ceres CLONE 342320-F
  misc_feature (200)..(200): n is a, c, t, g, unknown, or other
  misc_feature (242)..(242): n is a, c, t, g, unknown, or other
atcacaattcacagcgctcaagttctcgcgcccacagccaaatttttctccactcaatcgcggcataagctgcactgcvscatggacgccagcggasscggtagcaaggcgaagaagggggcggctggkcgcaaggytggcggccccaggtaagwrgtcggtgtbsgcggtccgtcaaggccgggctgcagttccccgtnggccggatcgggcgctacctcaagamggggcggtacssrcancgtgggcaccggcgcccccgtctatctcgccgccgtgcttgagtacctcgccgccgagtgctggagctggccgggaacgcggcgaaggacaacaagaagacgcgcatcgtcccgcgacacttgctcctggcgattcgtaacgacgttgagctcggcaagctgctgtctggcgtcac

SEQ ID NO: 6811 - DNA, 476 bp, Zea mays
  misc_feature: Ceres CLONE 342412-F
  misc_feature: Encodes the peptide sequence at SEQ ID NO. 6812
agawacrgatgtctccgcccgcacatccacttcacaaacgaaaacccgcagcaaacgctagcagcggcggcgccggcagttggtagccgcgaccgagacacggcgggtgacctgccccgccgcagtcggggtgtatgtattaccaccgccagaattccaggagacgaggaggcgccgatccgtagcggcgatatcgtggagccgctggtctcacgccgcaccgagacaatggcagaccagttagggtcttacactattagatcccatggaatgatattggcaaggttgcacatgtatgactggataatacttctcctccttgctgtcatagacgggctgttgaatataattgaaccatttcaccgttttgttgggaaagacatgatgactgacttgagatatcctatgaagggcaatacagtgccattttgggctgttccactgattggaattatactgccttggaccatctttgt

SEQ ID NO: 6812 - protein, 82 aa, Zea mays
  misc_feature: Ceres CLONE 342412-F
MADQLGSYTIRSHGMILARLHMYDWIILLLLAVIDGLLNIIEPFHRFVGKDMMTDLRYPMKGNTVPFWAVPLIGIILPWTIF

SEQ ID NO: 6813 - DNA, 484 bp, Zea mays
  misc_feature: Ceres CLONE 342420-F
  misc_feature: Encodes the peptide sequence at SEQ ID NO. 6814
attttgcgacaattcatctgcatacaggggcaacatatctagcagctactccgcccccaaatgctcgccggcatatcccgtttcctcactcgccgccgcccgccctttccgcttgccgctaccgccgctgcagcagccatgtcgtcgtcgtcgtccacggcagcgaacatctccgagcgtccgatctctccggacaccacccgcgtggcctgggtggggacgggcgtcatgggccagtcaatggccggccacctcctcgccgccggctacgctctcaccgtcttcaaccggacggcatccaagacccagggccttgtctcccgcggcgccagcctcgcggacagcccgcgcgcggccgccgcggctgccgatgtcatcttcctcatggtcggtttcccctccgacgtccgctccaccgccctcgatccatccacaggcgccctctccggcctcaccccaggcggtatcctcgtcgatatgacca

SEQ ID NO: 6814 - protein, 141 aa, Zea mays
  misc_feature: Ceres CLONE 342420-F
  misc_feature (46)..(141): Pfam Name: NAD_binding_2 Pfam Description: NAD binding domain of 6-phosphogluconate dehydrogenase
  misc_feature: SWISSPROT Homolog: EC 1.1.1.60 2-hydroxy-3-oxopropionate reductase
MLAGISRFLTRRRPPFPLAATAAAAAMSSSSSTAANISERPISPDTTRVAWVGTGVMGQSMAGHLLAAGYALTVFNRTASKTQGLVSRGASLADSPRAAAAAADVIFLMVGFPSDVRSTALDPSTGALSGLTPGGILVDMT

SEQ ID NO: 6815 - DNA, 516 bp, Zea mays
  misc_feature: Ceres CLONE 342479-F
  misc_feature: Encodes the peptide sequence at SEQ ID NO. 6816
gtggtctatcggagaaacaaaattttgtatactactccaaatagctagatagaagtaatccaaaaaatacgtttctttgttgcagataaccgtctcttcatcttcctcgtgcgcttccagtcaggcaaaggcggcggcacgcccccacgatcttgcgcgcgcgctggactcgcagcctcgcatcgcaagctagttctttgggggcggattccccgattgcctgccattattctggcttggttcttgcctctgtttgggtactccggcgaatcgtctgagttggggactggtcctcctcctcctcccgatggggggctggaaccggtcgcggcatgtgagatggcagcgtgaccgcccgcggcgccctccgctccctccgcctgattacggaccggagcactgctcagtcccattatgggaaagggaattctgcagctacgtcggcaacatttcttggcaaaggttctgtgaaaacaagcggtatgcttcagtagacaataccctcgagcactggga

SEQ ID NO: 6816 - protein, 69 aa, Zea mays
  misc_feature: Ceres CLONE 342479-F
MGGWNRSRHVRWQRDRPRRPPLPPPDYGPEHCSVPLWEREFCSYVGNISWQRFCENKRYASVDNTLEHW

SEQ ID NO: 6817 - DNA, 504 bp, Zea mays
  misc_feature: Ceres CLONE 342496-F
  misc_feature: Encodes the peptide sequence at SEQ ID NO. 6818
acgaaaaaaacctctctcggaagttcctctcgcgtggccggtttcctcaacctccgtgtcggctcgatagtttcgcaagcgggcggggcgggggtctgagctcgatggccacttctggcgagcaatcggctggcggtgggtctgcggcgagggcgtcgaagctgcgctacccgctgcggtcggcgagcaaggggaaggccgcggccgttttctcggcggcggatgcgcctcccaccaccatatctcaccgcgtcgggcaaaaccatcttcagatgtcagcaagagcatgtgtttaggcctttctgtgaaggataagtttgtcaagcctccacggaggcactcaatacaaaccaagccaggagctagcccaaggccaatacctytggaactgtgactccggtgtctggggttcggtcaaagagatcggacagccaggggaggtttgayactccgacatcagaagtgtccatgtccatgtcaaggcgcaagttcagcacgctttct

SEQ ID NO: 6818 - protein, 63 aa, Zea mays
  misc_feature: Ceres CLONE 342496-F
MATSGEQSAGGGSAARASKLRYPLRSASKGKAAAVFSAADAPPTTISHRVGQNHLQMSARACV

SEQ ID NO: 6819 - DNA, 519 bp, Zea mays
  misc_feature: Ceres CLONE 342506-F
  misc_feature: Encodes the peptide sequence at SEQ ID NO. 6820
aacggaggggaaaggaaaaaatcaaacgagaaggaagccaccgctccccaatcgcctgtttgccttcccatcctcctcgtagatctccggcaccgggcaccatgagctcctactccggcgaccgctcctcctcctccttgcgccccaccaacacctctttcgactcctacaagttcgacttcggcatcaactcctcccgctcctccggctctcgccccctccgcgaccagcggccgggcgcggctaccaaccctccaacgaggcccaccaccggcgccacgtggatgcaccagcccgccagcgccaagccgtcgtggacccaccagccttcccccgccgcggcgtcggcgcccaccatggcggggcccggatccgggccaacctccatggtcggcgacatctttggccggagctggtcctccgccgcgccctcctctgggctcggcatcccctcaggccaacaaccccggcctcttcagcgatctcctcggctcgcgctcggctcctcccgctccagtc

SEQ ID NO: 6820 - protein, 139 aa, Zea mays
  misc_feature: Ceres CLONE 342506-F
MSSYSGDRSSSSLRPTNTSFDSYKFDFGINSSRSSGSRPLRDQRPGAATNPPTRPTTGATWMHQPASAKPSWTHQPSPAAASAPTMAGPGSGPTSMVGDIFGRSWSSAAPSSGLGIPSGQQPRPLQRSPRLALGSSRSS

SEQ ID NO: 6821 - DNA, 445 bp, Zea mays
  misc_feature: Ceres CLONE 342509-F
accgagcatgatgctgtctctgttcacaactcttccgagcacgccgctgtctcctttgtcatcatcatcagctcagatctagcagcttcgccttctcaggtacgagatctacggcaatagaatccagacgtaccaactaaaatgttagggacataggttaaaatgattctaaatcagagctcaaataagagtacgaccaacacttcttgcacctgctcaagatgttttccacctcatagtgtcgttacgaaatgtgtgaacaggagattaataaaaatatcccctcttgcatgtgagcctgcaaccaataaaaaagtgtctatttactggacatatgttcatgttcacgcggcgcttcataaaatctgcataggatacatcgcacttctatctgacctactcaggtctggtgttcagcggttgccacacctaggatatcaaatgg

SEQ ID NO: 6822 - DNA, 1465 bp, Zea mays
  misc_feature: Ceres CLONE 342575
  misc_feature: Encodes the peptide sequence at SEQ ID NO. 6823
cccaccacacccaaaccgaccgccacagctgctcgcttgcttccgcccaggaccagaggggggagcctccagatctcggcgcgccatggcgtcgtcctccgacgagcagcccaagccgccggagccgcccgccgccgccgtggtcgccgcaccgccgcagacgcacgccgagtgggccgcctcgctccaggcctactacgccgccgcggggcacccctacgcctggccggcgcagcacctcatggcggcggccgcggcgggggcgcccttcggcacgccggtgccgttccccgtctatcacccaggcgccgccgcggcatactacgcgcacgcgtccatggccgcgggcgtcccttacccgacgagcgaagctgtcgccacggtggcggcggccactgcgccggaagggaaaggcaaggggaagggcgggggcgcgtcgcctgagaagggcagctctggggcgccctccggtgaggacgactccaggagtgacagcggcagcgatgagtcgtcagagacgagagatgatgacactgaccataagggttcatctgcgcccaagaaaaggaaatctggtaacacgtcggctgaaggtgaaccgtctcaagctgctgctgtgcgctatgctgcggttgagtcgccatatcccgcaaagggaaggtctgcctcaaagcttccagtgtctgcacctggccgggcagcgcttcctagtgccaccccgaatctgaacattgggatggacatttggaatgcttctccggccttggctgttcctgcagtgcagggggaagcgaatcctgggttggcgcttgcccgacgtgatggtgttactcaattggatgaacgtgaattgaagagggagaggcggaaacaatctaacagggagtctgcaaggagatctaggttacgcaagcagcaagagtgtgaggaattagccaggaaggtagctgacctaacaactgagaatagtgctctcagagcggaacttgacaacctgaggaaggcttgccaagacatggaagcagaaaattcacgtctattggtgagcacggtaccaagtgtcacaaccacactgggaatgagcatccagccgccaaaggcgcagcagcatcatgacgacgagggccagctccacaagaaatctagtaataacagcaacgggaaaggaagccacaaaccggaggctaacactaggtgagagacaggtgaatgagaaagtgacagagatgagatgaggtgtttcctatctaaccacaacacccatcatcaaccagtgcgttttcacagcccgctggggggccatgtagagtcgccccccactgcagccatgtattatttatggctcgccgcggtgtgcgttttgtgtgtgtgttttttttgtgtgtgtcgtgtaaacctattgatgtagctattgtaacaaaaacctagagagcctagaatttttatgccaaaaaaaaaaaaaaaa

SEQ ID NO: 6823 - protein, 370 aa, Zea mays
  misc_feature: Ceres CLONE 342575
  misc_feature (253)..(316): Pfam Name: bZIP_1 Pfam Description: bZIP transcription factor
  misc_feature (1)..(151): Pfam Name: MFMR Pfam Description: G-box binding protein MFMR
MASSSDEQPKPPEPPAAAVVAAPPQTHAEWAASLQAYYAAAGHPYAWPAQHLMAAAAAGAPFGTPVPFPVYHPGAAAAYYAHASMAAGVPYPTSEAVATVAAATAPEGKGKGKGGGASPEKGSSGAPSGEDDSRSDSGSDESSETRDDDTDHKGSSAPKKRKSGNTSAEGEPSQAAAVRYAAVESPYPAKGRSASKLPVSAPGRAALPSATPNLNIGMDIWNASPALAVPAVQGEANPGLALARRDGVTQLDERELKRERRKQSNRESARRSRLRKQQECEELARKVADLTTENSALRAELDNLRKACQDMEAENSRLLVSTVPSVTTTLGMSIQPPKAQQHHDDEGQLHKKSSNNSNGKGSHKPEANTR

SEQ ID NO: 6824 - DNA, 410 bp, Zea mays
  misc_feature: Ceres CLONE 342635-F
  misc_feature: Encodes the peptide sequence at SEQ ID NO. 6825
agcccacaccaaaagaaagaaaccaactaaaatcccaaaagagaggaaaggcacaaacagacggtagaaggaagaaagggacgctcgtctcggctcgtcacgtgccgccgccatggctgctctgggccgtggcctgcccctcctcctgctcctcctcctcgccgtagcgggggccgccaacgccgcggcggcgcccggcggcatgtccatcatcacctacaacgaggagcacggcgcgcgggggctggagcggacggagccggaggtgcgggccatgtacgacctctggctcgcggarcacggccgcgcctacaacgcgctgggcgagggcgagggcgagcgcgaccgccgcttcctcgtcttctgggacaacctccgcttcgtcgacgcgcacaacgagcgcgccggcg

SEQ ID NO: 6825 - protein, 99 aa, Zea mays
  misc_feature: Ceres CLONE 342635-F
  misc_feature: SWISSPROT Homolog: EC 3.4.22.14 Actinidain
MAALGRGLPLLLLLLLAVAGAANAAAAPGGMSIITYNEEHGARGLERTEPEVRAMYDLWLAEHGRAYNALGEGEGERDRRFLVFWDNLRFVDAHNERAG

SEQ ID NO: 6826 - DNA, 459 bp, Zea mays
  misc_feature: Ceres CLONE 342639-F
  misc_feature: Encodes the peptide sequence at SEQ ID NO. 6827
agaacttgagctttccgcttcctccgaccgagacgaggcagaaaccttcctcgatctccccttccccttccctcgctgtaattccatctccgtctccatctcgttcccaccacgccgctccctgtcgcggtgtcgccattgccccggctccaagcaaaatcccgcttgcctcgccccaagcattcctgctttcacccggccgccactcttccccagtccccgccactcaaggaaggcggaggattttatctagtcttgcagcgcggccatttccgtcccgccgtctgcgcctcctgtggcgtttgggacatcttccaattccaagctgacactacttgaacttaatgcggctctacgcacctgcgctctgtctgctgcgatcaagcacgcatccccaccctaatcagttccgtgcaggattcactcagagcatgggcttcctggaagtgctcgcactcg

SEQ ID NO: 6827 - protein, 38 aa, Zea mays
  misc_feature: Ceres CLONE 342639-F
MRLYAPALCLLRSSTHPHPNQFRAGFTQSMGFLEVLAL

SEQ ID NO: 6828 - DNA, 149 bp, Zea mays
  misc_feature: Ceres CLONE 342656-F
aaacctgcctccgcacctaccatttcctcccccaaaccaccatggacttctccgccggagggagtgggagcggcggaggaggcggaggcgccggcgacggcgggcgcaaggcggagcgctggctggagattgccagaagaaagctcctc

SEQ ID NO: 6829 - DNA, 468 bp, Zea mays
  misc_feature: Ceres CLONE 342680-F
  misc_feature: Encodes the peptide sequence at SEQ ID NO. 6830
gacgtgggcattggcaaatggcgattgcatttttggtgctaaaccgcacgacccactcggcccattccataccccaccttgcgtacgcgagccgaacgctcgtgggtactgcagcctccgtccctacctagggttccggcgatggcgcacggcggctacccgcgccgcggcgctgccgtacgcaggcccaagtcctcggcctctgccgctgttgccgaccgcaagcggaagcggaccgccgccgcgcaagaccacctcccttaagaaccagatccgctccaccgagcgcttcctccgcaaggaccttccggatgagattagggttgctcaagagaagaaactggaagaactgaagaggcaacaagagcttcagaatcaacttgttgtccagcggacattacagtttagagatagaaagataaaattctttgagagacggaagattgagaggatgataaggcgactcga

SEQ ID NO: 6830 - protein, 155 aa, Zea mays
  misc_feature: Ceres CLONE 342680-F
TWALANGDCIFGAKPHDPLGPFHTPPCVREPNARGYCSLRPYLGFRRWRTAATRAAALPYAGPSPRPLPLLPTASGSGPPPRKTTSLKNQIRSTERFLRKDLPDEIRVAQEKKLEELKRQQELQNQLVVQRTLQFRDRKIKFFERRKIERMIRRL

SEQ ID NO: 6831 - DNA, 260 bp, Zea mays
  misc_feature: Ceres CLONE 342683-F
ctctcgtcgcctcagctccctcttctccccgtgaccgaacaaacactgagcggaagaagcttcgaaccccttctggccatctctcgtcctcctttcaattcttgagctttgtgcttccatctcctctcctctgttctcttctttgtctctgcgtgcctgttcttgtcgtctcgctcgatcgtaagtgcaacggaataagaatggcgtcgccgtcagcgtcaggagagaagaagactacgatcctggtggcgaggaagggc

SEQ ID NO: 6832 - DNA, 1593 bp, Zea mays
  misc_feature: Ceres CLONE 342743
  misc_feature: Encodes the peptide sequence at SEQ ID NO. 6833
atacgttcttggatctcagctcgcgcgcgccatggttgtggaggccaactcagggagcacgctggcggccgtcggcgtggccggcaccggcagcagcatggccgtgcacggccaccagctttcgaccgtggtgccgagctcggtgaccggggaggaggtgaactacgagctcgcggacgccgacttgctccacaagctgcactatgtacgcgcggtgcacgtgttccgcgcgccgccgctcaccatccgggagctgaaagagcccatgttcccgtggctggacatgtacttccccgtcagcggccggctccggcggcgtcaagcggccgagggcgaagaggccgccgcggcggcggtggggcggccctacgtgcggtgcaacgactgcggcgtgcgcatcgtggaggtcgactgcgacgccaccgtggagcagtggctggaggcggaggcggagcgcggcgggctgtgcaaggcgctggcctacgacaaggtgatcgggccggagctcttcttctcgccgctgctctacgtgcagatcaccagcttcaagtgtggggggatggccctcggcttcacgtgggcgcacctcatcggcgacatcccctccgccgttgccagcttcagaaagtgggcgcaggtcctcggcggcaacaaggccccggcgccaaccctgcgagacccactcgccgtgccgccgtcggccccacctaccagcgtgacggtcccgccgtcggtcaaggccaccgcggcccccgtcggcgatcactgggtggtcccgaccacccatgacatggtgtccttatccttccacgtcaccgagcagcaactgcaggaactccggctcagcgcgaccaagggtcatcggcgcgaggttgtgggcccgtttgagctggtctcggcgctgatgtggcgggcgctggccgcgatccgaggccccgaggaggaggaggcgacgcgcacggtgaccgtcgtgaagactggagcggcgcccacgtcggggggcggcccccgcccggcgctgaccaacgagcaccgcatcggccacgtcgtcttcgcgaccggcggctcctcgccagcgacggccgacgtcgccaagctggcagcgctgctggccggcgcacacctggaggaggccagcgcggtcgcggccgccgcgttcgcgggagcggacgacgccgacgtggtcgtgtacggcgccaacctgacgttcgtggacgccgagggcctggaggtgtacgagctggagctcgcggggcggcgcccggcgcacgtggagtacgccgtggatggcgtcggcgacggcggcgcggccgtcgtgcaccgcgacgccggcgggcggggccggaccgtcgcggccgtcctgcgccgggggaaggcggaccgcctccgtgccgcgatccgtgacgcgctgcgggttgcttgatgatcttgcggttgcgggcagtctcgtggttcagtacttgtcaggttgaataaattagaggatgttgtaggatgtactcttgtggcgcatatgctcgcctgtatgttggaccgatcctgcccttccatgccagtgcgtacgtgtgtttaattacaaaaaaaaaaaaaaaa

SEQ ID NO: 6833 - protein, 463 aa, Zea mays
  misc_feature: Ceres CLONE 342743
  misc_feature (23)..(452): Pfam Name: Transferase Pfam Description: Transferase family
MVVEANSGSTLAAVGVAGTGSSMAVHGHQLSTVVPSSVTGEEVNYELADADLLHKLHYVRAVHVFRAPPLTIRELKEPMFPWLDMYFPVSGRLRRRQAAEGEEAAAAAVGRPYVRCNDCGVRIVEVDCDATVEQWLEAEAERGGLCKALAYDKVIGPELFFSPLLYVQITSFKCGGMALGFTWAHLIGDIPSAVASFRKWAQVLGGNKAPAPTLRDPLAVPPSAPPTSVTVPPSVKATAAPVGDHWVVPTTHDMVSLSFHVTEQQLQELRLSATKGHRREVVGPFELVSALMWRALAAIRGPEEEEATRTVTVVKTGAAPTSGGGPRPALTNEHRIGHVVFATGGSSPATADVAKLAALLAGAHLEEASAVAAAAFAGADDADVVVYGANLTFVDAEGLEVYELELAGRRPAHVEYAVDGVGDGGAAVVHRDAGGRGRTVAAVLRRGKADRLRAAIRDALRVA

SEQ ID NO: 6834 - DNA, 519 bp, Zea mays
  misc_feature: Ceres CLONE 342815-F
  misc_feature: Encodes the peptide sequence at SEQ ID NO. 6835
acccgcttcccccagccgcacgaaaccctaacgccgccgccgcttcacaggtaagccgccgtcatggtctccggttccggcgtatgcgcgaagcgcatcgtggtggacgcgctccaccacatgctgggccgcctgtcgtcgattatcgccaaggaactgctcaatgggcagaaggtggtcgtcgtccgctgcgaggagatctgtatgtcgggtggactcgtacgccagaagatgaagtacctccgctttctccgcaagcggatgaacaccaagccatcccatgggcccatccacttccgcgccccgtccaagatcctgtggcgcaccatccgcgggatgattccgcacaagaccaagaggggggaggcgtctctggctaggctcaagacgtacgagggcgtcccgccgccgtacgacaagaccaagcgcctggtcatccctgacgctcttaaggtcctgaggctgcaacccggacacaagtactgcctccttggtgagctttctaaggaggtcggatgg

SEQ ID NO: 6835 - protein, 152 aa, Zea mays
  misc_feature: Ceres CLONE 342815-F
  misc_feature (11)..(127): Pfam Name: Ribosomal_L13 Pfam Description: Ribosomal protein L13
MVSGSGVCAKRIVVDALHHMLGRLSSIIAKELLNGQKVVVVRCEEICMSGGLVRQKMKYLRFLRKRMNTKPSHGPIHFRAPSKILWRTIRGMIPHKTKRGEASLARLKTYEGVPPPYDKTKRLVIPDALKVLRLQPGHKYCLLGELSKEVGW

SEQ ID NO: 6836 - DNA, 430 bp, Zea mays
  misc_feature: Ceres CLONE 342864-F
  misc_feature: Encodes the peptide sequence at SEQ ID NO. 6837
actacccggcgacctcggtcgcccatggccaccgcgaaaccttatccccagaaccacacggataaaccctagctgcgcgagccccccggcgatgtcggtggccatccgctccggcgagctccttgcgtgccccgtcgcactccggcgggcgcccttggctgtgtctgtggtgtcggtgcggatgagggctaggggcgccgtggctgtgcgggcggaggcaacggccgagggggtagggaaagaggggaagaaggcggcggggaagaagaagccggcgagcgggatcaccaagccgaagcccatctctacagagctgcgggagttcgtcggcggcgcggcggagctgccccggactgaggccatcaagctggtatgggcgcacatcaagggcaacaacctccaggatccaaacaacaagaagataataatc

SEQ ID NO: 6837 - protein, 113 aa, Zea mays
  misc_feature: Ceres CLONE 342864-F
  misc_feature (65)..(113): Pfam Name: SWIB Pfam Description: SWIB/MDM2 domain
MSVAIRSGELLACPVALRRAPLAVSVVSVRMRARGAVAVRAEATAEGVGKEGKKAAGKKKPASGITKPKPISTELREFVGGAAELPRTEAIKLVWAHIKGNNLQDPNNKKIII

SEQ ID NO: 6838 - DNA, 521 bp, Zea mays
  misc_feature: Ceres CLONE 342896-F
  misc_feature: Encodes the peptide sequence at SEQ ID NO. 6839
actcagcggtccgtgttcttgatcgattaagctgtcctcaaccatcatggctgccattatggcggcaggtctggtagtactggcactcctcgctgccgtcgccgctccggcgcacgccacggactacgtggtgggcgactcggccgggtgggccagcggcgtggactacgccacctgggcgagcggcaaaaccttcgctgctggggacaacctagtgttccagtacagcgcgatgcacacggtggcggaggtgagctccgcggactacagcgcctgctcggccagcaactccatccagtcctacagcgaccagaacaccaaggtcgcgcttacggcgcccggcacgcgctacttcatctgcggcgccccgggtcactgcggcaacggcatgaagctcaccgtcacggtcgccgccgcggccgccaccaccaccccggagacgtccacgtctacgcccgccgcaacgacgacgcccaccacgaccaacgctgacacgccaacgctgamacgcctccggagac

SEQ ID NO: 6839 - protein, 158 aa, Zea mays
  misc_feature: Ceres CLONE 342896-F
  misc_feature (35)..(115): Pfam Name: Cu_bind_like Pfam Description: Plastocyanin-like domain
  misc_feature (154)..(154): Xaa is any aa, unknown, or other
MAAIMAAGLVVLALLAAVAAPAHATDYVVGDSAGWASGVDYATWASGKTFAAGDNLVFQYSAMHTVAEVSSADYSACSASNSIQSYSDQNTKVALTAPGTRYFICGAPGHCGNGMKLTVTVAAAAATTTPETSTSTPAATTTPTTTNADTPTLXRLRR

SEQ ID NO: 6840 - DNA, 447 bp, Zea mays
  misc_feature: Ceres CLONE 342941-F
  misc_feature: Encodes the peptide sequence at SEQ ID NO. 6841
gctagcttccctctctcctctgctgatctttttcgtccaccagcatggaggagaagaggaagctgcagtggcggcgagggcgtgatggcatcgtgcagtaccctcacctgttcttcgcggccctggccctggccctcctagtcgcggacccgttcggcctcagtccgctggccgaggtcgactaccggccggtgaagcacgagctcgcgccgtacggggaggtcatgggcagctggcccagagacaatgccagccggctcaggcgcgggaggctggagttcgtcggcgaggtgttcgggccggagtccatcgagttcgatctccagggccgcgggccgtacgccggcctcgccgacggccgcgtcgtgcggtggatgggcgaggaggccgggtgggagacgttcgccgtcatgaatcctgactgaagaagtctgtgccaatggagtg

SEQ ID NO: 6841 - protein, 126 aa, Zea mays
  misc_feature: Ceres CLONE 342941-F
MEEKRKLQWRRGRDGIVQYPHLFFAALALALLVADPFGLSPLAEVDYRPVKHELAPYGEVMGSWPRDNASRLRRGRLEFVGEVFGPESIEFDLQGRGPYAGLADGRVVRWMGEEAGWETFAVMNPD

SEQ ID NO: 6842 - DNA, 499 bp, Zea mays
  misc_feature: Ceres CLONE 342950-F
  misc_feature: Encodes the peptide sequence at SEQ ID NO. 6843
aagtttctggtttatcttccaccgcgcttcgcccactcgctccagccgcttcaccgcgccgccaccgccaccgcgaggatgccgttcaagaggttcgtggagatcgggcgcgtggccctggtgaactacgcgaggactatggccgtctcgttgtcatcgtcgatgtggtcgaccagaacagggcacttgtggatgcccctgatatggtcaggtgccaggtgaacttcaagcggctctcacttactgacatcaagattgacatcaaacgtgtccccaagaagacagccctgatcaaggcgatggaggaagctgatgtgaagaccaagtgggagaacagctcatggggcaagaagctgattgtccagaagaggagagcatcgctcaatgactttgataggttcaaagtcatgctggcgaagattaagaggggcggtgctatcaggcaagagctcgccaagctgaagaaggcgtcccacggcttaaggagtctctttccgtg

SEQ ID NO: 6843 - protein, 165 aa, Zea mays
  misc_feature: Ceres CLONE 342950-F
  misc_feature (69)..(145): Pfam Name: Ribosomal_L14e Pfam Description: Ribosomal protein L14
VSGLSSTALRPLAPAASPRRHRHREDAVQEVRGDRARGPGELREDYGRLVVIVDVVDQNRALVDAPDMVRCQVNFKRLSLTDIKIDIKRVPKKTALIKAMEEADVKTKWENSSWGKKLIVQKRRASLNDFDRFKVMLAKIKRGGAIRQELAKLKKASHGLRSLFP

SEQ ID NO: 6844 - DNA, 476 bp, Zea mays
  misc_feature: Ceres CLONE 342980-F
  misc_feature: Encodes the peptide sequence at SEQ ID NO. 6845
atagtcatataacctgccgcctggcccctacattcaacggtcatctccgctccgctcctccgctccacgccgccaccgctcctccgctcctcgcggctcaaacggtcaaatcgcagatccacaggaaaccccaagcggcggccgtccctgctgcggctctgcctccctctgctctccgattcgagcggattccatggccagagacgacgacggcgcgcccgcgcccggcgttccgggccaggtgtacctgcccgcgtggcgccgcgcgtacgaccgactcgtgaagatgctgcgccaggcgtacgcgcaggccgaggagctctccgtctagcgcgagcatctcatctccgagctccagttcctgcagagcgccagccgcgagcgccaggagatctcccaggtccgcctccagcagatctgcaaggacgaggagctcagcaagagagtccttgaggctgagacggcggcgcgtcttg

SEQ ID NO: 6845 - protein, 45 aa, Zea mays
  misc_feature: Ceres CLONE 342980-F
MARDDDGAPAPGVPGQVYLPAWRRAYDRLVKMLRQAYAQAEELSV

SEQ ID NO: 6846 - DNA, 1246 bp, Zea mays
  misc_feature: Ceres CLONE 343008
  misc_feature: Encodes the peptide sequence at SEQ ID NO. 6847
actacccacttctctcctcttccctctccccgcccactcgcctagacaaacgcggcggcgatggccgtccaggcgcagcaccttttcgcaccagccttcctgccccacgacgtcggccacgccttgagggcgctggagggtgccgcggcagtcggtggctccgcgctcctggacgagctcggcctcggcgggtgcgcgccggcgcccctcggggacgccgcgttcggcgacgcccggccgcgaagcgagctcacctgcaacgccggcgacgacaacagcgtgttcctcccgaggaagcgggcacgcgttgtgccggggttcctgctggacgaggtgcagaacaggtgcggcgcggcgtccaccagcggccgggcgatggccagtggcgtcctgtcgcagctgtaccaccagggcgtggaggtcgacgcgctggtgcgggtcgagatggacaggatgcgcgcggcgctccacgaggctcggctgcggcacgcgcgcgcggtggtagcggccgtgcggggtgcggcggaggctcggctccgcacgggggaggccgagctggagcgcgcccgacgccgcggcgcggagctggaggagcggctccggcagctggctgccgagggccaggcgtggctgggcgtcgccaggagccacgaggccgtcgccgctggcctccgcgccacgctcgacaaggtgctccagcaacccgccgtcgccggcggcggcggaggagaatgcggcgaggcggaagacgcgcagtcctgctgcttcgtggcatccccgtcggggcccgtgtcgacgggttcgtcgccgtcgtgcaaggcctgcggtggcggcgacgcgtgcgttctggtcctgccgtgccggcacctgtgcctgtgccgcgcgtgcgaggccggtgccgaggtgtgccccgtctgcggcgccgtgaagaacgcctcgctccaggtcctgctgtgacggcgaggaggcactggcagcggaagggagtcactccagcttgcctcccgcggtgcctcggtaggtgagtcacgacaccggggtcaggcatgaaacttttgttggttagtagcagtagagagtagccccgttggagtagaatcatgtagaaatgcattttggctagtttattagacaacccagctggtttatatgtccaaatcccagacttggttcacaactggagagtatctcatgtgtaatacaaccacacgacatagttccggtttgcttaaaaaaaaaaaaaaaa

SEQ ID NO: 6847 - protein, 298 aa, Zea mays
  misc_feature: Ceres CLONE 343008
MAVQAQHLFAPAFLPHDVGHALRALEGAAAVGGSALLDELGLGGCAPAPLGDAAFGDARPRSELTCNAGDDNSVFLPRKRARVVPGFLLDEVQNRCGAASTSGRAMASGVLSQLYHQGVEVDALVRVEMDRMRAALHEARLRHARAVVAAVRGAAEARLRTGEAELERARRRGAELEERLRQLAAEGQAWLGVARSHEAVAAGLRATLDKVLQQPAVAGGGGGECGEAEDAQSCCFVASPSGPVSTGSSPSCKACGGGDACVLVLPCRHLCLCRACEAGAEVCPVCGAVKNASLQVLL

SEQ ID NO: 6848 - DNA, 378 bp, Zea mays
  misc_feature: Ceres CLONE 343047-F
  misc_feature: Encodes the peptide sequence at SEQ ID NO. 6849
aaaaaaacgacgcagctagcgcgcatctcccgatcagctgcactgcaccttcgtcgaacgtcgatcgtactcgtacaccatgaaggcagtcgtcgcggcgacgatgcttctgctggtgctggtggccgcggcgacggtggcgagcgcagaccaccgtgacgacggccaccaccaccagcgccaccgcggccagagctggcaccgccacagcggcggcggccgagatggccgccggtcgacccctctggcggggctgacgcaktgcgtgacaagctgcgggtctggggtcacctcctgcatgctggactgctaccagccgctggtcgacctggaccccgtggagctgcccgtctgcctcctcaagtgcaccaacgacgc

SEQ ID NO: 6849 - protein, 99 aa, Zea mays
  misc_feature: Ceres CLONE 343047-F
  misc_feature (61)..(61): Xaa is any aa, unknown, or other
MKAVVAATMLLLVLVAAATVASADHRDDGHHHQRHRGQSWHRHSGGGRDGRRSTPLAGLTXCVTSCGSGVTSCMLDCYQPLVDLDPVELPVCLLKCTND

SEQ ID NO: 6850 - DNA, 440 bp, Zea mays
  misc_feature: Ceres CLONE 343115-F
  misc_feature: Encodes the peptide sequence at SEQ ID NO. 6851
accgcagccctagcgcgccgccaccttcaccttcccaggcckccgcgccgccgctccattgctgctaaacccgcaaccatgggtcccgtgctgaagcgcccgaccccgggcacggtgcagtgcttcgggcgcaagaagacggccgtggccgtggcctacacgaagccaggccgggggatgatcaaggtgaacggcgtcccgatcgagctgctccgtcccgagatgctgcggctcaaggccatggagcccgtgctgctggcggggcggtccaggttcaaggacatcgacatgcggatccgcgtgcgcggcggcgggaagacgtcgcagatctacgccatccgccaggccgtcgccaagggtctcgtggcctactaccagaagtacgtggacgaggcggcgaaaaaaggagatcaaggacatcttcatgcgctacgagcgca

SEQ ID NO: 6851 - protein, 120 aa, Zea mays
  misc_feature: Ceres CLONE 343115-F
  misc_feature (17)..(119): Pfam Name: Ribosomal_S9 Pfam Description: Ribosomal protein S9/S16
MGPVLKRPTPGTVQCFGRKKTAVAVAYTKPGRGMIKVNGVPIELLRPEMLRLKAMEPVLLAGRSRFKDIDMRIRVRGGGKTSQIYAIRQAVAKGLVAYYQKYVDEAAKKGDQGHLHALRA

SEQ ID NO: 6852 - DNA, 461 bp, Zea mays
  misc_feature: Ceres CLONE 343117-F
  misc_feature: Encodes the peptide sequence at SEQ ID NO. 6853
  misc_feature (391)..(391): n is a, c, t, g, unknown, or other
cctcaactctcctcattcttcgcaggctgagcagcaaccgccccaatctgcagttcaagaaccgcccacgcagaacccctccgccctccgctccttccaacttgctctctacctgcaccagcctcgcccacccttcgctcgcctccgccatggggaggggaaagttcaagggaaagcccaccggccgccacagcgtctccacaccagaggagatcgctgctggtacttcaggtcgccctcgcacctttatgaagacatgcaattgaaaaagagaattgatcttttttatgggcgaagtgtcgaagatggctttggtgaaggaaatgtcttgttagcatcaagtaaatggcgacatcacaacccctacaagcttgtgccttaaaacaagagnatacaagaagttggagtgcttttgtgaaggcttttgcgaatcacttgaagcgttagtacttttgtgaatg

SEQ ID NO: 6853 - protein, 38 aa, Zea mays
  misc_feature: Ceres CLONE 343117-F
MGRGKFKGKPTGRHSVSTPEEIAAGTSGRPRTFMKTCN

SEQ ID NO: 6854 - DNA, 143 bp, Zea mays
  misc_feature: Ceres CLONE 343152-F
aaaaacccagtcccatacgcacccgtccgttccgcgcgatcagccgagcgatgtcgtcgtcggcgcccgcaccggccaggccgtggacgacgcggaggacgaccagctcgcctccatgtccacggaggagatcatcagggcct

SEQ ID NO: 6855 - DNA, 494 bp, Zea mays
  misc_feature: Ceres CLONE 343153-F
  misc_feature: Encodes the peptide sequence at SEQ ID NO. 6856
  misc_feature (457)..(457): n is a, c, t, g, unknown, or other
agtattctgctcaagcacaccgcagaaaaagaaaaagaaaaggcaaaggcaaaggaatcccaatcaggcaagcaaaaaggaagaaccaggtgctgcggccggagatgtcgtcgcagctgatcgaggagcaccggtcgggcgcatggatcataactgccttctgggatgtccttgcgtttgtgttgcttcttgtgatttgttatctgtgggcaccttcccaaagctcgcaaagatatgcatattctggtgaagctgctgacgatgacgatgaggaatctcaatctctgacgaaaggagatggtgaagtagggatggtaaaaattgacaaggacagaaatgctggtgtcagcagtgctttcggcttagaagatgaggctgaggaggacaagcgggaatagccatttcttgttcctgatgtcccctaggtcccagaaacaatcgatattttggagcagcnatattgcaagaatacttctttttcaagttacatgtgg

SEQ ID NO: 6856 - protein, 131 aa, Zea mays
  misc_feature: Ceres CLONE 343153-F
YSAQAHRRKRKRKGKGKGIPIRQAKRKNQVLRPEMSSQLIEEHRSGAWIITAFWDVLAFVLLLVICYLWAPSQSSQRYAYSGEAADDDDEESQSLTKGDGEVGMVKIDKDRNAGVSSAFGLEDEAEEDKRE

SEQ ID NO: 6857 - DNA, 454 bp, Zea mays
  misc_feature: Ceres CLONE 343160-F
  misc_feature: Encodes the peptide sequence at SEQ ID NO. 6858
gttggctttctcccctcgcaccggggaacgcggctgccgatccgctcccgatcccctgccctcctccttccagccgactgagattccaccaaatcggcgcccgtgcagtccccgattcgattgacaagcacgattggccgctcctgatcagctacgggatacggctggatttgatttgattggatccccaattgggtgtccgggtccgcgcgttcgggcgggcgggcggggggattgctttagggtttcagcgggtgcggtcgctgtgtaggcgggtagggttttgccatggcggagaagggctgcctgaagcggctccagaaggagtaccatgcgctctgtaaggaaccgccgccgcaggtcgtggctcgcccactgcccaacgacatattggagtggcactatgtacttgaaggaagtaaaggcacaccctttgaaggtggatattactatg

SEQ ID NO: 6858 - protein, 55 aa, Zea mays
  misc_feature: Ceres CLONE 343160-F
  misc_feature: SWISSPROT Homolog: EC 6.3.2.19 Ubiquitin--protein ligase
MAEKGCLKRLQKEYHALCKEPPPQVVARPLPNDILEWHYVLEGSKGTPFEGGYYY

SEQ ID NO: 6859 - DNA, 259 bp, Zea mays
  misc_feature: Ceres CLONE 343180-F
  misc_feature: Encodes the peptide sequence at SEQ ID NO. 6860
aaatgtttcgtgttcccagcagagccagtgcaattatcggaagcaactgcagagctgcagcgaccaagcggacgacgcgagagagatgagggcggtggtgatcacgcgcggcggcggcggcccggaggtgctggaggcgcaggaggtagaggaccccgcgccgctgggcgacggcgaggtcctcctccaggtggtcgccgcgggcgtcaaccgcgccgacacgctccagcgccacggcgccacccgccgcccgccggcg

SEQ ID NO: 6860 - protein, 58 aa, Zea mays
  misc_feature: Ceres CLONE 343180-F
  misc_feature: SWISSPROT Homolog: EC 1.6.5.5 NADPH:quinone reductase
MRAVVITRGGGGPEVLEAQEVEDPAPLGDGEVLLQVVAAGVNRADTLQRHGATRRPPA

SEQ ID NO: 6861 - DNA, 425 bp, Zea mays
  misc_feature: Ceres CLONE 343194-F
  misc_feature: Encodes the peptide sequence at SEQ ID NO. 6862
acggtacagcctcatcgccacgccaccgacgaaagaaagcttggacgagtgaagggagatgccgccgccagctccgcgccgaataatcctgctggccgcggcgctgctgctgtggccggccgcctgcgtcacggccgacgacggcagcacggcattcttgccgccgccaccaccaccggggcccgcgtcgccgttcccgttctgcccggtgcggccgcctggggtgtcgtcggggccgttcccctggtcgccgccgccgccgtcggtggcgaggttccctcaggacccggggttcttgccgtccggggcgtgccccgtcggcggcgcggcggcggtggcgtggctgctgctgccgctgctcgctgtgctctctgctttcttgctgcggcacgagaagctttttttttttttttttyccccaatat

SEQ ID NO: 6862 - protein, 122 aa, Zea mays
  misc_feature: Ceres CLONE 343194-F
  misc_feature (120)..(120): Xaa is any aa, unknown, or other
MPPPAPRRIILLAAALLLWPAACVTADDGSTAFLPPPPPPGPASPFPFCPVRPPGVSSGPFPWSPPPPSVARFPQDPGFLPSGACPVGGAAAVAWLLLPLLAVLSAFLLRHEKLFFFFFXPI

SEQ ID NO: 6863 - DNA, 489 bp, Zea mays
  misc_feature: Ceres CLONE 343197-F
  misc_feature: Encodes the peptide sequence at SEQ ID NO. 6864
actcagatttgcactcggccggcatggcatttatcccccacctacaatctcaggcaatccgccattactgagagccccaatcgcacatcgggtcgtggcaagctcgcgacgcggaagcgccaccgctcccctgtccgtctccgtccacctcctgtgccggctgcctgcctgcctaccacatcaatcagtgtgaccatccagcacattcccatgacgtgccacgccagcctgctgctgccggcgctcgccgccgtcctgctctgctgccccctcgcgcaatgcgggcagcagaactacacctccatgttcagcttcggcgactcgctcaccgacaccggcaacctgctcgtgtccagcccgctctccaaccacatcgtcggccgctacccctacggcatcacctacttccaccgccccaccggccgctgctccgacggccgcctcgtcgtcgatttcctagcgcaagcgttcggcctgccgctgctgcag

SEQ ID NO: 6864 - protein, 93 aa, Zea mays
  misc_feature: Ceres CLONE 343197-F
  misc_feature: SWISSPROT Homolog: EC 3.2.1.51 Alpha-L-fucosidase
MTCHASLLLPALAAVLLCCPLAQCGQQNYTSMFSFGDSLTDTGNLLVSSPLSNHIVGRYPYGITYFHRPTGRCSDGRLVVDFLAQAFGLPLLQ

SEQ ID NO: 6865 - DNA, 328 bp, Zea mays
  misc_feature: Ceres CLONE 343209-F
  misc_feature: Encodes the peptide sequence at SEQ ID NO. 6866
aaccgagatgcaatgcaatgcaaacatcctccctcttctcctgctcctcacagacatcttatcctagctcccggtcgaaggccgtaggtaggattcccttctattcctcgcccgcttcctcctccggcagccggacctagctagctagctttcttgccgttcgccgcccatatggctaggaagtgctctagctgtgggaacaacggccacaactccaggacctgcggcgggcacagcaggaccgcggcggccttcgagaacaacggcggcggcgtgaggctgttcggggtgcagctgcacgtggggtcctcgtcgcccgtagccgtag

SEQ ID NO: 6866 - protein, 52 aa, Zea mays
  misc_feature: Ceres CLONE 343209-F
MARKCSSCGNNGHNSRTCGGHSRTAAAFENNGGGVRLFGVQLHVGSSSPVAV

SEQ ID NO: 6867 - DNA, 468 bp, Zea mays
  misc_feature: Ceres CLONE 343229-F
  misc_feature: Encodes the peptide sequence at SEQ ID NO. 6868
ctccacctttccacgctatagctcctctccgagtcgtcgtctccgtcgctgcctgctctgcttgctgcgccactccaaacccaacccaaaacccccacacgagatctgcgcagcaatggcgacgcggtgccacgtcctgctcctcctcgccgccgccttcgcgtccctcctcgcgctcgtggccgcggaagggggcgaagaggggccccgcgggcgccggctgctcgtcctcctggacgacctggccgtgcggtcgtcgcactcggccttcttcggctcgctccaggcgcgtgggttcgatctcgacttccgcctcgctgacgatccaaagctctcgctccaccgctacggccagtacctctacgacggcctcgtgctcttcgccccctccacaccacgttttggtggatcagtggaccagawcgcagtcctcgaatttattgatgctgggcatgacatgatcctggc

SEQ ID NO: 6868 - protein, 117 aa, Zea mays
  misc_feature: Ceres CLONE 343229-F
  misc_feature: SWISSPROT Homolog: EC 2.4.1.119 Dolichyl-diphosphooligosaccharide--protein glycotransferase
  misc_feature (103)..(103): Xaa is any aa, unknown, or other
MATRCHVLLLLAAAFASLLALVAAEGGEEGPRGRRLLVLLDDLAVRSSHSAFFGSLQARGFDLDFRLADDPKLSLHRYGQYLYDGLVLFAPSTPRFGGSVDQXAVLEFIDAGHDMIL

SEQ ID NO: 6869 - DNA, 467 bp, Zea mays
  misc_feature: Ceres CLONE 343237-F
  misc_feature: Encodes the peptide sequence at SEQ ID NO. 6870
gtcaccccaaaccggtctttgtcgcttcaaaccgtccaagggattcaaaacgcaaatcgaaccgccacgtgttcgcttggtttctttctttctccctacgccttgtccgctcctctctccctctctcgttctcgtcctcgtctttctcgagccgcgaggcgatcgcatcggagactcggagccggcaaaaccctaaggggaaggtttctgcaaggaggagggagatgcagggcgccagccacatgctcctggaggagcccttccgcctcgcctccgtcctctcccccgccaagcctaaagtattcccatcactcaccaagatagttgggacgctcgggcccaattcacactcggttgagattattcaggaatgcctcactgctggaatgtcagttgcacgatttgatttctcatggatggatgctgcgtatcaccaggagaccttgataatttgaggaaagcggcac

SEQ ID NO: 6870 - protein, 76 aa, Zea mays
  misc_feature: Ceres CLONE 343237-F
  misc_feature: SWISSPROT Homolog: EC 2.7.1.40 Pyruvate kinase
MQGASHMLLEEPFRLASVLSPAKPKVFPSLTKIVGTLGPNSHSVEIIQECLTAGMSVARFDFSWMDAAYHQETLII

SEQ ID NO: 6871 - DNA, 262 bp, Zea mays
  misc_feature: Ceres CLONE 343291-F
cttttcccgttcttctgaagctgtccatcttcttcccgtcgcttcggccgtcccgcaccagggaggagaggaggcttcaccgcgaagctcgccatgattctcgccggagaggagttcgtcacagagcccgcggtcgcwggcggtggcsggggcgcyatttmctgtggatatctgtcatggatcccgtcaagatgggcaccggcgtrcaggcctacatctcctaccgcgtcatcgrcyaagaccaacctccctgaatttgagg

SEQ ID NO: 6872 - DNA, 504 bp, Zea mays
  misc_feature: Ceres CLONE 343298-F
  misc_feature: Encodes the peptide sequence at SEQ ID NO. 6873
cttgagggaagcgtcgccgtctgcccacacccgcaccgcacccaaccgcagcggagccgggagccgaaggccgagggtattcttccttcgccgctaagcacgcctcctctccacaggcagccgacccaggggaagcgtcgccgtctgcccccaccccgaatctgatgcttcatcgattggttctaatcctcactacctccatattcatgcacgagattgcgcgtgattaggagcagggaccaatcatattgaactcagatttggagcggagcaggagggggagccattgccggtgttctgattgctgctggaggtcgagggatggtaggggtgctgtcgaatcgcgtggatcgggacgacctcaaggccggcagcctagctctagcgagagctagacagtccaatatgccagttacatacttacattgcacacgtacatcaaacgaataaatgtcaagctattctaaattttaatactacgtactgcaatggtgatgccaaaaa

SEQ ID NO: 6873 - protein, 42 aa, Zea mays
  misc_feature: Ceres CLONE 343298-F
MVGVLSNRVDRDDLKAGSLALARARQSNMPVTYLHCTRTSNE

SEQ ID NO: 6874 - DNA, 470 bp, Zea mays
  misc_feature: Ceres CLONE 343299-F
  misc_feature: Encodes the peptide sequence at SEQ ID NO. 6875
gtacccgccgcgagaagctccggttggcaccccaacggcatggatgctagcagcgtcagcccgtgcgatctagacagggagttcgcgccccaaatcgctcagctcctcgccacgcctcctctccaatcagctcaggaatactatggtgaactcatacggtccaagaagcttgatagcattagagtgagctacagtggcaagcatgggaaaggtgtttatgcaaatagggactttgctgaagacgaccttgttctgaaggaccaaatgttggtcggtgctcaggacagccttaacaagattgactgtgttgtgtgtagttactgcttccgcttcattggttctatagagtaccaaattgggcgtagattgtatttgcaaagccttggtggtagtgttgatggcactaccgacagacactgccatgggagtgatgttgggtcaagtactggttgttccagtgcatcaaatgg

SEQ ID NO: 6875 - protein, 143 aa, Zea mays
  misc_feature: Ceres CLONE 343299-F
  misc_feature: SWISSPROT Homolog: EC 2.1.1.43 Histone-lysine N-methyltransferase
MDASSVSPCDLDREFAPQIAQLLATPPLQSAQEYYGELIRSKKLDSIRVSYSGKHGKGVYANRDFAEDDLVLKDQMLVGAQDSLNKIDCVVCSYCFRFIGSIEYQIGRRLYLQSLGGSVDGTTDRHCHGSDVGSSTGCSSASN

SEQ ID NO: 6876 - DNA, 429 bp, Zea mays
  misc_feature: Ceres CLONE 343303-F
  misc_feature: Encodes the peptide sequence at SEQ ID NO. 6877
acatcacatatccgttgtggcagcagccttcgtgcaggcatggcgagctcatcttgtgcactgctgggtctggcctgcttcgtgctcctggcggcggcagccggcgccacgcagtacaaggtcggcggcgacaatggctgggccgtgccggacgccaccgccgagtcgttcaacacctgggcggagaagaccagcttccagatcggcgacagcctcttgttcgtgtaccccaaggacaaggactcggtgctgctggtggagccggccgactacaacgcctgcaacacctcctcctacgacaagcagttcgacgacggcagcacgtccgtggcgctggaccgcgccggcgccttcttcttcatcagcggcgtcgaggccaactgccgcgccaacgagaagctcatcgtcatggtcgccggcgcgggcgcg

SEQ ID NO: 6877 - protein, 130 aa, Zea mays
  misc_feature: Ceres CLONE 343303-F
  misc_feature (34)..(119): Pfam Name: Cu_bind_like Pfam Description: Plastocyanin-like domain
MASSSCALLGLACFVLLAAAAGATQYKVGGDNGWAVPDATAESFNTWAEKTSFQIGDSLLFVYPKDKDSVLLVEPADYNACNTSSYDKQFDDGSTSVALDRAGAFFFISGVEANCRANEKLIVMVAGAGA

SEQ ID NO: 6878 - DNA, 269 bp, Zea mays
  misc_feature: Ceres CLONE 343335-F
  misc_feature: Encodes the peptide sequence at SEQ ID NO. 6879
gtctcacctgatcttttttgctaaaaaaaactctagaaacaaagacagagagaaaaaagaaagctaaggagtcgaagaggaaaaggagaggtggccaggtggtggtgggggacgaccggacgaggaagtagtggcctgtgcgtgccgtcgcggaggagggggtggcgatggagaagggcgcgggcacgcggcggcrgcggctggtggaaaggggatcggatcgccttgccttcatcaccggccagacgcgcagcctctcctgcgacccg

SEQ ID NO: 6879 - protein, 34 aa, Zea mays
  misc_feature: Ceres CLONE 343335-F
  misc_feature (10)..(10): Xaa is any aa, unknown, or other
MEKGAGTRRXRLVERGSDRLAFITGQTRSLSCDP

SEQ ID NO: 6880 - DNA, 444 bp, Zea mays
  misc_feature: Ceres CLONE 343387-F
  misc_feature: Encodes the peptide sequence at SEQ ID NO. 6881
  misc_feature (435)..(435): n is a, c, t, g, unknown, or other
gcagcccgctcagcaccccttaccggccgcgtcccaggcgcgccactgcttcccttgcctcgtcttccgctgcccggtccgcccggatcctccgcaggtcggcggccgcgtcgtcgtcggggctggagacgctcatgccgctgcacagcgcggtggcggccgcgcggcttaggtcctgcatcgccgttgacttctcctgctggagctcgctctcacaaggccaagttcatggagctactgccttaggagcgtgtgttcattctctgacttattggctgtcagtgctaaatggcgcataccaatttggaaacttgtgaacttccatagtagtttcgattttgtataaccttttgtttctggcaacgttgacaaaatttgatcagcagggatctttattgaatgcttttcaaagttacactagtacttgtaataaanattcctcaa

SEQ ID NO: 6881 - protein, 104 aa, Zea mays
  misc_feature: Ceres CLONE 343387-F
SPLSTPYRPRPRRATASLASSSAARSARILRRSAAASSSGLETLMPLHSAVAAARLRSCIAVDFSCWSSLSQGQVHGATALGACVHSLTYWLSVLNGAYQFGNL

SEQ ID NO: 6882 - DNA, 463 bp, Zea mays
  misc_feature: Ceres CLONE 343388-F
  misc_feature: Encodes the peptide sequence at SEQ ID NO. 6883
aagacaaacaattcgtgaccgtgtgtgactgaggcccgtcacatgtggaggtcaaatccacatgtttgcgtggaattgcgacagtcgcacagagcacttttgctaaatcgctagttcgtttcctaaaccctagcaaagtaggaatggcgtcggcgagcatgctcgcgcgctcccttctccgcaccccagaccctacccaaacgagccacccgaaccgccggagcgccgctgtcgtctccttcccccgccgccaccgccgcctgtccgtgcgcgcctccgtctccacggcctgcccttccccaccgccacagcccgcggcggcggctgccggcgtgccgaagcactgcttccggcgcggggccgatggctacctgtactgcgagggagtgcgggtggaggacgcgatgacggctgccgagcgcagcccttctacctctacagcaagccacagatcctccgcaac

SEQ ID NO: 6883 - protein, 106 aa, Zea mays
  misc_feature: Ceres CLONE 343388-F
  misc_feature: SWISSPROT Homolog: EC 4.1.1.20 Diaminopimelate decarboxylase
MASASMLARSLLRTPDPTQTSHPNRRSAAVVSFPRRHRRLSVRASVSTACPSPPPQPAAAAAGVPKHCFRRGADGYLYCEGVRVEDAMTAAERSPSTSTASHRSSA

SEQ ID NO: 6884 - DNA, 487 bp, Zea mays
  misc_feature: Ceres CLONE 343459-F
  misc_feature: Encodes the peptide sequence at SEQ ID NO. 6885
aagcagcatccgcacactcccaattcccctcgagcgccgcagcgagcccaagaagccgaccgccgagccccctctccagtccagtccgcggtctcggtttcttgcttacccggcgcccaatcttcagggagctccttctcgtcgtctgtctccatggccgcctcgaccaagaccgtcgccgtcctcctcgccgcggtgctcctcgcgctggtcgcgtccgcggcagccagcaggaagctggaggaggaggacgcactcctgggaagcctggccccagcccccgcgccggccgttggcggttccgcggggctgcctggcgccaggccgggggcgtgggccgtcgccgccctggtctctctcgtcgccttcctcgtgaactgagggtgtgggcatcgtgctgcgcagcgcgggagatgggagggacgaatcctgcgatctggatcgctgggagaggagagggggatatttatgttcgttctgtttgttc

SEQ ID NO: 6885 - protein, 75 aa, Zea mays; identical to SEQ ID NO: 6082
  misc_feature: Ceres CLONE 343459-F

SEQ ID NO: 6886 - DNA, 468 bp, Zea mays
  misc_feature: Ceres CLONE 343501-F
  misc_feature: Encodes the peptide sequence at SEQ ID NO. 6887
atccgtgctttgtgcctgtttggtgcgcgtccacctttcggggtcaccggcttctgctttcttgctacgccaccgcgcctctcgtctatttatggagtcccccgatccatgaagccggggcaggccgagagttgtcaaggacgacgtctgccggcagtgctcctgctcctcctcctccttcctggccgccgcgcgagcttgggttagttagtgtctcttcttcgcggagacctgtgagaggagccatcatcatggccgctgttgagactgttgtcctcaaggttgctatgtcatgcgagggctgcgccggggcggtcagaagagtgctctccaagatggaaggagttgaaaccttcgacatagacctcaaggagcagaaggtgacagtcaaaggcaatgtcaagcctgaggacgtcttccagacggtttccaagtcggggaagaggacctcgtactgggagggcgaag

SEQ ID NO: 6887 - protein, 72 aa, Zea mays
  misc_feature: Ceres CLONE 343501-F
  misc_feature (7)..(68): Pfam Name: HMA Pfam Description: Heavy-metal-associated domain
  misc_feature: SWISSPROT Homolog: EC 3.6.3.4 Copper-exporting ATPase
MAAVETVVLKVAMSCEGCAGAVRRVLSKMEGVETFDIDLKEQKVTVKGNVKPEDVFQTVSKSGKRTSYWEGE

SEQ ID NO: 6888 - DNA, 407 bp, Zea mays
  misc_feature: Ceres CLONE 343510-F
  misc_feature: Encodes the peptide sequence at SEQ ID NO. 6889
acaagcgcacgcactcctcgccgtggaccaactcccaagtcccatcccgtcctaactcccaagagccgaacgcgagcggcggcgccatggcgcggtgcagcaacggcctcctgggcctcctcaacgcgggcgtgctggtcctcgccatcgtcgcgctggggggcggcgcctggctcagccaccgcgcgtccaccaccgactgcgagcggttcctcgagcggcccgtcatagcgctgggcgtgctcctcctcgcgctctccctagcgggcctggccggcgcgctctgccgcgcctcctgcctcctctggctctacctcctcgcgcttttcctcctcatcctgctcctcttcgcattcaccgtcttcgcgttcgtcgtcaccaaccgcggcgcccggtgggtcgtctcc

SEQ ID NO: 6889 - protein, 107 aa, Zea mays
  misc_feature: Ceres CLONE 343510-F
  misc_feature (4)..(107): Pfam Name: Tetraspannin Pfam Description: Tetraspanin family
MARCSNGLLGLLNAGVLVLAIVALGGGAWLSHRASTTDCERFLERPVIALGVLLLALSLAGLAGALCRASCLLWLYLLALFLLILLLFAFTVFAFVVTNRGARWVVS

SEQ ID NO: 6890 - DNA, 467 bp, Zea mays
  misc_feature: Ceres CLONE 343524-F
  misc_feature: Encodes the peptide sequence at SEQ ID NO. 6891
caggatcccgttctcagtcgccagccactggtcacagccaccgtctccctccttccccaacctcgccgctatcaggtggtggatgcagcagcgcggccgctccttcaacagccgctctcggagcttctcccgcgcccgcgtcgccatcgagggatcttaatctcacagccatccctcgatcatttcgtttgaactcggttctgaaattctgactgacgaacgcacgcaacgacctaccgtgatggacgccgccgccgccgccaccgttgtttctcttaacgggaagatgggggccgaggagaggaaggcgcagaagagctactgggaggagcattccaagaacctcaccgtcgaggccatgatgctggactcccgcgccgctgatctcgacaaggaggagcgccctgagcagcctgcactcagcaattttccaaaggagctctcatgggaggagcggtcacaggctc

SEQ ID NO: 6891 - protein, 75 aa, Zea mays
  misc_feature: Ceres CLONE 343524-F
  misc_feature: SWISSPROT Homolog: EC 2.1.1.103 Phosphoethanolamine N-methyltransferase
MDAAAAATVVSLNGKMGAEERKAQKSYWEEHSKNLTVEAMMLDSRAADLDKEERPEQPALSNFPKELSWEERSQA

SEQ ID NO: 6892 - DNA, 494 bp, Zea mays
  misc_feature: Ceres CLONE 343525-F
  misc_feature: Encodes the peptide sequence at SEQ ID NO. 6893
acagctagctagcatacagacgaataatctcttcttcacctcactaacaccagctagcaactctttctctcctgcaataatggccgctcgctcctcctcctcccagccgcagctggtcgcggcggcggcggtcctggcagcggcgctgctgcaacatcccgagtcgctcgtcagatcctccagcaacacagcaccttcgccgccgccgccatgggtaaggttcacggatcgctggcccgcgctgggaaggtgcgcgggcagacgcccaaggttgcaaagcaggacaagaagaagaagccccgcggccgcgctcacaagcgcatgcaatacaaccgccgcttcgtcaccgccgttgttggattcggcaagaagcgcggccccaactcatcggagaagtagatctagctatggctttgtgttttattccccactagtttcctcactgatggcaacttgctgaagacttatgctattatctgtatcgatgttactgc

SEQ ID NO: 6893 - protein, 62 aa, Zea mays
  misc_feature: Ceres CLONE 343525-F
  misc_feature (3)..(61): Pfam Name: Ribosomal_S30 Pfam Description: Ribosomal protein S30
MGKVHGSLARAGKVRGQTPKVAKQDKKKKPRGRAHKRMQYNRRFVTAVVGFGKKRGPNSSEK

SEQ ID NO: 6894 - DNA, 457 bp, Zea mays
  misc_feature: Ceres CLONE 343530-F
  misc_feature: Encodes the peptide sequence at SEQ ID NO. 6895
acagagaaccggaggactgaggaggaggaggagacgtcacgcctgcgcggctgcgcccaccatggacgaggaggagttccggcgcatgctcgacctcttcccggtcgtccgctcccgagactactgctgctccgatcttggaacatccagcagaggaaccagacagcgatcacgagttcaggaggcaactaagggcgataataaggactcgtccggtggacgagatatgtttatgcagaaattgaagatggctgcggagaataagattggagcgacaaaggcagagttcttctgcaagacattcgaagaagttcatgagaaacttgttcacagagagctgaatttggatgctgctaagaagttcctgagcgcatatgagagccgcgcgccagtccctcatcgcgatctcccagtcggtcccggaggtcggggcaccgtcgtcagcccgcccagcggc

SEQ ID NO: 6895 - protein, 132 aa, Zea mays
  misc_feature: Ceres CLONE 343530-F
MDEEEFRRMLDLFPVVRSRDYCCSDLGTSSRGTRQRSRVQEATKGDNKDSSGGRDMFMQKLKMAAENKIGATKAEFFCKTFEEVHEKLVHRELNLDAAKKFLSAYESRAPVPHRDLPVGPGGRGTVVSPPSG

SEQ ID NO: 6896 - DNA, 489 bp, Zea mays
  misc_feature: Ceres CLONE 343546-F
  misc_feature: Encodes the peptide sequence at SEQ ID NO. 6897
aaatcatgctcttgatatatgataggacaccaagttatgttccattgaagatactatcaattgaagatggaaagcaactgaaatcttttaagcacttgttgcatcgcaacaagaaaattgatttcatcgagcagttcaatgagaagctccttgtcaagcaagagaatgaaaacttccagatatttgatgtatggtgactgtggatataatttgatttttcttaatccttactgtttgaaggcctaatgattttatggtctgtgtttcgaaggtgcggagttctgagctaattgaagtcagtgtctccaagtttatgaccccttcagcattcatttttctgtatgagaacaacctcttcttgacattccgaaacagaacagtcgctgtatgggacttcagaggagagcttgtgacttcatttgaagaccatttgctctggcataatgattgtagcaccaacaatattacatcacgagtgaccaggatctc

SEQ ID NO: 6897 - protein, 64 aa, Zea mays
  misc_feature: Ceres CLONE 343546-F
IMLLIYDRTPSYVPLKILSIEDGKQLKSFKHLLHRNKKIDFIEQFNEKLLVKQENENFQIFDVW

SEQ ID NO: 6898 - DNA, 175 bp, Zea mays
  misc_feature: Ceres CLONE 343613-F
cttggcctccgcttccgctcccgcctggaggctgcatcaaaccctaccgctccggacctcccggctggccgcgagatgcgacgcctgtccggcccctaatccttctcgatactgcccctcgcccgcccgcccgccggcatgggccgctacgggcccttccctgccgccgctggtg

SEQ ID NO: 6899 - DNA, 498 bp, Zea mays
  misc_feature: Ceres CLONE 343643-F
  misc_feature: Encodes the peptide sequence at SEQ ID NO. 6900
agcaacaagaccgcgcccaatccaatctgcgctgcgctgcgaaaggccagaagagcacacacaacacaggtacagctagcgcgcgcgggcggtgcggggctgtctggcaattacgcagccttggcagcttgcaccaccgcgcaagctagcgctgacggagggaacaagggcttgcgcgcgcacgcagggaggggagggaacgcctgccgccgatcgcctggtggatctcccggcggcgggggaagcagcagagaggggacggccagcagcgcaaccaatggcgccgccggacgcgggtgcggcagcagcgtgcggcgcgcggtgggtgaggcgggacacgctgctgggcctcgcgctgggccagttcgtctcgctgctcatcaccgccaccggcttcgcctcctccgaactcgcccgccgagggatcaacgcgcccacctcgcagtcgctcctgaactacgtcctcctcgccgtggcctacggcggcgtcctcctcta

SEQ ID NO: 6900 - protein, 73 aa, Zea mays
  misc_feature: Ceres CLONE 343643-F
MAPPDAGAAAACGARWVRRDTLLGLALGQFVSLLITATGFASSELARRGINAPTSQSLLNYVLLAVAYGGVLL

SEQ ID NO: 6901 - DNA, 491 bp, Zea mays
  misc_feature: Ceres CLONE 343674-F
  misc_feature: Encodes the peptide sequence at SEQ ID NO. 6902
atattccgctcagaattcctcaccggcctgcctcagagagagaaaaagcggagattagcggcggcgatggcactcccggcgtcgagctccggcctcttccgcttcatctccccgcgcagccgcctccagtccaccgacatcgtggctgccgcctcctggggagtcttcgccggcaccgccggcctctacctcgtccagccatttgactggattaagaaaactttcttcgagaaaccccaaccagaggcataaaaggcttgcaagtctgcaactttggtacatcacttttgtccgggatggttcctgactgaagagaacttggataactcagcaaataatacgagaccccctcgtgtttccttgtttgttttttattattcagatgtatgtaggcaatccccacgagggagacagggaacagagaaaccgcttggttcacctgtgtttatataatactcctgtattatccaacatgcatgttttaaaacctg

SEQ ID NO: 6902 - protein, 61 aa, Zea mays
  misc_feature: Ceres CLONE 343674-F
MALPASSSGLFRFISPRSRLQSTDIVAAASWGVFAGTAGLYLVQPFDWIKKTFFEKPQPEA

SEQ ID NO: 6903 - DNA, 469 bp, Zea mays
  misc_feature: Ceres CLONE 343748-F
  misc_feature: Encodes the peptide sequence at SEQ ID NO. 6904
aagacatcccatatcgccaagtccccttcgtcgtccccttccctcgcctcgcgttaggtagcctgcttccgacccgcacatctccctccggttctcgccatgggcgccggcgccaacaaccacgaggagtcgagccccctcatcccagctgcggttgccgcccccgcggacgagaagcccccgcaggctccggcgccggaggccgccaattactatgccgacggggtcccggtcgtgatgggcgagcccgtgtcggcccacgccttcggcggcgtcccgcgggagagctggaactccgggatcctctcctgcctcggccgcaacgacgagttctgcagcagcgacgtcgaagtgtgtcttcttggaacggtagcaccatgtgtgctctatggtagcaatgttgagaggcttgctgctggacaaggcacatttgcaaacagctgtttgccttacactgggctgtatttgc

SEQ ID NO: 6904 - protein, 123 aa, Zea mays
  misc_feature: Ceres CLONE 343748-F
MGAGANNHEESSPLIPAAVAAPADEKPPQAPAPEAANYYADGVPVVMGEPVSAHAFGGVPRESWNSGILSCLGRNDEFCSSDVEVCLLGTVAPCVLYGSNVERLAAGQGTFANSCLPYTGLYL

SEQ ID NO: 6905 - DNA, 425 bp, Zea mays
  misc_feature: Ceres CLONE 343789-F
  misc_feature: Encodes the peptide sequence at SEQ ID NO. 6906
accaagcgtgccaattgactcgcgcacgctctctcagtcccagactccagtctcaaagcccccttctctccctgctgcaccgtgtcccagcgagctcgtcagccgcagtaccttgctccgcctccgaccccggcgcgagcgggaatctacacccacgtgctcgcggccgtccatgagctggccgccgagcagcggctggggccagcggcgacggaacgtgtccgccgcggcgctgctcttcctccacctgctgctgctcttctccgcccccgggacgtgcacgccggcgagaggggtggcgccgccgccgacgacggaccaggacgggtactcctggtcctggtgggacccggcggcgacggcggcgcgcagggggctggtggggccggggtcgtcgccgcccacgtgccgcagccgctgcgggg

SEQ ID NO: 6906 - protein, 84 aa, Zea mays
  misc_feature: Ceres CLONE 343789-F
MSWPPSSGWGQRRRNVSAAALLFLHLLLLFSAPGTCTPARGVAPPPTTDQDGYSWSWWDPAATAARRGLVGPGSSPPTCRSRCG

SEQ ID NO: 6907 - DNA, 456 bp, Zea mays
  misc_feature: Ceres CLONE 343822-F
  misc_feature: Encodes the peptide sequence at SEQ ID NO. 6908
attcagtccggccacgcactcaagcaatcatcgttctatcgaaacgcaacagcaagaagattaaccaagcacatcgccgttcsgkcgattcatgggtcgcatcggcaccgcracgacgctggtggccctcgcggcctgcctcctctactgctctgcttcgtcggcgacgctggcctacgccggcgctgcgccgacggaccttggggcgctgcggccaacgtgcgacgggacgcttgggcagtgcgcggtggggagcgacgaggagcaggaggtgggcggcagcgacgcgttcctgcggcgggcgttggcgcagcggcagcccaccaaccggtacatcagctacgcggcgctgcgcgcggatcaggtgccgtgcaaccagcgcggccgctcctactacagcaactgcgcgtcgcaraagccgccaacccctaccgccgcrratgctccgccatcacc

SEQ ID NO: 6908 - protein, 121 aa, Zea mays
  misc_feature: Ceres CLONE 343822-F
  misc_feature (56)..(113): Pfam Name: RALF Pfam Description: Rapid ALkalinization Factor (RALF)
  misc_feature (117)..(117): Xaa is any aa, unknown, or other
MGRIGTATTLVALAACLLYCSASSATLAYAGAAPTDLGALRPTCDGTLGQCAVGSDEEQEVGGSDAFLRRALAQRQPTNRYISYAALRADQVPCNQRGRSYYSNCASQKPPTPTAAXAPPS

SEQ ID NO: 6909 - DNA, 459 bp, Zea mays
  misc_feature: Ceres CLONE 343856-F
  misc_feature: Encodes the peptide sequence at SEQ ID NO. 6910
atattccgctcagaattcctcaccggcctgcctcagagagagaaaaagcggagattagcggcggcgatggcactcccggcgtcgagctccggcctcttccgcttcatctccccgcgcagccgcctccagtccaccgacatcgtggctgccgcctcctggggagtcttcgccggcaccgccggcctctacctcgtccagccatttgactggattaagaaaactttctttcgagaaaccccaaccagaggcatataaggcttgcaagtctgcaactttggtacatcacttttgtccgggatggttcctgactgaagagaacttggataactcagcaaataatacgagaccccctcgtgtttccttgtttgttttttattattcagatgtatgtaggcaatccccacgagggagacagggaacagagaaaccgcttggttcacctgtgtttatataatactc

SEQ ID NO: 6910 - protein, 62 aa, Zea mays
  misc_feature: Ceres CLONE 343856-F
MALPASSSGLFRFISPRSRLQSTDIVAAASWGVFAGTAGLYLVQPFDWIKKTFFRETPTRGI

SEQ ID NO: 6911 - DNA, 454 bp, Zea mays
  misc_feature: Ceres CLONE 343870-F
cggcccaattctcacgcgctcgccgcctaggagcattcacgttggcggcgggcggcggctcggttcctctcctccaccgcacctccaagaatccacctccacgactgagctgacggctcggtagcgccatggcagttcaccggctccaaccttccccatccggcctacagtgctccaccgcccggtcgccagtgctcctccatgggccacggctgacgggtgcacgcaccgatggttggtgcaggtaggagaggtggatttggtggacctagattcgatgtgcagagagcgacttggaggtggctgacatcttcaagcactgcatcatgcagttacaactactgttggccatacagggaaatgctgggcctattataccaattgttcaaagcatggaccttgtataattacatgtttttatcatagatagattaatttctgaaatgcccataga

SEQ ID NO: 6912 - DNA, 184 bp, Zea mays
  misc_feature: Ceres CLONE 343935-F
aaagcccgaatacatcgaactgcaaccgctcgacgtggggtagaatataatctggtgcgctccccccgcgaacaacttcctgcttgcacgcaagccactccgaggccaagtctagggtttgggaatctgtaggaggggagaggggagcgcgctcagggtcagggaggcgaagatgatcgaggtg

SEQ ID NO: 6913 - DNA, 482 bp, Zea mays
  misc_feature: Ceres CLONE 343936-F
  misc_feature: Encodes the peptide sequence at SEQ ID NO. 6914
cagaagttcaaaagggcttgctgatggcgcattcactgaggcagttgaaggaaccttgttaaacgatgaaaacttcaagagaaaagttcatgttattagaggtcttagagaactaacaagggatgtgcttcactattataagggcgctatattagatgaactacctggcttagtagacttcagtgtgtttttgaagctcacacccaagcagaaggacgttgttcacaagttggaaatgcatgatagattcaaaagaagtgcagtagggagtgcactgtacatccatccttgtctttcaggactttcagaggttaatgctgagaacagggctcacaccttgagagatgattcagttgatagtctgatggattctatcaatgtgagagatggcgtgaaggccaactttttcatgaatatcctgtcacttgctaattccgcaggagagaaagtacttgcttttagccaacatacttcccatgacc

SEQ ID NO: 6914 - protein, 160 aa, Zea mays
  misc_feature: Ceres CLONE 343936-F
RSSKGLADGAFTEAVEGTLLNDENFKRKVHVIRGLRELTRDVLHYYKGAILDELPGLVDFSVFLKLTPKQKDVVHKLEMHDRFKRSAVGSALYIHPCLSGLSEVNAENRAHTLRDDSVDSLMDSINVRDGVKANFFMNILSLANSAGEKVLAFSQHTSHD

SEQ ID NO: 6915 - DNA, 479 bp, Zea mays
  misc_feature: Ceres CLONE 343986-F
  misc_feature: Encodes the peptide sequence at SEQ ID NO. 6916
atttgcgacaattcatctgcatacaggggcaacatatctagcagctactccgcccccaaatgctcgccggcatatcccgtttcctcactcgccgccgcccgccctttccgcttgccgctaccgccgctgcagcagccatgtcgtcgtcgtcgtccacggcagcgaacatctccgagcgtccgatctctccggacaccacccgcgtggcctgggtggggacgggcgtcatgggccagtcaatggccggccacctcctcgccgccggctacgctctcaccgtcttcaaccggacggcatccaagacccagggccttgtctcccgcggcgccagcctcgcggacagcccgcgcgcggccgccgcggctgccgatgtcatcttcctcatggtcggtttcccctccgacgtccgctccaccgccctcgatccatccacaggcgccctctccggcctcacccaggcggtatcctcgtcgatatga

SEQ ID NO: 6916 - protein, 139 aa, Zea mays
  misc_feature: Ceres CLONE 343986-F
  misc_feature (46)..(140): Pfam Name: NAD_binding_2 Pfam Description: NAD binding domain of 6-phosphogluconate dehydrogenase
  misc_feature: SWISSPROT Homolog: EC 1.1.1.60 2-hydroxy-3-oxopropionate reductase
MLAGISRFLTRRRPPFPLAATAAAAAMSSSSSTAANISERPISPDTTRVAWVGTGVMGQSMAGHLLAAGYALTVFNRTASKTQGLVSRGASLADSPRAAAAAADVIFLMVGFPSDVRSTALDPSTGALSGLTQAVSSSI

SEQ ID NO: 6917 - DNA, 455 bp, Zea mays
  misc_feature: Ceres CLONE 344021-F
  misc_feature: Encodes the peptide sequence at SEQ ID NO. 6918
aaaaacccacgtttcaaaaaaaagagaggaaagcaaagttccttcttccctcggaaaaaaaatcagtctcaatggagagcagcgtaggcatagagaaggccgcagcggtggcggttggtgcaggtgtgggcggtggaggagggtacggctgcggcgggtgggagacgccgaagcgcgaggagtgccgcatcccggcgacgctgccgtgccccgcggcgccgaggaaggccgtgccggacttcgggaagcggcgcagcccgcccaagaacggctacttccagccgccggacctggaggcgctcttcgcgctcgcgccgcgccgccaggccttctgcgcgtgacttggcgcggactcgatttttggggagggagttgtagatagcttgccggtctcgctctgttgtactctttctagtgggggtgtttagtggccgcgggtgtattagggaggcagt

SEQ ID NO: 6918 - protein, 89 aa, Zea mays
  misc_feature: Ceres CLONE 344021-F
MESSVGIEKAAAVAVGAGVGGGGGYGCGGWETPKREECRIPATLPCPAAPRKAVPDFGKRRSPPKNGYFQPPDLEALFALAPRRQAFCA

SEQ ID NO: 6919 - DNA, 465 bp, Zea mays
  misc_feature: Ceres CLONE 344035-F
atcccagttcttctccacctcgtcctcctcctgctcctgcattctcgcccgtcccccaaattcaccttggccaccctccaccacctcgtcgacgcgggcagcagttcgcctcatcgtcctcccacctgacgacgtcgcggttcgcgctctcgcggcgtgccgcgcacccacgtctcccgcgagttccacgccttctgtgccacgcgcggacgcgccacctggagccactgttcgccgcgccctccgcatctccgacctctacatctccatccgcggaagcagaccacctccaatccttctttttcacgcagtcattgcttgcctccttagcccaactgttggtaccagaggttcatgtttcatcataaggaatgaacagtagtcgacaaatggaactccactacataaacactggatttcatacacaatcaccgagaccttcatggatttctttgagggtctcac

SEQ ID NO: 6920 - DNA, 475 bp, Zea mays
  misc_feature: Ceres CLONE 344051-F
  misc_feature: Encodes the peptide sequence at SEQ ID NO. 6921
atccatcgagctgcccgcgcgcggcagttaagctcacacatcagctagctcaccttggacggccgaccaggtacgttgcgagcgatggcgggatacaaagcgtcgggcggcacggcgctcggcgtcgtcctggctgttgccgcgctcctcgccgcggcggcgatggcggtggacgacgagcacatgtaccactggaagtgcttcaactcgtgcacggggaagtgccgcgacgaggacgcctttgacgacggccaccgttccggggattcgaacgtctcttccgtcgtctctggcggcaagtgcaacaacaggtgcctcagcgagtgcttcgaggacctgccggccatctgctaccaccagtgcgtcgtcagcaagtgcctctgcttcccaccctgtatgtgctgcacagccaacaagctaagatccatgaatcctacaagacaattatttctggaatcctaaatgatctctctct

SEQ ID NO: 6921 - protein, 125 aa, Zea mays
  misc_feature: Ceres CLONE 344051-F
MAGYKASGGTALGVVLAVAALLAAAAMAVDDEHMYHWKCFNSCTGKCRDEDAFDDGHRSGDSNVSSVVSGGKCNNRCLSECFEDLPAICYHQCVVSKCLCFPPCMCCTANKLRSMNPTRQLFLES

SEQ ID NO: 6922 - DNA, 506 bp, Zea mays
  misc_feature: Ceres CLONE 344061-F
  misc_feature: Encodes the peptide sequence at SEQ ID NO. 6923
ctccaacgcggcacagagcctcattcatctccattcgaaacaccctcgcacccacactctcccttcgtccccagcctaaatccccgcaacgatggctcgcacgaagcagacggcgcgcaagtccacgggcggcaaggccccgaggaagcagctggcgaccaaggcggcgcgcaagtcggcccctgcgaccggcggcgtgaagaagccgcaccgcttccgcccgggcaccgtggcgctgcgcgagatccgcaagtaccagaagagcacggagctgctcatccgcaagctgcccttccagcgcctggtccgcgagatcgcgcaggacttcaagaccgacctccgcttccagtcctccgccgtcgccgcgctgcaggaggccgccgaggcttacctcgtcggcctgttcgaggacaccaacctctgcgccatccacgccaagcgcgtcaccatcatgcccaaggacatccagctcgcccgccgcatccgcggggagcgcgcctaggcgg

SEQ ID NO: 6923 - protein, 136 aa, Zea mays
  misc_feature: Ceres CLONE 344061-F
  misc_feature (58)..(132): Pfam Name: Histone Pfam Description: Core histone H2A/H2B/H3/H4
MARTKQTARKSTGGKAPRKQLATKAARKSAPATGGVKKPHRFRPGTVALREIRKYQKSTELLIRKLPFQRLVREIAQDFKTDLRFQSSAVAALQEAAEAYLVGLFEDTNLCAIHAKRVTIMPKDIQLARRIRGERA

SEQ ID NO: 6924 - DNA, 505 bp, Zea mays
  misc_feature: Ceres CLONE 344073-F
  misc_feature: Encodes the peptide sequence at SEQ ID NO. 6925
aaggctttcattccccggagttcttgtcgtcttctcttcggcgtcccgttaaccgccatccaccacaccgagccccaaccccaagcagcccccaactaccaatccctcgcacctccatccctgtctcccatggctgtgcctctgcggtgggcgaacctcaacatcaacctggtgatcgagatcgtgaaccgcgtcccgtgcgcgatcgaccgcgaacggatggccgccgtctgccaggcgtggctcgcggcggtcgtgcaggcaaagcctctgacatatcagctcccgtcgctcttcctcccgcccgcgaacgtgtctggcgtctactgctacctcagcggctgccgcgaccacaacatgttgcccgggccccgctacttcggttcgtacgacggcggctggttcttcctcgcctacggtcagactcgcgggcaccggctgttcaacatccgcaccggaggctcccacgagctacccgacgtgktcgcggatctcttcactactg

SEQ ID NO: 6925 - protein, 125 aa, Zea mays
  misc_feature: Ceres CLONE 344073-F
  misc_feature (119)..(119): Xaa is any aa, unknown, or other
MAVPLRWANLNINLVIEIVNRVPCAIDRERMAAVCQAWLAAVVQAKPLTYQLPSLFLPPANVSGVYCYLSGCRDHNMLPGPRYFGSYDGGWFFLAYGQTRGHRLFNIRTGGSHELPDVXADLFTT

SEQ ID NO: 6926 - DNA, 507 bp, Zea mays
  misc_feature: Ceres CLONE 344111-F
  misc_feature: Encodes the peptide sequence at SEQ ID NO. 6927
acttctccttactcttccgtagttccaacgctctgcgcggcatttcgccgagcatacaccatgcactccctgcggtgcgcccttcgctaccccatccccagtaccgccgcctctttatccacctccggcctccgccgtctctcctcccaccatcgcactccaccgccgctccgctcagcgaccaccggtgaagacgagtggaacgacgcgtgggagaccgcatggcttccaggcgactcccccgcctcctccccagcgcccgccgcgccatgggagtctcccgcctcggcttcggagtccgccatcccggtcatctctgccgaggtggatccagacactaaggccttcgtggcagacatggacgagcgctgggccgagcgccgcatcgcgtcgaggcggggccagcagcagcgcgcgtctcgcgcggcggaaggcggggaggggggcgtcgtggcgaggaagaaggcgcaagcggatgattacaggaccaggaagcagcgggtgcac

SEQ ID NO: 6927 - protein, 149 aa, Zea mays
  misc_feature: Ceres CLONE 344111-F
MHSLRCALRYPIPSTAASLSTSGLRRLSSHHRTPPPLRSATTGEDEWNDAWETAWLPGDSPASSPAPAAPWESPASASESAIPVISAEVDPDTKAFVADMDERWAERRIASRRGQQQRASRAAEGGEGGVVARKKAQADDYRTRKQRVH

SEQ ID NO: 6928 - DNA, 520 bp, Zea mays
  misc_feature: Ceres CLONE 344136-F
  misc_feature: Translation starting site: 115
  misc_feature: SWISSPROT Homolog: EC 5.2.1.8 Peptidylprolyl isomerase
atcactaggccaccaccagcggcgggctccagtcgcaactcgcaacacagacgccgccgcccaaagaaaagacgtcaactccaggagacaagacagtgagaactgaagagaaggatgggcttcgagaagcagatcctgagatccggcaccggccccaagccgataaagggccagaaggtcaccgttcactgcaccggctacgggaaggatcgtgatctgtccaagaaattttggagcaccaaggaccctgggcagcagcattcagtttcagcattggtcagggttcagtgatcaaaggatgggacgagggagttatgaccatgcaagtgggtgaagttgctcgtatccagtgcacgcctgattatgcttatggagccggcgggttcccagcctggggaattcaaccaaactcagtgcttgtgttcgagattgaagtcctcagtgcccagtgaattcgcatctgtcagctatggaaacgttggccatgcttctccaagtaatgaaataattcccgttatca

SEQ ID NO: 6929 - DNA, 507 bp, Zea mays
  misc_feature: Ceres CLONE 344190-F
  misc_feature: Encodes the peptide sequence at SEQ ID NO. 6930
cttttccattctctgtcgccttcgcccctccaaggttctctgattccagaygcaaccctgcggctgcggggtcaaggagccagagggggtgcacagcgatcgttctgccggagatcgaaaccctcagctagggtctgaggcgccgggctgcggccgcgagatgtcgacgccggcgaggaagcggctgatgcgggacttcaggcgcctgcagcaggacccgcccgccgggatcagcggcgcgccgcacgacaacaacatcatgctctggaacgccgtcatattcgggccggatgatacgccttgggacggaggcacgttcaagcttaccttgcagtttacagaagattacccaaacaagccaccaactgttcggttcgtctctaggatgtttcatccaaacatatatgctgatggaagcatctgcttggatatcctacagaaccagtggagtcctatatatgatgttgctgcaatcttgacttctattcagtccctgctgtgtgatcc

SEQ ID NO: 6930 - protein, 115 aa, Zea mays
  misc_feature: Ceres CLONE 344190-F
  misc_feature (8)..(115): Pfam Name: UQ_con Pfam Description: Ubiquitin-conjugating enzyme
  misc_feature: SWISSPROT Homolog: EC 6.3.2.19 Ubiquitin--protein ligase
MSTPARKRLMRDFRRLQQDPPAGISGAPHDNNIMLWNAVIFGPDDTPWDGGTFKLTLQFTEDYPNKPPTVRFVSRMFHPNIYADGSICLDILQNQWSPIYDVAAILTSIQSLLCD

SEQ ID NO: 6931 - DNA, 465 bp, Zea mays
  misc_feature: Ceres CLONE 344264-F
  misc_feature: Encodes the peptide sequence at SEQ ID NO. 6932
aaaaacactctcctccttcctccaccgccgccaacgtcgcctggcggccgtctgcagctccgcgcctctgctcggaagttggtgaaggtttcttgaagctgagaagatggtgctgaagacagaactctgccgcctcagcggccagaagatttatcctgggaaaggcatccgatttatccgtgctgattctcaggttttcctttttgccaactcaaaatgcaagcgctacttccacaaccgcctgaagcctgcaaagcttacctggacagcaatgtacaggaagcagcacaagaaggatatccatgctgaggctgtcaagaagaggcgccgcgccaccaagaagccatactcgaggtccattgtgggtgcttccctagaggtgatccagaagaagagggctgagaagcccgaggtccgcgatgctgctagagaaagctgctcttcgtgagatcaaggagcgcatca

SEQ ID NO: 6932 - protein, 113 aa, Zea mays
  misc_feature: Ceres CLONE 344264-F
  misc_feature (3)..(73): Pfam Name: Ribosomal_L24e Pfam Description: Ribosomal protein L24e
MVLKTELCRLSGQKIYPGKGIRFIRADSQVFLFANSKCKRYFHNRLKPAKLTWTAMYRKQHKKDIHAEAVKKRRRATKKPYSRSIVGASLEVIQKKRAEKPEVRDAARESCSS

SEQ ID NO: 6933 - DNA, 464 bp, Zea mays
  misc_feature: Ceres CLONE 344272-F
cccttccctcctctccgcctccgattggagtggctcgccttcttccccgcagccagcacgagcttgtcgagatttcagctcgtttctccgccagaggtcgagcaggccagcctcccaggaccgaagctctgcccggttcgccagtccaggaactgctgccctcccggagccagagatccaaacaaacctctgcgttggggttctccggggttccttgcgctggagggaggtttcgttctcgccggccatggtttggctgagaagaagcagcagcatattgatgcgaaatctctgagctttatgaagatcgccactcacctgcgccgctcctgcttcctccactccttctcggtcgtcttcctctactggttttatgtgatctcgtaacttgccctcctccggatccgccattccccgtgccctctctctctctctctccgtcccctcttgcttctcccttcttt

SEQ ID NO: 6934 - DNA, 434 bp, Zea mays
  misc_feature: Ceres CLONE 344287-F
  misc_feature: Encodes the peptide sequence at SEQ ID NO. 6935
gcacataaaaattcccacgccccgcacccacccaacgacctccgcgtccgcccccaaaacccccgcaaaccctagccgccgccagcaaggaatggccgccctcctgcggctcgccgcagcccgatccgccctcccccggcgcgccctcgccccacaccggaggctcgcggcggcggcggcggccgcgatggaggagtggtggtccgactgggagcaggacggcgaggaggaggcgcgcgcctcggcgccggccgccggccttgaccccgccggcgggggccccgggggcgtgcagtggtttgtcatgggccgcccgggcccgcagaagcacgcccacgccgcgcgcctcgccgaggtgctcgccgtgccctacatctccatgggcgcgctcctcaggcaggagctcaacccagcctcgcaactctacaggaaga

SEQ ID NO: 6935 - protein, 114 aa, Zea mays
  misc_feature: Ceres CLONE 344287-F
  misc_feature: SWISSPROT Homolog: EC 2.7.4.3 Adenylate kinase
MAALLRLAAARSALPRRALAPHRRLAAAAAAAMEEWWSDWEQDGEEEARASAPAAGLDPAGGGPGGVQWFVMGRPGPQKHAHAARLAEVLAVPYISMGALLRQELNPASQLYRK

SEQ ID NO: 6936 - DNA, 755 bp, Zea mays
  misc_feature: Ceres CLONE 344389
  misc_feature: Encodes the peptide sequence at SEQ ID NO. 6937
aaagccgagcaggaggcgacgaaaccaactgagggtgcgtgtcggatggcgaggccgagggaggaggagctcgtggaggccgcgctggtcgcggcggccgcagcgctgggcgcggcggccgttaagaggctggtggcgccgcccgagcccgtagctcccgtggtggtggcctgcgtcgctctccggtgccgtctcccgcgctgttcctgctcctcaacgtcatcatcgcgtctatcgttttggcgtccgtgcagccgcggcggggaggagcggcagcttcggcgtcgtccgcgggcgccatcgacgacgaacgggaggcgcggggagacgccgcgaagaggaggaggagcaagagcaagaagcggacggcggccgaggccgccgttccagatggctgctacatggcgctggtcgttacgggcgagccgatagagacggcggcggtgatggaggaggtggcggcggcagatgaggatgaggatgcggccgccgaggtgaacaaacgggctgaggagttcatctcggcgttccggcaccacctcagggtcgactcctcctcgtctactacaacccggcgaagcaacgctagagcggcggcaccatgctctatctagatagttmtggattgcaaacatatttttatggtttccccagtttcaaaggatttttaatttgtgctccaagtttttcttcttcttttgagttgtagttgtatactctmttaacgtcagtttcatccaaaaaaaaaaaaaaaa

SEQ ID NO: 6937 - protein, 128 aa, Zea mays
  misc_feature: Ceres CLONE 344389
MARPREEELVEAALVAAAAALGAAAVKRLVAPPEPVAPVVVACVALRCRLPRCSCSSTSSSRLSFWRPCSRGGEERQLRRRPRAPSTTNGRRGETPRRGGGARARSGRRPRPPFQMAATWRWSLRASR

SEQ ID NO: 6938 - DNA, 512 bp, Zea mays
  misc_feature: Ceres CLONE 344411-F
  misc_feature: Encodes the peptide sequence at SEQ ID NO. 6939
gccccaccctcggcgtcgcttccacccatccgccgcggctcgtctccgtctcccggctcggcgtctagctcgtcaacgcgcgcgtccgccgtcggctcctccgaccggcgtcccaccgcaggggatacagatcggcgatccgctgggcttgcaaacatgtatatccgagtgaagcgcaacaagagtacctacttcattcaatgtgaaccgacagagacagctttgagcatcaaacagaagttgcactcgctgatagatcaacctcctagtagtcagcagttggtcttgtggcctagcagtgatgtgcttgaagactcaaagactttggcagatcaaaaggtggataacgattccattgttgcattggcactaagaaaagatgacggtgagtttgaggaagttttcatcgccaggccagaggatttcatgtcatcatcatgataaagattagtccatcatttctacaaagggaccactgcgcgtcctttggagcggacggcgctctatgctga

SEQ ID NO: 6939 - protein, 94 aa, Zea mays
  misc_feature: Ceres CLONE 344411-F
  misc_feature (4)..(75): Pfam Name: ubiquitin Pfam Description: Ubiquitin family
MYIRVKRNKSTYFIQCEPTETALSIKQKLHSLIDQPPSSQQLVLWPSSDVLEDSKTLADQKVDNDSIVALALRKDDGEFEEVFIARPEDFMSSS

SEQ ID NO: 6940 - DNA, 487 bp, Zea mays
  misc_feature: Ceres CLONE 344466-F
  misc_feature: Translation starting site: 132
gcgttagcactagggtttcaccaggctcttaaggccgccgccgcctcggtgcttcctcgcttcgaagtgttcgtgcgaaggcgaccctccctccttcactccttccccgccgcctcccggccgtcgccgccatggtgaagtactcgcaggagccgggcaaccctaccaagtcggctaaggccatgggcagggatctgagggtccacttcaagaacacaagggagacagcctttgctcttcgcaagttgtctttgaccaaggctaagcgataccttgaggatgttattgctcacaagcaggcaattcccttccggagatactgtggcggtgttggtcgcaccgcgcaagctaagtctcgccactccaatgggcagggcccgctggcctgttaaatcagccgggttcatcctggatttgctgaagaatgctgagagtaacgctgatgtgaaaggcttggatgtggacaacctctatgtttcacacatcc

SEQ ID NO: 6941 - DNA, 510 bp, Zea mays
  misc_feature: Ceres CLONE 344512-F
  misc_feature: Encodes the peptide sequence at SEQ ID NO. 6942
atacggcataccacactagagccgccgccgccgccgtttcgcgcaccgtaccctagccctcgtcagcggcggcttcgagctcatccagccatgacgttcaagcggaggaatggcggacgcaacaagcacgggcgcggccacgtcaagtacatccgctgctccaactgcgccaagtgctgccccaaggataaggctatcaagcggttcttggtgaggaacattgttgagcaggctgccgtgagagatgtgcaggaggcctgtgtacatgatggatatgttctacccaaattgtatgcaaaggttcatcactgtgtctcatgtgcaatccatgcgcacattgtccgggtccgctctcgtgagaacaggaggaaccgtgagcccccgcagcgcttcagacgccgggatgatggcccaaggcctggtcagggcccgccgcgcccaggcggtgcagctcctgcagctgcagctgctgctgctcctcgtacctaagttctggaattagtttcgggg

SEQ ID NO: 6942 - protein, 132 aa, Zea mays; identical to SEQ ID NO: 6773
  misc_feature: Ceres CLONE 344512-F
  misc_feature (1)..(114): Pfam Name: Ribosomal_S26e Pfam Description: Ribosomal protein S26e

SEQ ID NO: 6943 - DNA, 463 bp, Zea mays
  misc_feature: Ceres CLONE 344526-F
  misc_feature: Encodes the peptide sequence at SEQ ID NO. 6944
tccatttcgactttcgagcgcagaaacgagagggccggagcagccgcagtcccggcgatcccgccgccggtcgccctcatacttcctcgtcactgccttcgtttctctttccaacaatcaagatgagccgtggcggtagcgcgggtggtggtcaaagttctctgggttacctctttggaagcggtgagccccccaaaccagcagtggcaccagctgtaagkgctccacctgctgctgcaggtgctccacctgctgagaaaccacctgctgcaaagcctgatggcaccagtcagattgctgctggggttaccagccaaaccaataactaccacagggccgacggtcagaacaccggaaacttccttacggaccgtccttcgaccaaggtccacgctgctcctggcggtggctcttccctgggatacctgtttggtggcaactgatgccgctcaccaagctatca

SEQ ID NO: 6944 - protein, 106 aa, Zea mays
  misc_feature: Ceres CLONE 344526-F
  misc_feature (33)..(33): Xaa is any aa, unknown, or other
MSRGGSAGGGQSSLGYLFGSGEPPKPAVAPAVXAPPAAAGAPPAEKPPAAKPDGTSQIAAGVTSQTNNYHRADGQNTGNFLTDRPSTKVHAAPGGGSSLGYLFGGN

SEQ ID NO: 6945 - DNA, 440 bp, Zea mays
  misc_feature: Ceres CLONE 344588-F
  misc_feature: Translation starting site: 269
  misc_feature: Pfam Name: UPF0220 Pfam Description: Uncharacterised protein family (UPF0220)
aaaaagaagagcagaacgacgaggagattgcttggtgggaggagttggtgaggagaggtcgcgaccatggagaaccttgctctgstttggggcatcatcggcccgggcgtgtccggcgccatcttcggggccggatagtggttctgggtggacgcggtcgtttgcagcgcggtccaggtctccttcctccactaccttccagggatcttcgcttcgctggcggcgctsatgttcaattgcgtgaacaaggatgagatcggatacgactatgtactcaccctacggggacgattcagagtggagagtgaagctctggctttttgtggcatatgtcgtttcttttgtctgtttagctggatccgtgggtttattggtgcaagatgcactgacgaacaagggcccttctgtctggactggtgttgctggcgttctgcaatgtg

SEQ ID NO: 6946 - DNA, 504 bp, Zea mays
  misc_feature: Ceres CLONE 344598-F
  misc_feature: Encodes the peptide sequence at SEQ ID NO. 6947
actctattcccattccaagcccccgctctcggattcccgacgacgagctcagagctcctcctctcctcccctgctcggtgttcgacgcaacagctgccgccatgtctgccgccaaccagctcgccgccctcttcagcaacatgtacgccacgggtttgcttgacgatcagttccagcagctccagatgctccagaacgccagtactcctgacttcgtctccgaggtcgtcacgctcttctgccaggacggcgagcggatcatcggagagctggccaaactgctggagaagcccaacgtggattttgacagggttgacgcctttgtgcatcagctcaaaggaagcagtgcaagtattggtgctcagaaggttaagaacacttgcattcagttccgcgaatcctgtcagcagaagagcaaagatggctgcagcgtcaggtcaatggctgtccccccagcaagtgaacaagatggtggagtggagcttcatgttgggatgatggcgt

SEQ ID NO: 6947 - protein, 134 aa, Zea mays
  misc_feature: Ceres CLONE 344598-F
  misc_feature (41)..(122): Pfam Name: Hpt Pfam Description: Hpt domain
MSAANQLAALFSNMYATGLLDDQFQQLQMLQNASTPDFVSEVVTLFCQDGERIIGELAKLLEKPNVDFDRVDAFVHQLKGSSASIGAQKVKNTCIQFRESCQQKSKDGCSVRSMAVPPASEQDGGVELHVGMMA

SEQ ID NO: 6948 - DNA, 476 bp, Zea mays
  misc_feature: Ceres CLONE 344604-F
  misc_feature: Encodes the peptide sequence at SEQ ID NO. 6949
ttcctcatccagtgttctgtcctagcgccgccgccgccccagctcgccttgcgtgactgagagctcgtcggcttccgtccacgcgtgaagcgagagcatggacacccaggtgaagcttgctgttgtggtgaaggtgatgggcaggaccggctccaggggtcaggtgacccaggtcagagtgaagtttttggatgaccagaaccggctcatcatgaggaatgtcaaggggcccgttcgcgagggtgacatcctcaccctgctcgagtccgagagggaggccaggaggctgcgctgaagccctagcgttcttggtgggctcttgtatggtctttggtgtcttggaatttgtgctatgtttgaacttctgtgaccctgttttaagagtagtaagcctggttataagattgcagttttgtttatcttggttgaaagtgcaattggtgttgagacatggttatccttgctatattatctat

SEQ ID NO: 6949 - protein, 65 aa, Zea mays; identical to SEQ ID NO: 5504
  misc_feature: Ceres CLONE 344604-F
  misc_feature (1)..(65): Pfam Name: Ribosomal_S28e Pfam Description: Ribosomal protein S28e

SEQ ID NO: 6950 - DNA, 412 bp, Zea mays
  misc_feature: Ceres CLONE 344796-F
  misc_feature: Encodes the peptide sequence at SEQ ID NO. 6951
attaatggagctgctttgcacgggcggcagagagccgtagacagagcagtgacggtcgtcgtacacagatcacgatgctgctcccacactcttcgtcagcctctgcaactgctaccactcgtgggctagcactagcagcagcagcaccgccgccgcgtccgaccgctcgcccccggcgcgcacgcctcctgcctccacgcgcgcgggccgagacgcatgcgacgggcgttggcgccgaccgcgcggccgaggcgcttctccagagcgggctgcgccgtgagtcgctgccgcggcacgtcgccggtggtgatggacgggaactcgcggtgggcgcgcgagcgggggctgacgcccgcggacggccacaaggccgggggccgcaacctggagcgggtcgttgcgctgtcgcgcg

SEQ ID NO: 6951 - protein, 34 aa, Zea mays
  misc_feature: Ceres CLONE 344796-F
  misc_feature: SWISSPROT Homolog: EC 2.5.1.31 Di-trans,poly-cis-decaprenylcistransferase
MDGNSRWARERGLTPADGHKAGGRNLERVVALSR

SEQ ID NO: 6952 - DNA, 461 bp, Zea mays
  misc_feature: Ceres CLONE 344905-F
  misc_feature: Encodes the peptide sequence at SEQ ID NO. 6953
atagattattttccgattcctcccgatttttggaaagcgaaggaaaactttcgattgtatttgtggccgtcaggtcggatgattcctgcttctccgatcctatcacatcgcgcactaccttccagcgaatccatcacggaagaaattgttccccacccaccctagactcgccgccgtcgcaactcccacccgatccccaaattctccggcggtgatggccagcctgtggcgcgccgtgatggatagcgtcagcggctcctccccctcggcgctggacgcggccccaggtagcggcgtcgagttctggcacggcgcagagcgcgctgggtggctaaataagcagggcgagtacatcaagacgtggaggcggcggtggttcgtgctgaagcaggggaggcttttctggttcaaggaccctgcggtgacacgggcctcggtgccccgcggcgtcatccccgtcg

SEQ ID NO: 6953 - protein, 82 aa, Zea mays
  misc_feature: Ceres CLONE 344905-F
  misc_feature: SWISSPROT Homolog: EC 2.7.11.1 Non-specific serine/threonine protein kinase
MASLWRAVMDSVSGSSPSALDAAPGSGVEFWHGAERAGWLNKQGEYIKTWRRRWFVLKQGRLFWFKDPAVTRASVPRGVIPV

SEQ ID NO: 6954 - DNA, 456 bp, Zea mays
  misc_feature: Ceres CLONE 344906-F
  misc_feature: Encodes the peptide sequence at SEQ ID NO. 6955
acataaccagcgcacagctctcgcattctctctcccatcggcacacccgagcttgcgccctccttccacgtcgaggtccgagtcctgctttgatggcgaccgacgtggctgagactcccgcgccgttggtggatgcggccccagaggctcccgctgacgccccggcggcgctgctgcggacgcgaagccggccaaggccaagaaggccgccgcaccgaagaagcgcgccagcccgacccacccgccgtacgccgagatggtctcggaggcgatcacgtcgctcaaggagaggacggggtccagcagctatgcgattgccaagttcgtggaggacaagcacaaggccaagctcccgcccaacttccgcaagcttctgaacgttcagctcaagaagctcgtcgcccggcggcaagctgaccaaggtgaagaactcgtacaagctgtcgtccgccacca

SEQ ID NO: 6955 - protein, 66 aa, Zea mays
  misc_feature: Ceres CLONE 344906-F
  misc_feature (1)..(54): Pfam Name: Linker_histone Pfam Description: linker histone H1 and H5 family
MVSEAITSLKERTGSSSYAIAKFVEDKHKAKLPPNFRKLLNVQLKKLVARRQADQGEELVQAVVRH

SEQ ID NO: 6956 - DNA, 487 bp, Zea mays
  misc_feature: Ceres CLONE 344913-F
  misc_feature: Encodes the peptide sequence at SEQ ID NO. 6957
  misc_feature (470)..(470): n is a, c, t, g, unknown, or other
acctcgaatagccagaaactatcgccagcaaagggagaacgccgaggtgagagagataatgcggtggtggtgctcatggtcggatgaatgggggtgtcgagctatgcgcggttgacgtcctcatcggagcaaaccccttcaccgttggttgccttgtaccgtggcctgggaagtcggtgactgctcatcatggtaggaggccccgaccgaccgtgcaaccgtgtgccgacgctgtggctgtgcgccaatgaaatcacgtgaggtcgtgagtcatctgaggatcatcctggtaactggaatctcaagtcccaggtcaagaacaggtaccgcaggatgaggcgcatgaaggatgctgtgatgtgttcgtgagagatctaggtcgtcgtctcccagtcaactttgggttgctggaccgttgtctccttataatgtaattatttacttatttatttgtacagaactcctattanataataaagatgtgaca

SEQ ID NO: 6957 - protein, 55 aa, Zea mays
  misc_feature: Ceres CLONE 344913-F
MNGGVELCAVDVLIGANPFTVGCLVPWPGKSVTAHHGRRPRPTVQPCADAVAVRQ

SEQ ID NO: 6958 - DNA, 512 bp, Zea mays
  misc_feature: Ceres CLONE 345014-F
  misc_feature: Encodes the peptide sequence at SEQ ID NO. 6959
ctctcgcccctctctcccaccccgcagccgccctagcacccgcgacgagcaggatctgcccagttgctcttgcggtagttcccccaactgtcaccatgcagaacgaggagggtaagactgtggacctctatgtccccaggaagtgctcggccacaaacaggatcatcactgccaaggaccatgcctctgtccagatcaacattggccacttggatgcgaatggcctgtatgatggtcacttcacaacgtttgctctctctgggtttgtccgtgctcagggtgacgcagacagctccttggacaggctgtggcaaaagaagaaggctgatatcaagcagtagattttacatctagtttaccaagaattggacaccgccttagctatgttttgaattcatgtcactatatgcaatgttgtgatttcagctggtaccttaaatctgaagatttagtayttttgttgggttccttctgagtttgatgtgtggtgttcgtttaattcccttgtacaa

SEQ ID NO: 6959 - protein, 81 aa, Zea mays
  misc_feature: Ceres CLONE 345014-F
  misc_feature (1)..(81): Pfam Name: Ribosomal_S21e Pfam Description: Ribosomal protein S21e
MQNEEGKTVDLYVPRKCSATNRIITAKDHASVQINIGHLDANGLYDGHFTTFALSGFVRAQGDADSSLDRLWQKKKADIKQ

SEQ ID NO: 6960 - DNA, 559 bp, Zea mays
  misc_feature: Ceres CLONE 345026-F
  misc_feature: Encodes the peptide sequence at SEQ ID NO. 6961
agcccgatgcgaaaatgcttgaagcctccaagaatctgggtgcaccgctgaggcgctgaccaccacgcaccacctcaccagatctttcttcctgttgcttcctcggctggtttccttctctcgccgcgtcgcctgcttcttcccccaaccaaagacacgaatcagccatggcgctcgcctccgccacgtcccgccccctcctcggtcgccccgccggcaccgcgcggccccacctcgccgtttcctcatcctcccccgcctcctcgatccgcttcccccgcggcgccgacggcggcgccagcagagcggccgtctctctccgcgcccccacgcctccagcggcggcaacagcaacatctggtagcattgctccagcaatttcattgactgaaaaggccttgaaacatctgaaccaaatgagagctgaacggaatgaagttttgtgcttgagaattggagtgaaacagggtggatgctcaggcatgtcttacaccatggaatttgaaaatcgagagaatgccagccctgatgawtctgttgtagagtatgatggttttgc

SEQ ID NO: 6961 - protein, 47 aa, Zea mays
  misc_feature: Ceres CLONE 345026-F
  misc_feature (39)..(39): Xaa is any aa, unknown, or other
MRAERNEVLCLRIGVKQGGCSGMSYTMEFENRENASPDXSVVEYDGF

SEQ ID NO: 6962 - DNA, 468 bp, Zea mays
  misc_feature: Ceres CLONE 345056-F
  misc_feature: Encodes the peptide sequence at SEQ ID NO. 6963
gataaaccacagagccaccccactaactactttcaccattgtttccagaaaaatctccgcgcataatatttctctagagcaaacgctctgtcatcacacaacactagttcgtccgcacgacactcccgcagttcctcgacaggggagaggtttccattccaggcggttgcggttgcggttggcggcggagatgagccgggggagcaagctccggtggctgtggcgcgcgccggcgcgggcgctggggcgggcgcgggacctgtacgtgcgggggctgacggggtgcgcgcgccacgtcccctccgacgccgcgttcgggtaccccgtgttcgtgccggcgccgctgtccaggagccacagcgccgtcggctggggcgccgggtcgtccgaggccgacgaggacctgcgcgagctggtccgcgccgcgtcgcagcgcccgcgtggagcagcggcgcgccgagctgcagg

SEQ ID NO: 6963 - protein, 92 aa, Zea mays
  misc_feature: Ceres CLONE 345056-F
MSRGSKLRWLWRAPARALGRARDLYVRGLTGCARHVPSDAAFGYPVFVPAPLSRSHSAVGWGAGSSEADEDLRELVRAASQRPRGAAARRAA

SEQ ID NO: 6964 - DNA, 526 bp, Zea mays
  misc_feature: Ceres CLONE 345231-F
  misc_feature: Encodes the peptide sequence at SEQ ID NO. 6965
attccccgccgcctcgcgcccccgctcgcttcacttctctaggtgcgcaccgatcagaaggtgcctgcctcctcctcgtcggcgaaaagatggcggtgccgctgctgacgaagaagatcgtgaagaagcgggtcaagcagttcaagaggccccacctcgaccgctacaagtgccttaagccaagctggcgcaggccaaagggtattgattcccgtgtcaggaggaagttcaagggatgcaccttgatgcccaacattggttatggttctgacaagtcgaccaggcactacctccccagcaagttcaagaagtttgtggtccacaacgtttctgagctggagttgctcatgatgcacaacaggacctactgcgctgaaattgctcacaacgtgtccaccaagaagcgcaaggagatcgtggagcgtgctgcacagctcgacattgtggtcacaacaagcttgctaggctccgcagccaggaggacgagtagtctggtttcctgtcttaacgacgaactggatgttgc

SEQ ID NO: 6965 - protein, 145 aa, Zea mays
  misc_feature: Ceres CLONE 345231-F
  misc_feature (14)..(123): Pfam Name: Ribosomal_L32e Pfam Description: Ribosomal protein L32
MAVPLLTKKIVKKRVKQFKRPHLDRYKCLKPSWRRPKGIDSRVRRKFKGCTLMPNIGYGSDKSTRHYLPSKFKKFVVHNVSELELLMMHNRTYCAEIAHNVSTKKRKEIVERAAQLDIVVTTSLLGSAARRTSSLVSCLNDELDV

SEQ ID NO: 6966 - DNA, 178 bp, Zea mays
  misc_feature: Ceres CLONE 345319-F
aaygagaagagcggcggcscgggcggacaaggagcaggcggargargagctgtgccaagccacaatgggtatctcacgcgactcgattgcacaagcgccgtgccaccggtggaaagcagaagagcctgggaggaagaagcgaaagtatgagcttggtcgccagccgggcyaacaccaa

SEQ ID NO: 6967 - DNA, 412 bp, Zea mays
  misc_feature: Ceres CLONE 345331-F
  misc_feature: Encodes the peptide sequence at SEQ ID NO. 6968
aaaaaaaacatgatcgatcgatcgaccccgcgcgccagccatgcagatgcaggccctcgccctgcccacgatggagtcggagctgagggctctcgcgtgggcgacgttgctcaccccagcgtgcgcggtgtacgcgcggttcgccgctcgccgccttcgccccggcgtcccgcgcctggccgcgctcttcccgacattcccggtgttcgtgtacatgccctggatgttcaactccctccacctgcgcctcttctccaccttcttccacacctggctggccatcaacaggctcgtcctcctcgcgctcgacctcggcccgctccacccgcgcctcccgctcctgccgttcgtcctctgcgccggcctccccatcaaggtccgtctccagcagccgacgaagaaccaagcgtcg

SEQ ID NO: 6968 - protein, 124 aa, Zea mays
  misc_feature: Ceres CLONE 345331-F
MQMQALALPTMESELRALAWATLLTPACAVYARFAARRLRPGVPRLAALFPTFPVFVYMPWMFNSLHLRLFSTFFHTWLAINRLVLLALDLGPLHPRLPLLPFVLCAGLPIKVRLQQPTKNQAS

SEQ ID NO: 6969 - DNA, 405 bp, Zea mays
  misc_feature: Ceres CLONE 345385-F
  misc_feature: Encodes the peptide sequence at SEQ ID NO. 6970
aaccaaaaccaaatccagaactctccctgggaatttggtggccgatttgccgccgcgtgggtgtggtggggcatgcgccgaacgactcctgcgtcggagctcaagcgcctcggggtctccagcaatggtatgaccatcatcggagctcgctgctcgtggatggtggcgaggcaacgtcgccagctccatcctcgtcacacccgcggtcaagagcaggtaccacaggatgaggcgcatggaggatgctgtgacgagttcgtgagaggtctaggccgtcgtctcccagtcaactttgggttgctggaccgttgtctccatataatgtaattatttatttattttgtacaaaactccgattatatagtaaagatgtgacattcgatccaaaaaaaaaaaaaaaaaagg

SEQ ID NO: 6970 - protein, 108 aa, Zea mays
  misc_feature: Ceres CLONE 345385-F
NQNQIQNSPWEFGGRFAAAWVWWGMRRTTPASELKRLGVSSNGMTIIGARCSWMVARQRRQLHPRHTRGQEQVPQDEAHGGCCDEFVRGLGRRLPVNFGLLDRCLHIM

SEQ ID NO: 6971 - DNA, 695 bp, Zea mays
  misc_feature: Ceres CLONE 345427-R
caaattgggtaccgggccccccctcgaggtcgacggtatcgataagcttttttttttttttttttaaaaatcattttttataaaagggtatcaagggatggtaatcaatttttcaagaaaggaaatgcatcaattgttcagcacacagctcatatcacctaatgcgtcatataaggtgataaagattttaaaaaaacaaggaaaagggataatgcactggggcttgcctgtaataacactaggttagtatttgttagacgacgatcacttgacaaccatcctttgtcttggtactcgttcaaattatccatcttcaggttcatccgactgatgacatcgtcttgcggagatgtccaatctctgcattatcctggggtcgacttgggtcgtcttccgcatcatgtgattaattattgtaccataatcaactcgactcaatatttgcaagaacgacgacagtctccgattgaagtcttcgatcgaacgcccgatgagcgaagcatcggaacgccaccttcttcttttcctaaacaccctgatatttctcattgggcaaatccgatgtgaactccgtaagaaccacgataattcctagttcaagcttttcatcgagcatttagtggcgtcgcacaggggccttcttcagttcagcatccaactggtgagtactagagcagcatcttgcgaggtgtgag

SEQ ID NO: 6972 - DNA, 1143 bp, Zea mays
  misc_feature: Ceres CLONE 345448
  misc_feature: Encodes the peptide sequence at SEQ ID NO. 6973
gcaggtccttctcttcgtagccattgttgcctagttagacagctcgccgcacgtctcgttgttttcatccatgtacgcggcgccgacggcagcaacgacgatgccgccagccgtgacccacgacgacctgtccctgcgcaaggcgcaggagcggcgcgccacgcggtccagcggccaggtcgccgtatccctcgtcgcgctctccgtgctctgcggcctcgttgccttcatcctctgcctcagccgccgagggggtcgcgctcagagggtgtcgcactacctcatgagcgtgggcggtagcaaggaccagctggacgtgtgcgtctacaacagcagcggccgcctcgcgctcgcgtacgccgtcggcgccttcatcctcctcgccgtcgccatgttcgccgagcacgcctacatgctggtcgccgtcgccgccccggagtccgcctccgccggcatggccgtcgcccaggaccacccgcgcgtcgcgtccaccgccgccgcgctcacctggcagacgggctgcctcttcttcctcacgtggatttgcttcgggcttgccgaggtgatgctcatgatcggcatcgccgtggagtccggccacatgagcgactggcggaagccgcggcccgtgtgccaccgggtgcgcccggggatgttcgcggcagcggggatcctggggctcatcaccgtcgtggtcggcttcgtggtctacatcacagctgtgcaggcacagcggctgaggggacagcagtaccagcacggcggcgttcacttcgtcggctacggcgctccccatccgggcgcccagcaccagcaccagcacctgcgcccgccagtgccgcacccacacgggccacaccctcatccggtgccgtccgcgccaggagcgccggagataacagcggcgccgtgccaagtgcaacccagctgtgcgtctttcatcaccaaggaggccttcgacgtgtgaaaaggctagtcagaaagaccaaaacgtcaaacgggagcgcccagccccaactacggctatattctttgcctccttgtttaagtttatttgtttattggaccgaggtattgctttgtaaatgtcaaaaaaaacacataactgttgagcggaaatttgttgtaaaaaaaaaaaaaaaa

SEQ ID NO: 6973 - protein, 298 aa, Zea mays
  misc_feature: Ceres CLONE 345448
  misc_feature (84)..(214): Pfam Name: DUF1218 Pfam Description: Protein of unknown function (DUF1218)
MYAAPTAATTMPPAVTHDDLSLRKAQERRATRSSGQVAVSLVALSVLCGLVAFILCLSRRGGRAQRVSHYLMSVGGSKDQLDVCVYNSSGRLALAYAVGAFILLAVAMFAEHAYMLVAVAAPESASAGMAVAQDHPRVASTAAALTWQTGCLFFLTWICFGLAEVMLMIGIAVESGHMSDWRKPRPVCHRVRPGMFAAAGILGLITVVVGFVVYITAVQAQRLRGQQYQHGGVHFVGYGAPHPGAQHQHQHLRPPVPHPHGPHPHPVPSAPGAPEITAAPCQVQPSCASFITKEAFDV

SEQ ID NO: 6974 - DNA, 499 bp, Zea mays
  misc_feature: Ceres CLONE 345449-F
  misc_feature: Encodes the peptide sequence at SEQ ID NO. 6975
gcgaaaggccagaagagcacacacaacacaggtacagctagcgcgcgcgggcggtgcggggctgtctggcaattacgcagccttggcagcttgcaccaccgcgcaagctagcgctgacggagggaacaagggcttgcgcgcgcacgcagggaggggagggaacgcctgccgccgatcgcctggtggatctcccggcggcgggggaagcagcagagaggggacggccagcagcgcaaccaatggcgccgccggacgcgggtgcggcagcagcgtgcggcgcgcggtgggtgaggcgggacacgctgctgggcctcgcgctgggccagttcgtctcgctgctcatcaccgccaccggcttcgcctcctccgaactcgcccgccgagggatcaacgcgcccacctcgcagtcgctcctgaactacgtcctcctcgccgtggcctacggcggcgtcctcctctaccggcggcagccactcacgataaaatggtactactactt

SEQ ID NO: 6975 - protein, 86 aa, Zea mays
  misc_feature: Ceres CLONE 345449-F
MAPPDAGAAAACGARWVRRDTLLGLALGQFVSLLITATGFASSELARRGINAPTSQSLLNYVLLAVAYGGVLLYRRQPLTIKWYYY

SEQ ID NO: 6976 - DNA, 474 bp, Zea mays
  misc_feature: Ceres CLONE 345452-F
  misc_feature: Encodes the peptide sequence at SEQ ID NO. 6977
gatttgtctcctgaagcaagcgcagcaatgccagctcttcccgcttttcccctcacccgccgcccatccgatgccagacgccgcggtcgcctcgtcctttccctcgtcgtcttcgttgctgtctccgccgccgcagccctcgcctacctatctttcccctctgccgggcggacatcgcccccggcggtccggacggaggtcgactgctgcaggggtatggagggcctcgagctctggggcccggcggtcaagtggggctcagaccaccgcctgccctccgccgccgcctgctgcgccgcctgcaaggccatgtgccctcaccctaaggacggggcctgccgctgcgactcgtgggtcttctgcggtgacgagcgcaaatgcaaggacaggctcggggagtgctggctgaagaaacagaaggatgtcatggcccctgctgttattgcaaagggggaggacgtcatgtggacttct

SEQ ID NO: 6977 - protein, 149 aa, Zea mays
  misc_feature: Ceres CLONE 345452-F
MPALPAFPLTRRPSDARRRGRLVLSLVVFVAVSAAAALAYLSFPSAGRTSPPAVRTEVDCCRGMEGLELWGPAVKWGSDHRLPSAAACCAACKAMCPHPKDGACRCDSWVFCGDERKCKDRLGECWLKKQKDVMAPAVIAKGEDVMWTS

SEQ ID NO: 6978 - DNA, 504 bp, Zea mays
  misc_feature: Ceres CLONE 345559-F
  misc_feature: Encodes the peptide sequence at SEQ ID NO. 6979
aaaaaggccatcttctcttcctctcgcgtagcaccgcctctcaacctccgccgccgctcgcccggggcgtcacccacccgcgcagaaggcccccgccgctcaaattaccggtgccctaaaccccgatatcttcttcgcctccctttcctcctcagcaccccaaaccctgaccttcagggttccgccgccatgccgcagggagaccacatcgagcttcaccagaagcgccatggcaagcgcctggaccacgatgaacgcaagcgcaagcgcgaggcgcgcgaggtgcacaggcgctcgaaggacgcccgcaatttgattggtgctaagggcaagaggttcgccaagaaacgctatgctgagaaggcgcagatgaagaagaccctgaaaatgcatgatgaatcaaataagcgacagaaggttgatgaygatgtccaagagggtgctcttcctccttatctactcgatcgtgatcagacacagcgtgccaaggtactcagcaacaca

SEQ ID NO: 6979 - protein, 105 aa, Zea mays
  misc_feature: Ceres CLONE 345559-F
  misc_feature (1)..(104): Pfam Name: Ribosomal_S8e Pfam Description: Ribosomal protein S8e
MPQGDHIELHQKRHGKRLDHDERKRKREAREVHRRSKDARNLIGAKGKRFAKKRYAEKAQMKKTLKMHDESNKRQKVDDDVQEGALPPYLLDRDQTQRAKVLSNT

SEQ ID NO: 6980 - DNA, 500 bp, Zea mays
  misc_feature: Ceres CLONE 345584-F
  misc_feature: Encodes the peptide sequence at SEQ ID NO. 6981
atcaaacagctaatatcgtcgttcgttcctcaactgatcttaatcgtcgagaagttaccagctagcggagatcatcggcaatgtcgaacatggggcaatccttccaggccggcaaggcgcaggcccagggcgagtgccaggcggagcgcgcagcgcagtgcgtcagggacggcgccggcgccacggctgcgccgtgaccgacaccgccggagccgcggccgacagcgcgcagctgcaggagcaccgcgccgccggcaccgttcagcaggctgctgagcaggtggcgcagacggcggcgggcgcggcggcagccgtcaaggacacggtggcgggcgcggcggcggccgtcaaggacacggtggcgggcgcggcggcaggcgccaatgacgcggtgaccggcggccactgaccgactcacgcgtgtgaaccggacggcgtaccagcaatgctgcatggccaagggttgcgcctcaagatggctactaaatttcccccttttc

SEQ ID NO: 6981 - protein, 38 aa, Zea mays
  misc_feature: Ceres CLONE 345584-F
MSNMGQSFQAGKAQAQGECQAERAAQCVRDGAGATAAP

SEQ ID NO: 6982 - DNA, 429 bp, Zea mays
  misc_feature: Ceres CLONE 345713-F
  misc_feature: Encodes the peptide sequence at SEQ ID NO. 6983
atccgtctcctgcactgaccttttcctccacgtctcccgcaactgcaagcaaccactgatccagcccgttctatgtcccggcgaatggtgacgaaccaggacgcggaggcggcagcgccaggggcaggggcggcggtagatccgatgcggctagcatcgcggtggcggcgatcccggccagagtggaactgcgcgtcggcggagctggaggctgagccgtccgagctcaacaccgtcaacagctcgggactcttctccgtcgtctctaccgacaagttatcggtaaaatacctcggcagccatcaccacggccacgacgtcggtgtcgtgcaggccgaccgtcccgcgccgacgcgccgagccgtgtactacttcgagatgggcgtcmggaaygcctggatacmaggggcagacatccattgggttcac

SEQ ID NO: 6983 - protein, 115 aa, Zea mays
  misc_feature: Ceres CLONE 345713-F
  misc_feature (107)..(107): Xaa is any aa, unknown, or other
MVTNQDAEAAAPGAGAAVDPMRLASRWRRSRPEWNCASAELEAEPSELNTVNSSGLFSVVSTDKLSVKYLGSHHHGHDVGVVQADRPAPTRRAVYYFEMGVRNAWIXGADIHWVH

SEQ ID NO: 6984 - DNA, 411 bp, Zea mays
  misc_feature: Ceres CLONE 345717-F
  misc_feature: Encodes the peptide sequence at SEQ ID NO. 6985
tcaaaaaacctccatcacccgcctccactcccccctcccaggtgctgcccaggtaagtcggcggcggcgatgacaacgcgcttcaagaagaaccgcaagaagctcggccacgtgtccgccgggcacggccgcatcggcaagcacaggaagcacccgggaggtcgcggtaacgccggtggcatgcaccaccaccgtatcctcttcgacaagtaccatccgggctacttcggcaaggttggcatgcgttacttccataagctccgcaacaagttctactgccccgcggtcaacatcgagcgcctctggtcgatggtgcccaccgacaaggcggcggaggccggcggcgacaaggccccgcagatcgacgtcacgcagttcggctacttcaaggtgctcgggaagggggtgctg

SEQ ID NO: 6985 - protein, 114 aa, Zea mays
  misc_feature: Ceres CLONE 345717-F
MTTRFKKNRKKLGHVSAGHGRIGKHRKHPGGRGNAGGMHHHRILFDKYHPGYFGKVGMRYFHKLRNKFYCPAVNIERLWSMVPTDKAAEAGGDKAPQIDVTQFGYFKVLGKGVL

SEQ ID NO: 6986 - DNA, 316 bp, Zea mays
  misc_feature: Ceres CLONE 345727-F
  misc_feature: Encodes the peptide sequence at SEQ ID NO. 6987
tacatcgcgaagggcggcaaggcagatccagggcgatcatggcttacgtcgagagaggtgttctgaaagacaaacggactatatggcgactgagcataatctcagacttcttctgggccattgtgagctttatcagaatcttctttgacacactgttctcattggacaaaactgacaacttcaagaaagggtatggtgctggtaagaagtgggatggtggacctggtggtggtgggcggggcccatatggcggtggaggaggtggaggattcggcggcggaggtggaggtggttcgtgtttgagaaacaaaaaaaa

SEQ ID NO: 6987 - protein, 92 aa, Zea mays
  misc_feature: Ceres CLONE 345727-F
MAYVERGVLKDKRTIWRLSIISDFFWAIVSFIRIFFDTLFSLDKTDNFKKGYGAGKKWDGGPGGGGRGPYGGGGGGGFGGGGGGGSCLRNKK

SEQ ID NO: 6988 - DNA, 464 bp, Zea mays
  misc_feature: Ceres CLONE 345738-F
  misc_feature: Encodes the peptide sequence at SEQ ID NO. 6989
acggacgcttcgctctagtcggaaggtttcgaggaactcccgggctcgaggagatcgggacgatgatgggagggcgcgctctgctgctgctcctggtctcggcgctgctcgttcagatccgcgcctctgacccgctgctgtacgagccgtttgatgaggacttcgagggtagatggatcgtctccaagaaggatgaataccaaggtgtatggaagcatgccaagagtgatgggcatgaggactatggcctccttgttagtgacaaggcaaggaaatacgccataatcaaggagcttgatgagccagttaccttaaatgatgggacagtggtcctgcagtttgaagtgagacttcagaatggccttgaatgtggaggtgcctacattaagtacatccgccctcaggatgctggatgggatgccaaggagtttgataatgagactccatacactattatgtttggt

SEQ ID NO: 6989 - protein, 134 aa, Zea mays
  misc_feature: Ceres CLONE 345738-F
  misc_feature (24)..(134): Pfam Name: Calreticulin Pfam Description: Calreticulin family
MMGGRALLLLLVSALLVQIRASDPLLYEPFDEDFEGRWIVSKKDEYQGVWKHAKSDGHEDYGLLVSDKARKYAIIKELDEPVTLNDGTVVLQFEVRLQNGLECGGAYIKYIRPQDAGWDAKEFDNETPYTIMFG

SEQ ID NO: 6990 - DNA, 406 bp, Zea mays
  misc_feature: Ceres CLONE 345739-F
  misc_feature: Encodes the peptide sequence at SEQ ID NO. 6991
ataggaggccaggaggggagaaaggcgaactcgaattgggggaagagagcgagagacgaatcgcatcgagccggagaggatcgtcagagacagggaggagggcggcggaatcggcgccggcgggaggcaggcatggaggacttgagcgtggaggagctcgcctccaacctctccacctacaaagagcagctacgcgaggtcaagaagcttatcaaggagaagaaggatgatgctggaatttctgaatatattgatatggagaaagagcttcaagaggtcataacgttaaccgaagagattttggcaacttttgagtgtggaaatggattggaatagtcgccatgaatttgctggctactttatacatgtctttgttcataaaccttgttttaagatgaaaaaaaaa

SEQ ID NO: 6991 - protein, 67 aa, Zea mays
  misc_feature: Ceres CLONE 345739-F
MEDLSVEELASNLSTYKEQLREVKKLIKEKKDDAGISEYIDMEKELQEVITLTEEILATFECGNGLE

SEQ ID NO: 6992 - DNA, 484 bp, Zea mays
  misc_feature: Ceres CLONE 345743-F
  misc_feature: Encodes the peptide sequence at SEQ ID NO. 6993
aagaacattcgattctaaaatttacaatttacaatttacagctgtgcggaggcgggagcagggggcagcgagcacctagcagcgcgcggccggcgactccaccgagacacctcagccggccgcgcggtcgcggttgcctccggctggctcctcgcctcgatggtggggatgtaccagcaccaactccgcgacgaccccttcgacaccctaagcggcggccactgcggtgagcagccacgcgttgccggcggcggcgcctcctcctcctcaccctcggctgttcatgacccgctgtctgcataggtacatggcggcggacagccgcggcagcgggtcgaggcgcttgccgacggaagaagcatgttgcgcggcgggrgaagcggtatagttggcgccgcgggtggagatctaggggtgctagtgcggtggatgcgggaactcgcagcggawcccgtgggtccactttccggcgccatcagagcac

SEQ ID NO: 6993 - protein, 47 aa, Zea mays
  misc_feature: Ceres CLONE 345743-F
MVGMYQHQLRDDPFDTLSGGHCGEQPRVAGGGASSSSPSAVHDPLSA

SEQ ID NO: 6994 - DNA, 458 bp, Zea mays
  misc_feature: Ceres CLONE 345853-F
  misc_feature: Encodes the peptide sequence at SEQ ID NO. 6995
tagtaaaggatatgatggtaaagatgtggtggtccagaacttgcgccaagtttgtgtctttaaggttgctaaggagcacragaagccttgsttatggtgggactatrrttactattttgcgattcggtgtccaatgaaggaaaagaagtacacaaaggagtgtgctgatggtgttatcaagtctcttggccttgatcataaagcaatagataaatgtattggtgatccagatgctgatgaagaaaaccctgttctgaaagctgaacaggatgcacagattggcaagggctctcgtggtgatgttaccatcttaccaactctggtaattaacaatagacaatacagaggtaagcttgacaaaggagcagttcttaaagcactttgtgctggttttaaggaaactactgagccagccgtttgcttgagtgaagatatacaaacaaatgagtgcctagaga

SEQ ID NO: 6995 - protein, 152 aa, Zea mays
  misc_feature: Ceres CLONE 345853-F
  misc_feature (27)..(27): Xaa is any aa, unknown, or other
  misc_feature (30)..(30): Xaa is any aa, unknown, or other
  misc_feature (36)..(36): Xaa is any aa, unknown, or other
SKGYDGKDVVVQNLRQVCVFKVAKEHXKPXLWWDYXYYFAIRCPMKEKKYTKECADGVIKSLGLDHKAIDKCIGDPDADEENPVLKAEQDAQIGKGSRGDVTILPTLVINNRQYRGKLDKGAVLKALCAGFKETTEPAVCLSEDIQTNECLE

SEQ ID NO: 6996 - DNA, 495 bp, Zea mays
  misc_feature: Ceres CLONE 345887-F
  misc_feature: Encodes the peptide sequence at SEQ ID NO. 6997
aaaaaggcaacgacccaagtcccaacggaacttagctgccgagcgcccaaagccccaccgcctctcccatcaagcggcgctaaaggtttcctcgcccgcaacgcgatgccgaagaacaagggaaagggaggcaagaaccggaagcggggcaagaacgaggcggacgacgagaagcgggagctggtgttcaaggaggacgggcaggagtacgcgcaggtgacgcggatgctgggcaacggccgttgcgaggcgctctgcatcgacggcaccaagcgcctctgccacatccggggcaagatgcacaagaaggtgtggatcgccgccggggacatcgtgctcgtcggcctgcgcgactaccaggacgacaaggcggacgtcatcctcaagtacatgaacgacgaggcccgcctgctcaaggcctacggcgagatccccgacaacgtcaggctcaacgagggcgtcgttgatgaggaggaagccggcgcgcaggatgac

SEQ ID NO: 6997 - protein, 130 aa, Zea mays
  misc_feature: Ceres CLONE 345887-F
  misc_feature (30)..(94): Pfam Name: eIF-1a Pfam Description: Translation initiation factor 1A / IF-1
MPKNKGKGGKNRKRGKNEADDEKRELVFKEDGQEYAQVTRMLGNGRCEALCIDGTKRLCHIRGKMHKKVWIAAGDIVLVGLRDYQDDKADVILKYMNDEARLLKAYGEIPDNVRLNEGVVDEEEAGAQDD

SEQ ID NO: 6998 - DNA, 512 bp, Zea mays
  misc_feature: Ceres CLONE 345888-F
  misc_feature: Encodes the peptide sequence at SEQ ID NO. 6999
caggatcccgttctcagtcgccagccactggtcacagccaccgtctccctccttccccaacctcgccgctatcaggtggtggatgcagcagcgcggccgctccttcaacagccgctctcggagcttctcccgcgcccgcgtcgccatcgagggatcttaatctcacagccatccctcgatcatttcgtttgaactcggttctgaaattctgactgacgaacgcacgcaacgacctaccgtgatggacgccgccgccgccgccaccgttgtttctcttaacgggaagatgggggccgaggagaggaaggcgcagaagagctactgggaggagcattccaagaacctcaccgtcgaggccatgatgctggactcccgcgccgctgatctcgacaaggaggagcgccctgagcagcctgcactcagcaattttccaaaggagctctcatgggaggagcggtcacaggctcttatctataagaaactgtggtttgatgcagaacgcacaaactgtg

SEQ ID NO: 6999 - protein, 90 aa, Zea mays
  misc_feature: Ceres CLONE 345888-F
  misc_feature: SWISSPROT Homolog: EC 2.1.1.103 Phosphoethanolamine N-methyltransferase
MDAAAAATVVSLNGKMGAEERKAQKSYWEEHSKNLTVEAMMLDSRAADLDKEERPEQPALSNFPKELSWEERSQALIYKKLWFDAERTNC

SEQ ID NO: 7000 - DNA, 526 bp, Zea mays
  misc_feature: Ceres CLONE 345898-F
  misc_feature: Encodes the peptide sequence at SEQ ID NO. 7001
acacacacacacagcaccatgcttcacaggaggagccgcacgctgggagggagctccgatcgacctgcgcgccgagctgtcgcggtgaagagcgggagggggagcaatggcgcggccacggacctgctcgtctgcttcccgtcgcgggcgcacctcgccctcatgccgcccaaggccatctgcagcccgtcgcggccgtcggcgtccgagccggtcaagcgccggcacagcaccagccggccgcccagcgggctctacaagtcggccgcggccaggaacccgagccgccgcggcgcggacgtccccgtggacgacgagcccacgtcgcccaaggtgacgtgcgcggggcagatcaaggcccgccaggccaagcccaagggccccgggcccggcggtggcggtggcaagaagaccaagaaggccacgtggctgcaggcgctggggmtcaagaaggacgcactggcgctcttggacgccctgcacggcgctttcaggttcaacgttgccggatgcttcggcagcttcc

SEQ ID NO: 7001 - protein, 169 aa, Zea mays
  misc_feature: Ceres CLONE 345898-F
  misc_feature (143)..(143): Xaa is any aa, unknown, or other
MLHRRSRTLGGSSDRPARRAVAVKSGRGSNGAATDLLVCFPSRAHLALMPPKAICSPSRPSASEPVKRRHSTSRPPSGLYKSAAARNPSRRGADVPVDDEPTSPKVTCAGQIKARQAKPKGPGPGGGGGKKTKKATWLQALGXKKDALALLDALHGAFRFNVAGCFGSF

SEQ ID NO: 7002 - DNA, 509 bp, Zea mays
  misc_feature: Ceres CLONE 345916-F
  misc_feature: Encodes the peptide sequence at SEQ ID NO. 7003
attttgcgacaattcatctgcatacaggggcaacatatctagcagctactccgcccccaaatgctcgccggcatatcccgtttcctcactcgccgccgcccgccctttccgcttgccgctaccgcgctgcagcagccatgtcgtcgtcgtcgtccacggcagcgaacatctccgagcgtccgatctctccggacaccacccgcgtggcctgggtggggacgggcgtcatgggccagtcaatggccggccacctcctcgccgccggctacgctctcaccgtcttcaaccggacggcatccaagacccagggccttgtctcccgcggcgccagcctcgcggacagcccgcgcgcggccgccgcggctgccgatgtcatcttcctcatggtcggtttcccctccgacgtccgctccaccgccctcgatccatccacaggcgccctctccggcctcaccccaggcggtatcctcgtcgatatgaccacttccgaccccaccctcgccgccgag

SEQ ID NO: 7003 - protein, 124 aa, Zea mays
  misc_feature: Ceres CLONE 345916-F
  misc_feature (20)..(124): Pfam Name: NAD_binding_2 Pfam Description: NAD binding domain of 6-phosphogluconate dehydrogenase
  misc_feature: SWISSPROT Homolog: EC 1.1.1.60 2-hydroxy-3-oxopropionate reductase
MSSSSSTAANISERPISPDTTRVAWVGTGVMGQSMAGHLLAAGYALTVFNRTASKTQGLVSRGASLADSPRAAAAAADVIFLMVGFPSDVRSTALDPSTGALSGLTPGGILVDMTTSDPTLAAE

SEQ ID NO: 7004 - DNA, 507 bp, Zea mays
  misc_feature: Ceres CLONE 345945-F
  misc_feature: Encodes the peptide sequence at SEQ ID NO. 7005
acgccagatcacggtggctctcctcgcatcttcctccactcgtctcctcttcccctccctcgcctcaaaacaaggaagggagcagatggagccgcatcattaaaaaaggacacggaaacttaatccgatccaccaaacaaaaatccctgtctctcgcgtagggcaccgccacgcgcgcctcatccggtaccgccatgacgagcgcctccgagctcttcatcgcgcgccgcgccgcccgtggggcccgcctctccgaccccgacccggacccggacccggacccgcaccccgtcgcgctccgggaccagcatggactcggcggccggcgccagcgccgcgggtgccgtccgcgacgccagctcgacgccgccggggacgtgcgccagcacctgcacaccggggccccgccaccgcgtcgccgcggatcgtacaccgatcagatcttatcctacatagacaataacaactttggagattctgcatctcggaggaacagactcgataggc

SEQ ID NO: 7005 - protein, 104 aa, Zea mays
  misc_feature: Ceres CLONE 345945-F
MTSASELFIARRAARGARLSDPDPDPDPDPHPVALRDQHGLGGRRQRRGCRPRRQLDAAGDVRQHLHTGAPPPRRRGSYTDQILSYIDNNNFGDSASRRNRLDR

SEQ ID NO: 7006 - DNA, 1154 bp, Zea mays
  misc_feature: Ceres CLONE 346002
  misc_feature: Encodes the peptide sequence at SEQ ID NO. 7007
agamyatttttgtctctcaaaayctgaccttttyttctccccgttttccttrtaccaggaaaagaactttckacmatggcagaggcagagtgccgcgcctcggactcggccgacggccccacctcggactcggccgacgacttcgagttctgcatcctgtcgtccggcggcatcgtcccggccggagagagcgcggggacggacatgtgcgtggccgacgaggtcttctgccagggcaagctcctcccgctccgcgcctcctcggccgcggccgccgacggcgccagcgtcgccacgctgccgaggtcggagtcagtggcctccaccgtgggccttgtgtcgcggtccggcagccgcagcgcgagctcgagctcgagcggcagcagcagcgggtgcgtgagccggagccagtcgtccaagagcgcctcctccgaccacggcgccggggcgcctccgccgcggcgctcgctgtcgagcagcctgttctacgcgcacccgagcccgtcgccgcggctgcgctcggcgcgcccgcgccgcagcaccgggtccgcgcagcccgccgcggcggcgtggggcctgtttcgcttccgcctcggcgtcgtcggcgccccggacgtgtacccgccgcgccccgcggccgatgccaagatcgccgccgcagcgaggggtggcggcagcaggagcgcgcggttcgagcaggtggccgccgccgtcgacaggaagctaggattagcggcgctgttcggggacaggctcggctgcaagtgctcgcccgacgccatcgtcgagcccgttcgcgcgcgcgtgccggaggcggcgaggcggagcagggagaaggacggcgccaagtgcggccgcggccggggccggggcgccgcccgtcgtaacaggatcctggactggctcgaagagctctccattgtgaaggataagaagtaggctggctggtgatcgctccgtcaagatcgtgcctttcttgaagcagtttgtctgtgtgtatgatcaaggaaaggattattaattttttttctttctttttagcattttttagattcttctatgtctgactaggaagcagtgcaccgatgctatgcagaagaattttaacagagcgatggtcaattgctcataagtttaaaaaaaaaaaaaaaaaa

SEQ ID NO: 7007 - protein, 287 aa, Zea mays
  misc_feature: Ceres CLONE 346002
MAEAECRASDSADGPTSDSADDFEFCILSSGGIVPAGESAGTDMCVADEVFCQGKLLPLRASSAAAADGASVATLPRSESVASTVGLVSRSGSRSASSSSSGSSSGCVSRSQSSKSASSDHGAGAPPPRRSLSSSLFYAHPSPSPRLRSARPRRSTGSAQPAAAAWGLFRFRLGVVGAPDVYPPRPAADAKIAAAARGGGSRSARFEQVAAAVDRKLGLAALFGDRLGCKCSPDAIVEPVRARVPEAARRSREKDGAKCGRGRGRGAARRNRILDWLEELSIVKDKK

SEQ ID NO: 7008 - DNA, 405 bp, Zea mays
  misc_feature: Ceres CLONE 346134-F
  misc_feature: Encodes the peptide sequence at SEQ ID NO. 7009
acaagcgcacgcactcctcgccgtggaccaactcccaagtccsatcccgtcctaactcccaagagccgaacgcgagcggcggcgccatggcgcggtgcagcaacggcctcctgggcctcctcaacgcgggcgtgctggtcctcgccatcgtcgcgctggggggcggcgcctggctcagccaccgcgcgtccaccaccgactgcgagcggttcctcgagcggcccgtcatagcgctgggcgtgctcctcctcgcgctctccctagcgggcctggccggcgcgctctgccgcgcctcctgcctcctctggctctacctcctcgcgcttttcctcctcatcctgctcctcttcgcattcaccgtcttcgcgttcgtcgtcaccaaccgcggcgccgggtgggtcgtct

SEQ ID NO: 7009 - protein, 106 aa, Zea mays
  misc_feature: Ceres CLONE 346134-F
  misc_feature (4)..(106): Pfam Name: Tetraspannin Pfam Description: Tetraspanin family
MARCSNGLLGLLNAGVLVLAIVALGGGAWLSHRASTTDCERFLERPVIALGVLLLALSLAGLAGALCRASCLLWLYLLALFLLILLLFAFTVFAFVVTNRGAGWVV

SEQ ID NO: 7010 - DNA, 393 bp, Zea mays
  misc_feature: Ceres CLONE 346151-F
  misc_feature: Encodes the peptide sequence at SEQ ID NO. 7011
accccggcggtcgcccggcgccgctgcaggccgcagttgtaggtacagggacaaatccccggttctttctccaccctccgaccggccggcggccgctgcaagtttcaccgcagttggcaactggcaaccccgctctgacctaggaggatgtcgggtttcggcgatgggtacgtggggacggcgcaggacgcggtgaagatccggcggctggagaagcagcgcgaggcggagcgccgcaagatcgaggagctcaagaacaagtccgcggacgggcagcccggcctcctccagttcggctccagcacctccgagattcttgagactgcatttaagaaggaaacagttggtctcgtcaccagggagcagtatgtcgagaagagggttaacattcga

SEQ ID NO: 7011 - protein, 82 aa, Zea mays
  misc_feature: Ceres CLONE 346151-F
MSGFGDGYVGTAQDAVKIRRLEKQREAERRKIEELKNKSADGQPGLLQFGSSTSEILETAFKKETVGLVTREQYVEKRVNIR

SEQ ID NO: 7012 - DNA, 382 bp, Zea mays
  misc_feature: Ceres CLONE 346206-F
  misc_feature: Encodes the peptide sequence at SEQ ID NO. 7013
aaaaaagctcgatcgcacgggagaagaggataagaggaagcgagtgggactgtgagtgagttggaaggaggggggtggcaatggcgttgcggaatggtggtggtggtggtggagcctgtcccgcggcggttgtgctggtggctgcggccgtcgcggcgctgctgggcgccggggtggcggcggcgaccaagttcgacgacgtggtgcagcccagctgggccaacgaccacgtggtgtacgacggcgacctcctcaagctccgcctcgactccagctccggcggagggttcgtgtcaaggaccaagttcctgtacggcaaggccagcgccgacctcaagctcgtgccgggrgactccgccggcgtcgtcacggcttttctatc

SEQ ID NO: 7013 - protein, 100 aa, Zea mays
  misc_feature: Ceres CLONE 346206-F
  misc_feature: SWISSPROT Homolog: EC 2.4.1.207 Xyloglucan:xyloglucosyl transferase
MALRNGGGGGGACPAAVVLVAAAVAALLGAGVAAATKFDDVVQPSWANDHVVYDGDLLKLRLDSSSGGGFVSRTKFLYGKASADLKLVPGDSAGVVTAFL

SEQ ID NO: 7014 - DNA, 661 bp, Zea mays
  misc_feature: Ceres CLONE 346208-R
  misc_feature: Pfam Name: UCR_14kD Pfam Description: Ubiquinol-cytochrome C reductase complex 14kD subunit
cgattggggtaccgggcccgccctcgaggtcgacggtatcgataagcttttttttttttttttttcttaacggcactcacgatcgaagatttcacaggttaataatggttgaagacaaatttgctgaaaacaacagctacagcccatggttaatgcaccatggcatgaacaagtaaaattagactttggttggaacaaaaaaaaacagtttcatccactgcattatatttgacgagtccagatttaccgtaaacaggtagaatacttgcgaccatgtctatccagcaccctagggaagtgtcctctggtataatggaagggctcccactgactgacgctcggagctttcctttttcaccaacgccaacatgtcactcaaatatcctctgaatggaacctgctgtgcctggaggtcctccgggacgcactggtgcttcatggagaggtccatggcacgcttgaggcgctggatgcgggcgtctaccacctccctaggcagcctaccgagcgcctccttgatgtccaaatcgaagtaggggtcgtagaggtcgtcgtacctgagtccgtatttgctgaggcgcgaggagaccgcttgcatgtggaggcgcgccaccgggttgcggcgcgggttccccagccagttccccagcgcgttcatcaa

SEQ ID NO: 7015 - DNA, 433 bp, Zea mays
  misc_feature: Ceres CLONE 346214-F
  misc_feature: Encodes the peptide sequence at SEQ ID NO. 7016
agccttctggaactctcccttccggttccttcctctccgcctccacggctccacctccagtcctccaccgctgctccacacgggcacacctttgcctcgcccaaccgctgcctcgctcgcgtccgccattccccagacctcgagagctaccgtctggtccgatcggacggaccccttcgcgcgccccagagatttcaggtaaggtgctgtaacagaagatgcaagggggaagaggtgggaggcagggcttattcggtttcggggacccttctggtggttccggtggctttggacaaccagggagccttatgcctggtttttttggtggcgcaaatccctttgacgaccctttcttcacaaacccctttggtagcatgatgcagactagtttctcagcccctttcagcggcatgatgcaacctagcttcatgaa

SEQ ID NO: 7016 - protein, 71 aa, Zea mays
  misc_feature: Ceres CLONE 346214-F
MQGGRGGRQGLFGFGDPSGGSGGFGQPGSLMPGFFGGANPFDDPFFTNPFGSMMQTSFSAPFSGMMQPSFM

SEQ ID NO: 7017 - DNA, 392 bp, Zea mays
  misc_feature: Ceres CLONE 346249-F
aatcgccgcgctccacgtgcaatctccgtctcccgcgacgtcacagctccggcagatgccgtcccacataaaaccgccccacctactactcctcacccagctcccaattcmcctcccgtcccgtcccgtcccctcccctcccctcccctccgctcccgtcgtctaccctcactcgaaactccgaatcgaaaccggcggagttcaatttggggatttcggcacctcgttccccgaaattttctggatctgagtctgtcggccgttctcgatttgcgtctggagtgtgcctgcgagttttcaggctcgatttggtcggggcctcgggggtcccgggtcttttcgatttcggggatggactcgtctccggtgtcctattggtgctacagctgcag

SEQ ID NO: 7018 - DNA, 504 bp, Zea mays
  misc_feature: Ceres CLONE 346251-F
  misc_feature: Encodes the peptide sequence at SEQ ID NO. 7019
accagatccgcccccgttttctcgcctcgcggtctcgcccctcgcacccgcccctcagctcycatgggctctcgccgtcgctgacactggggcccaacgctctcccccrcgtccgcgcccgcctcctccccctcaccctcctcctcctcttgttgcctccactgactctagcctaccgcccccgcccaccgacatcggaagccctagctgctgcaggaactgccctgccggcccgccgctcctccgctcgaagcgtctccggtttcttggatgcaccggctgctccgatggctgcccttccgcccgccgcagaggaccccgacgccgtggagatccgtgaagtttgggcgagcaacctggaggaggagttcgcagtgatccgcgccgtcgtcgacgtgtacccgtacgtggccatggacacggagtttccggcttcgtggtgacgccgagcgccgagtacggttcacctgcgaccgcaactacgccgccctcgagggcaacgtc

SEQ ID NO: 7019 - protein, 51 aa, Zea mays
  misc_feature: Ceres CLONE 346251-F
  misc_feature: SWISSPROT Homolog: EC 3.1.13.4 Poly(A)-specific ribonuclease
MAALPPAAEDPDAVEIREVWASNLEEEFAVIRAVVDVYPYVAMDTEFPASW

SEQ ID NO: 7020 - DNA, 457 bp, Zea mays
  misc_feature: Ceres CLONE 346273-F
  misc_feature: Encodes the peptide sequence at SEQ ID NO. 7021
taagttgttttgaaattatgggccctaaggccaaaattgggctggtttcttgtacacttccacgttcgaggcgcgcggcgagccgggttctcaccaattcgtcttcttccacaaactccaaaaccctagcgccgccgccgccatgtcctcgtctccgtccccggcgaaccgccgtccccggggcccgcttgcgctggggctggagtcctcggcgaacaagatcggcatcggcgtggtctccctctcgggtgacatcctctccaacccgcgccacacctacgtgacaccgccgggtcatggattccttccccgggagaccgcgcagcaccacctcgcgcacctcctccctctcctccgcgccgcgctcgctgagtccggtgtggcccccgctgacctcgcatgcgtctgctacactaaaggcccggcatgggcggccctctccaggtcgccgcagcag

SEQ ID NO: 7021 - protein, 105 aa, Zea mays
  misc_feature: Ceres CLONE 346273-F
MSSSPSPANRRPRGPLALGLESSANKIGIGVVSLSGDILSNPRHTYVTPPGHGFLPRETAQHHLAHLLPLLRAALAESGVAPADLACVCYTKGPAWAALSRSPQQ

SEQ ID NO: 7022 - DNA, 493 bp, Zea mays
  misc_feature: Ceres CLONE 346297-F
  misc_feature: Encodes the peptide sequence at SEQ ID NO. 7023
aatttcatcagcagcattacccatcgctcgccaacgtgcagactaaggaagcactgaccggccggtcatggcgaggatccacctctacgtcgtcgccgcggcctgcgccgtcgccctcgcgctcgccggcgacccggacatgctccaggacgtctgcgtggctgactacgcttccccggtcaagctgaacgggttcccgtgcaaggcgaacatctcggcggacgacttcttcttcgacgggctgaggagcccgggcaacaccaacaacccggcgggctccgcggtgacggcggccaacgtggacaagttcccgggggtgaacacgctgggcgtctccatggcgcgcatcgactacgcgccgggcggccagaacccgccgcacacgcacccgcgcgccaccgagatcatcttcgtcctcgagggcacgctcgaggtcggcttcctcaccaccgccaacaggctcctcagcaagaccgtcgccacgggggacgtc

SEQ ID NO: 7023 - protein, 142 aa, Zea mays
  misc_feature: Ceres CLONE 346297-F
  misc_feature (57)..(141): Pfam Name: Cupin_1 Pfam Description: Cupin
  misc_feature: SWISSPROT Homolog: EC 1.15.1.1 Superoxide dismutase
MARIHLYVVAAACAVALALAGDPDMLQDVCVADYASPVKLNGFPCKANISADDFFFDGLRSPGNTNNPAGSAVTAANVDKFPGVNTLGVSMARIDYAPGGQNPPHTHPRATEIIFVLEGTLEVGFLTTANRLLSKTVATGDV

SEQ ID NO: 7024 - DNA, 257 bp, Zea mays
  misc_feature: Ceres CLONE 346317-F
acccggcaccgcaaccgctgttcctctgcgcggcacgcgcgcgcgccacagccgatcagccaccgcaggattcctcgctccaccgcaaccattcggcttctcccaaatcccggcacggcggcacgggacctctcctctctctcccgctggcgggcgatggcctcctcctcctcttcctcacctgcgcccgccttggccggggaggcgctacgcctagaaacgcatcctctccagcaagctctacctcgaggtcccgt

SEQ ID NO: 7025 - DNA, 493 bp, Zea mays
  misc_feature: Ceres CLONE 346335-F
  misc_feature: Encodes the peptide sequence at SEQ ID NO. 7026
cttcttacagccgccgccgccgcatcccagcctccatcaccgtttccgtctcgttgccatgggtaaggtgcacggatcgttggcgcgcgccgggaaggtccgcgggcagacccccaaggtggcgaagcaggacaagaagaagaagccccgcggccgcgcgcacaagaggatgcagtacaaccgccgcttcgtcaccgccgtcgtcggcttcggcaagaagcgcgggcccaactcctccgagaagtaggcgccgctcggctcgtaccggttcctcatccttcctgctctccgtatgcttatgctcttgatggtactagtttcgttgttcgcaagcagaggaagaaccttctgtagattcggttttgttgtccatgtgctcagatgggaacttgagattgtatgaatttgagatatggtgatatgagctgatgatttttattatgcttattgttgctcctctgagctgttatttttgaacgctatccaaataaat

SEQ ID NO: 7026 - protein, 62 aa, Zea mays; identical to SEQ ID NO: 6893
  misc_feature: Ceres CLONE 346335-F
  misc_feature (3)..(61): Pfam Name: Ribosomal_S30 Pfam Description: Ribosomal protein S30

SEQ ID NO: 7027 - DNA, 479 bp, Zea mays
  misc_feature: Ceres CLONE 346342-F
  misc_feature: Encodes the peptide sequence at SEQ ID NO. 7028
gctcgatctcatccgtccgctggtaagccataagccaaagaccacaatagatctcgtctccctccgttcccctcctgtccgtcattttctcgtcacctacatatctccggctcgccgtcggcgtcgccgcctcctcctccttcgcccgctggaggcgcccatagcgacctcaccggtgggtttgctgaagtgacatcggccgaggtggaactggttggggggagtccattcgggttcgagcagcctgagccggcgcgccggcagcgacggagtcgtgcagttgagttgagatggcaaacattccccactccttcgcaggggcctcgcctccgtccccctctccgatggctggcagcagcagcggccccgccccgggccaggcagccaaggacaagaagatggcgtccgcggaacagctggtcctggaactctgcgaccctgaactgcgcgagaacgctttacttgagctctccaagaaa

SEQ ID NO: 7028 - protein, 63 aa, Zea mays
  misc_feature: Ceres CLONE 346342-F
MANIPHSFAGASPPSPSPMAGSSSGPAPGQAAKDKKMASAEQLVLELCDPELRENALLELSKK

SEQ ID NO: 7029 - DNA, 449 bp, Zea mays
  misc_feature: Ceres CLONE 346374-F
  misc_feature: Encodes the peptide sequence at SEQ ID NO. 7030
ggtccattcccttcgtgcttgtttgctctagggtttttgccacgccgccgcgctctgccccttccaccccaccgatataccaagatgacggcgcaggctgcggaggagctcgccgcccagatcgagcagcagaagctcgaggagcagaagaccgaggcagaagaggttgtggtggaggaggatgacgaggatgatgaggatgacgatgatgatgacaaggatgatgatgaactggatggacaagaaggggatgggagtggcaagtcgaagcaaagcaggagtgagaagaagagccgcaaggccatgctgaagcttggcatgaagcccatcactggtgtcagccgggtcactgtgaagaaaagcaagaatatgctttttgtcatctcgaagcctaagtagagtgattttttttttgtacttgttggagaggcagcaggtcaattacctaa

SEQ ID NO: 7030 - protein, 104 aa, Zea mays
  misc_feature: Ceres CLONE 346374-F
MTAQAAEELAAQIEQQKLEEQKTEAEEVVVEEDDEDDEDDDDDDKDDDELDGQEGDGSGKSKQSRSEKKSRKAMLKLGMKPITGVSRVTVKKSKNMLFVISKPK

SEQ ID NO: 7031 - DNA, 459 bp, Zea mays
  misc_feature: Ceres CLONE 346379-F
  misc_feature: Encodes the peptide sequence at SEQ ID NO. 7032
aggtgccagtttcgttctcatctccgtttctctggattgtcccccgctccccctctccggtcttccccatgtcggacgcgtataggaaagccaagcccggccgcctcgtcttcaagggcggcgaagccgcctccatccacaagccaaagaagcacaagaagaataagaagcccgcgtcggacgccctcgccgacggcgacatcgaggccgcggccgcgaccgcggagggtgctgaaggcggcggaggtgccggcagcggcactggcgacgactacaccatcgacgcggcgaagaagatgaagtacgaggaactcttccctgtggagtcgaagaagttcgggtatgaccccgacaacgccgcccgcgctgccgcccggaaccgcaccgtcgaggaagccctcgacgaccgcgtccgcaagaaggccgaccgctactgcaaatgaggttcactcattggtc

SEQ ID NO: 7032 - protein, 124 aa, Zea mays
  misc_feature: Ceres CLONE 346379-F
MSDAYRKAKPGRLVFKGGEAASIHKPKKHKKNKKPASDALADGDIEAAAATAEGAEGGGGAGSGTGDDYTIDAAKKMKYEELFPVESKKFGYDPDNAARAAARNRTVEEALDDRVRKKADRYCK

SEQ ID NO: 7033 - DNA, 495 bp, Zea mays
  misc_feature: Ceres CLONE 346384-F
  misc_feature: Translation starting site: 60
  misc_feature: Pfam Name: Ribosomal_L34 Pfam Description: Ribosomal protein L34
aatgtagtagagccagaggaggaggagcagggggaggacgaggctagggttgctcggcgatggcgtcggcggcgaagacccttgcacgggttggatcatccctcttcggccgcattctcgcgtctccgtcctcgtccataccccgcgccgggctgccgctagccaggctgcagccacacgtcccgccgccggcaccggcgggggtggacgcttacgaggcggagaccgtcgccaggctgagctcgctccccggcgagatatccttcccttgcggcctcccctcgctccgcttcttcatcgacgacgcaaatcgaccaagggtgggcgcaaggtgattgcccggagaatcgccaaaggcaggcacagaatctcagtttagctagatccggctcgtagcagccctggatgttttctgtaacacagattcgtatcgtgttctttctatggttagcactctgctgaaggtgagcccccgcgcaagcagcagtccatgta

SEQ ID NO: 7034 - DNA, 558 bp, Zea mays
  misc_feature: Ceres CLONE 346398-F
  misc_feature: Encodes the peptide sequence at SEQ ID NO. 7035
ccaacccaacccaacgacgcagctagcgcgcatctccgatctgcactgcaccttcgtctccgaagaacgtcgatcgtactcgtacaccatgaaggcagtcgtcgcggcgacgatgcttctgctggtgctggtggccgcggcgacggtggcgagcgcagaccaccgtgatgacgacggccaccaccaccagcgccaccgcggccagagctggcaccgccacagcggcggcggccgagatggccgccggtcgacccctctggcggggctgacgcagtgcgtgacaagctgcgggtctggggtcacctcctgcatgctggactgctaccagccgctggtcgacctggaccccgtggagctgcccgtctgcctcctcaagtgcaccaacgacgccatggacaacttcatgccggacctgaagattatctacatcccggaggggggccacttcgtgcaggagcagctcccggatcgggtcaacgagctcctcctcgacttcctcaatggccacccccgtcgcatcatgatacctagtagcagttgcagcaataatcgcggcgt

SEQ ID NO: 7035 - protein, 156 aa, Zea mays
  misc_feature: Ceres CLONE 346398-F
MKAVVAATMLLLVLVAAATVASADHRDDDGHHHQRHRGQSWHRHSGGGRDGRRSTPLAGLTQCVTSCGSGVTSCMLDCYQPLVDLDPVELPVCLLKCTNDAMDNFMPDLKIIYIPEGGHFVQEQLPDRVNELLLDFLNGHPRRIMIPSSSCSNNRG

SEQ ID NO: 7036 - DNA, 807 bp, Zea mays
  misc_feature: Ceres CLONE 346421-R
  misc_feature (12)..(12): n is a, c, t, g, unknown, or other
  misc_feature (13)..(13): n is a, c, t, g, unknown, or other
  misc_feature (458)..(458): n is a, c, t, g, unknown, or other
actatttttttnnaaaaaataatatcaaccctcccctaggcgcggggagtgtagtgggagaggcggggaaacccccccccacgaatgggtaccggccccccctcgaggtcgacggtatcgataagcttttttttttttttttttgccttggaagcaatgtgtttaactatatatctgtttctgcatgattggcctggataaaaagcttataataaactcttatagtttatataccttaaccgatcgagagcaccattataataagtgaaaacaaatttaacactgaaagaaaaagaatactcaaatcaaatgaaagtccgaatataattcaggtgactgatagaagtttatcccattagggcatatgcaactcccgctgtcgcgaccgcggcgactagccatcgcacgagcagagccgctgctgcgccccccttctcagaatcggaggtcgaattttnccgaatcgtccgaggaaaccctccccactcccggccgggaaaaacccctccccctccctggaaggaccccccccccgggacgccggccgcccttgaaagaacctttgaaaaaagcccccccgccccctgcagggaactttgcttcaacggccataaactcgggccaaacgggttccccttgttgccccaaatagtcggctgaatgaaaccttggccccatcgacaagaacccttgggatttggaagagctggacccgcccttccgcgctcttggttcctttggcccaccgccacacccgaaaaaccccaccacccccctcgtaaacctccgccgatccaccacaccacc

SEQ ID NO: 7037 - DNA, 492 bp, Zea mays
  misc_feature: Ceres CLONE 346442-F
  misc_feature: Encodes the peptide sequence at SEQ ID NO. 7038
gttggctttctcccctcgcaccggggaacgcggctgccgatccgctcccgatcccctgccctcctccttccagccgactgagattccaccaaatcggcgcccgtgcagtccccgattcgattgacaagcacgattggccgctcctgatcagctacgggatacggctggatttgatttgattggatccccaattgggtgtccgggtccgcgcgttcgggcgggcgggcggggggattgctttagggtttcagcgggtgcggtcgctgtgtaggcgggtagggttttgccatggcggagaagggctgcctgaagcggctccagaaggagtaccatgcgctctgtaaggaaccgccgccgcaggtcgtggctcgcccactgcccaacgacatattggagtggcactatgtacttgaaggaagtaaaggcacaccctttgaaggtggatattactatgggaaactcaaatttccaccggattatccttttaagcct

SEQ ID NO: 7038 - protein, 68 aa, Zea mays
  misc_feature: Ceres CLONE 346442-F
  misc_feature: SWISSPROT Homolog: EC 6.3.2.19 Ubiquitin--protein ligase
MAEKGCLKRLQKEYHALCKEPPPQVVARPLPNDILEWHYVLEGSKGTPFEGGYYYGKLKFPPDYPFKP

SEQ ID NO: 7039 - DNA, 495 bp, Zea mays
  misc_feature: Ceres CLONE 346445-F
  misc_feature: Encodes the peptide sequence at SEQ ID NO. 7040
gttccatcgccccccattgctcgccaagagttcttcttgtttaggcaaaggcaaaagcaggagcaaaaaggtttcgttggcgatggcgagctcgtggacgcttcctgaccacccgaagctccccaaggggaagccggtggctgttgtcgtgctggacggatggggcgaggccaaccccgaccagtacaactgcatccatgtcgctcagactcctgtcatggactcgttaaagaatggtgctcctgagaaatggagactagtgaaggctcatggaacagctgtgggtctcccatctgatgatgacatgggcaacagtgaagttggtcacaatgcacttggtgctggtcggattttcgcccaaggtgctaagcttgttgatcaagctcttgcctcaggaaagatttatgatggagatgggttcaactacatcaaagaatcttttgaaaatggtactcttcaccttattgggtygttgagtgatggtggtgtccactc

SEQ ID NO: 7040 - protein, 137 aa, Zea mays
  misc_feature: Ceres CLONE 346445-F
  misc_feature (15)..(137): Pfam Name: iPGM_N Pfam Description: BPG-independent PGAM N-terminus (iPGM_N)
  misc_feature: SWISSPROT Homolog: EC 5.4.2.1 Phosphoglycerate mutase
  misc_feature (130)..(130): Xaa is any aa, unknown, or other
MASSWTLPDHPKLPKGKPVAVVVLDGWGEANPDQYNCIHVAQTPVMDSLKNGAPEKWRLVKAHGTAVGLPSDDDMGNSEVGHNALGAGRIFAQGAKLVDQALASGKIYDGDGFNYIKESFENGTLHLIGXLSDGGVH

SEQ ID NO: 7041 - DNA, 511 bp, Zea mays
  misc_feature: Ceres CLONE 346452-F
  misc_feature: Encodes the peptide sequence at SEQ ID NO. 7042
gcatcaaacaaatcaccctgccgatcgccatggacgaacagcaggcggaggagggcgaaagcgcgcgcgtcaagaggacgccggaggaggggtcgtcgccgctgtcctctctggcggatgacgtgctgctacagatcctgggacggctcgaggcggacccgcgggactgggcgcgggcctcctgcgcgtccccgcgcctcgccgctctgctccgggcggcctgcctcccgccgtcaccggacggggcgcccgcggcctgggcggcgctccacaagctctccgtctgttgcccggggctcctccgcgccggggtgctcctcgagcccaccgactatttcgggctcgatctcgacatcgggcctgacgtccccatctacgcccgcaccgacgcctcctccgccgaggggttcgaggccacggcacctcccgccacagcggaaccatcgtcgcggccgggagcgcgcccgcgccggcgaatctgcaacgtcgccgcgtggtcgctctacgacga

SEQ ID NO: 7042 - protein, 160 aa, Zea mays
  misc_feature: Ceres CLONE 346452-F
MDEQQAEEGESARVKRTPEEGSSPLSSLADDVLLQILGRLEADPRDWARASCASPRLAALLRAACLPPSPDGAPAAWAALHKLSVCCPGLLRAGVLLEPTDYFGLDLDIGPDVPIYARTDASSAEGFEATAPPATAEPSSRPGARPRRRICNVAAWSLYD

SEQ ID NO: 7043 - DNA, 461 bp, Zea mays
  misc_feature: Ceres CLONE 346480-F
  misc_feature: Encodes the peptide sequence at SEQ ID NO. 7044
agtcttcagcacgcacaccaatcgcccacaagcgctcgcaggagaggtcgaaaccctagcttttgcggcgacggcggcggcggcgagagaagatgatctacgacgtgaactcccccctcttccgttccttcctcagccagaagggcggcgccgacaagaggaaaatggaggagcataaaccaaaggagcagaggcccaaggccaacgagaacaagcctgtgatgaacgaatgaatatctccagaagctttgttcaatgtgcaaccaaatgcgatgtccgtttgctctggttagcttaaaaccaacgcttccaataatcctattggtgtcttagtttccccttatagtgttatttgctcggcttgaacatggcaacggaaatgaaacttgaactacctatggtactgtcatcaatttgagacccccatgattgacaacttttgtgcaaaaaaaaaaaaaaaa

SEQ ID NO: 7044 - protein, 46 aa, Zea mays
  misc_feature: Ceres CLONE 346480-F
  misc_feature (1)..(46): Pfam Name: Wound_ind Pfam Description: Wound-inducible basic protein family
MIYDVNSPLFRSFLSQKGGADKRKMEEHKPKEQRPKANENKPVMNE

SEQ ID NO: 7045 - DNA, 451 bp, Zea mays
  misc_feature: Ceres CLONE 346520-F
  misc_feature: Encodes the peptide sequence at SEQ ID NO. 7046
aaaagccctcctctcccctctccctcgcggcctcgccttatcccctccgtcactcacctcgaccaccgccatggccatggccctggcctccgcgaccgccgccgcactcttccgctccactctgtacgcgccacacggcgccggcgcgcgcgtccggccgcggcgccggcagccgttcttggctccgctccacgcggcgaagggccccggctcggcgccggtggtgctggagggcaaggccaagggaaagaagaagaaggggcccagcgccgggaaccttcccgcagccctcgacgtcgagatcagggaggcgcaggagtacctcgacagcgagcagcaggaacctgttccagacaacttcccatttgaattaatcgacgaagagggcatgagcgtggttattttgagaagggactacaaggacgagaaggtcgaggttactgtcagcatg

SEQ ID NO: 7046 - protein, 127 aa, Zea mays
  misc_feature: Ceres CLONE 346520-F
MAMALASATAAALFRSTLYAPHGAGARVRPRRRQPFLAPLHAAKGPGSAPVVLEGKAKGKKKKGPSAGNLPAALDVEIREAQEYLDSEQQEPVPDNFPFELIDEEGMSVVILRRDYKDEKVEVTVSM

SEQ ID NO: 7047 - DNA, 487 bp, Zea mays
  misc_feature: Ceres CLONE 346538-F
  misc_feature: Encodes the peptide sequence at SEQ ID NO. 7048
tctatctttgtggtcgtggtcctcccgtcgtcgtcgactcgtcgtcgtcggtgttgctccgatgggcaaggactcgaagccgaaggacgccaaggggaagggcaagcaggcggccggctcctctggcggcgacgacggcggcggcaagggaggcaagggcaagggcaagggcaagggcggcaagtccgctgacggactcggcacttgcacctacgtcaaagctaggcacgtattgtgtgagaagcaggggaagatcaatgaagcttataagaagttgcaggatggatggctgaataatggggacaaagttcctcctgctgagtttgctaaggtagcacaagagtattctgaatgcccatcagggaagaaaggtggagatcttggttggttcccgcgtggcaagatggctggtcctttccaggaggttgctttcaacacacctgagggaactgttagcgcaccattcaagtccacgcacgggtatcac

SEQ ID NO: 7048 - protein, 142 aa, Zea mays
  misc_feature: Ceres CLONE 346538-F
  misc_feature (56)..(142): Pfam Name: Rotamase Pfam Description: PPIC-type PPIASE domain
  misc_feature: SWISSPROT Homolog: EC 5.2.1.8 Peptidylprolyl isomerase
MGKDSKPKDAKGKGKQAAGSSGGDDGGGKGGKGKGKGKGGKSADGLGTCTYVKARHVLCEKQGKINEAYKKLQDGWLNNGDKVPPAEFAKVAQEYSECPSGKKGGDLGWFPRGKMAGPFQEVAFNTPEGTVSAPFKSTHGYH

SEQ ID NO: 7049 - DNA, 490 bp, Zea mays
  misc_feature: Ceres CLONE 346585-F
  misc_feature: Encodes the peptide sequence at SEQ ID NO. 7050
agatccagaggcactgaataatagaaactctacgagagaaaagcgggaaaaaaggcaggacggcaatcgcatgcttgcgacgatgaccgccagcgagtgaagaatccagccacctgaactcgtaacttcttcttttctttcgtcgttctactcccatcgaagctactactgaggacgggcgcaggcggagaacgagcggatccgctagcaggggaacagccggcgcggagtctctctctctgtgcaagcaggaagggtttggaggatgacagaagctgcagttattacaaggtactggtgccatggatgcgagaaggtcatcgaggaggccatgggggaggagatcaagtgcccgttttgcggtggtgggttcatcgaagagatggccggggaggattccgaggggttggccagccagcagttagagcgagagtggggaacgccgccaggggacagcgaggacgacgatgacgacgatatagcccatgag

SEQ ID NO: 7050 - protein, 75 aa, Zea mays
  misc_feature: Ceres CLONE 346585-F
MTEAAVITRYWCHGCEKVIEEAMGEEIKCPFCGGGFIEEMAGEDSEGLASQQLEREWGTPPGDSEDDDDDDIAHE

SEQ ID NO: 7051 - DNA, 426 bp, Zea mays
  misc_feature: Ceres CLONE 346619-F
  misc_feature: Encodes the peptide sequence at SEQ ID NO. 7052
aaaaatcgacgccgtcggcgagggcacccaggtccgcgtcgcaccacgtcagccacacacccaccaggccaccaccgccctcagctccggtgtgcagagacgctggatggcctcgcaccagtagaatccgtccggcactttctgccctaccccaccccactccacccatccggccgcgggtggatttgaccgatatcggcaggcggccgccggcgtctgcctcgattgatccgcctcgtctcagtcctaggtatggcggcggtggcggagggatcggcgtctgctgcggcgaaggaggtggagtaccaggcgggcgtgcagaagcttgtggacctgctctccaatctcaacccggccgccaaggagttcgtcccttcctcggctccggccgcggctgcgtcgccgcccaagaaagcgttgtcggcg

SEQ ID NO: 7052 - protein, 58 aa, Zea mays
  misc_feature: Ceres CLONE 346619-F
  misc_feature (27)..(44): Pfam Name: PAM2 Pfam Description: Ataxin-2 C-terminal region
MAAVAEGSASAAAKEVEYQAGVQKLVDLLSNLNPAAKEFVPSSAPAAAASPPKKALSA

SEQ ID NO: 7053 - DNA, 465 bp, Zea mays
  misc_feature: Ceres CLONE 346644-F
  misc_feature: Encodes the peptide sequence at SEQ ID NO. 7054
  misc_feature (284)..(284): n is a, c, t, g, unknown, or other
agaacccgatcgggccattggggacggggcggagaacgcgagtaagcactaccctcctcaactcctaccctccgccgtaaaccccgctgttctttgccggagcaccccctccccgtctccagccccagtctcggtccccccggacttcgatatcttcggagaccgcctgcatgctcaaatcgtagacactctgggtaggcgcaaggtggagatccgtccgggcacggatcaatttcttcgttcgctggtactcaggctctaatatttttacaaaatcgatgganagttctaaatctcctcagtcatcaaaaaacagtcggattgtggtgccttctgatagtaatcgcccccgatttgacaatgacggtttttcttcagaaactgcatcaaatcaaatggtcgtgttcaactctgaagcagcagatgaactgggagaaaaccgtctgcagaagtcagtgatcacaa

SEQ ID NO: 7054 - protein, 62 aa, Zea mays
  misc_feature: Ceres CLONE 346644-F
  misc_feature (2)..(2): Xaa is any aa, unknown, or other
MXSSKSPQSSKNSRIVVPSDSNRPRFDNDGFSSETASNQMVVFNSEAADELGENRLQKSVIT

SEQ ID NO: 7055 - DNA, 449 bp, Zea mays
  misc_feature: Ceres CLONE 346692-F
  misc_feature: Translation starting site: 261
  misc_feature (25)..(25): n is a, c, t, g, unknown, or other
acaaacagggtgacaaggaacakgngacaggcacagccgcacagccgcctccgctccatccacctctccacaccatctgacgctgcttccaccgaggtctccaaggctcactcctcaccagcttctgctctctccctcctcatctctgctctgctctggaccgttaactctccagctccccctcgctccgttcccttccgcccaaatcaccgggaccaccaccgccttcttcaagatcggcgggcgggcaccggccggcgatgacatccaccgtcaccacaaccgttgggtgcggggggctccccgtccgcccgttgtcgacagcgaccagaggacgcccacgcagatgcgccgtccgagcccaggccgcgggagcggatgctccaatgataagtcagtggaggtcatgcgcaagttctccgagcagtacgcccgccgctccaacactt

SEQ ID NO: 7056 - DNA, 472 bp, Zea mays
  misc_feature: Ceres CLONE 346723-F
  misc_feature: Encodes the peptide sequence at SEQ ID NO. 7057
cttttttcggctgctgcgaaactgcagccaaccaaggagtggaggagtaggagtagcggcagtcaaagcgtggcgggcggacgggcgggcaagctggaacccattggatcggtggtatcaaggaatcggaagagggacccggctctcccctccccaccccgcgtcccacgtcggttcccctaatctgcgtccgcggcgtgatatgagacggttctgtaattgctgatcggcgtgatgaattttaggccaatagttcttatcttcctcctgctcgtgctcattgtcacatcacagtttgagtggaagcagcatattggtgaggctgaggcgaatccaacagctacacgaaggaggcaacaggcgcttggaagggaggatgctgttaaagagaaagtaatattggcacaagagaaaaacattcagcagcttaatgagcttattcagagccttcagcttcagctattgcattgcc

SEQ ID NO: 7057 - protein, 79 aa, Zea mays
  misc_feature: Ceres CLONE 346723-F
MNFRPIVLIFLLLVLIVTSQFEWKQHIGEAEANPTATRRRQQALGREDAVKEKVILAQEKNIQQLNELIQSLQLQLLHC

SEQ ID NO: 7058 - DNA, 502 bp, Zea mays
  misc_feature: Ceres CLONE 346841-F
gcttcactccactccactctacttcgtccatacagggaaaacaaaggcagcgtggtctggaatccaaaacagggcgagcggcacggcagcggaggggagaccacggtggttggctggctagttgccctctccgcccgccagagacctctcctctcctgtccccaccccctttggcctttgctcgttcgtggcgctcccgtacgcgtccagcgacgagagtttaccgctccggtttcgcttcgtacgggcggttgatacttgatagcggttgataagaggcgcggcggcggggcgagagagcttggttgcgccgaggttgcgcgaaactactagaaggaggggggacgaggaggagtgcggagtgtgtcttgctttgctttgcctcgcctgtccgggctggttggttggtctcccgctcgctacagtccaagccgacgcacaaatctcggtctcggacgcgccgccgcggtaggattccgggtgcctcgattccttgtttctt

SEQ ID NO: 7059 - DNA, 500 bp, Zea mays
  misc_feature: Ceres CLONE 346888-F
  misc_feature: Encodes the peptide sequence at SEQ ID NO. 7060
aaaactcgaaccccctctccccgcctcgagcatcgaccggagggggaaggcaaggcgccgatacgttctcggaatccgaggcgaagcggggtggggatcggatggtggaggctagcgcgagcttcatggataaggtcgaggcggctgctgcgacgccgtcgtctacgggggcagcgtcggcgtcgcggacgcaaggatggaagatgagatggcgcccgtggaacccctgccggagcctcccgacgaaggcgggcccgttgcgtggcccatgccggagttctgccctcttacggtcgatggggcgctgaaggagtcgttcctggagactctgtggaaggacgctgcgccggagatggagcggcctgcgcgagaggcggacgaagcgctcagcccggaatcgcggccgtcgagcagcaagcgccaccgctccggcaccgcctcgccgtcgtccaggagcagcccctaccgcaacatcctgcaggtgttccagcagtgcaggc

SEQ ID NO: 7060 - protein, 101 aa, Zea mays
  misc_feature: Ceres CLONE 346888-F
MEDEMAPVEPLPEPPDEGGPVAWPMPEFCPLTVDGALKESFLETLWKDAAPEMERPAREADEALSPESRPSSSKRHRSGTASPSSRSSPYRNILQVFQQCR

SEQ ID NO: 7061 - DNA, 420 bp, Zea mays
  misc_feature: Ceres CLONE 346936-F
  misc_feature: Encodes the peptide sequence at SEQ ID NO. 7062
atcgtagccctcgactaaactaaactaaactaaaagcaagccagtgagcgccctttttcttccgttgctccatggccatggcatcccgaccgcctcttcgtcgtcgacgtcgtcttcccctcgtcccactcctcgttctgctctgcctctctccgggatgcgccgccggtagagtcccggtttcggtctactacgaagcgctgtgcccgttctgctccgcgtttgtcgtgaacgacctctccagggtcttccgcgacgggatctcctccatcgctgagctgcggctcgtccctttcggcaatgggcgtgtctcggccgacggaaccgtcacttgccagcatggagaggacgagtgccaactcaacgctatagaagcttgcgtgatcagaatatggcctgacgcggagcagcattttcctt

SEQ ID NO: 7062 - protein, 116 aa, Zea mays
  misc_feature: Ceres CLONE 346936-F
  misc_feature (35)..(116): Pfam Name: GILT Pfam Description: Gamma interferon inducible lysosomal thiol reductase (GILT)
MAMASRPPLRRRRRLPLVPLLVLLCLSPGCAAGRVPVSVYYEALCPFCSAFVVNDLSRVFRDGISSIAELRLVPFGNGRVSADGTVTCQHGEDECQLNAIEACVIRIWPDAEQHFP

SEQ ID NO: 7063 - DNA, 656 bp, Zea mays
  misc_feature: Ceres CLONE 346965-R
  misc_feature: Pfam Name: Mod_r Pfam Description: Modifier of rudimentary (Mod(r)) protein
  misc_feature (1)..(1): n is a, c, t, g, unknown, or other
  misc_feature (656)..(656): n is a, c, t, g, unknown, or other
ncaattgggtaccgggccccccctcgaggtcgacggtatcgataagcttttttttttttttttttgcacgaaccctgaagcatacgaaagctttattatcatccaacaaatcgtgcaaagtgtttggcaagccctataagaagctgcagcaataaaacagggccaagcagaggaatacagcaaagttgacatgatgcaggccggatgtcagtggagttatgtcagtctggccggcgagatggagcaacgcctgcttgtgataagccgtgcggagcttcttgtacttctgtacgaagtgtgggaagtcgatgtccttcgccaggaacttctgctgcagctcctcagactcctcgtccagctttgccatcgacgtttggagtttgtcgagtagtgcagcaggggaataggacctcataatatcatccttttgcctctccaaatcagtaagccggtcttgagcagcagccagttgtgtggttctaattattgtgcactgattcccaagctccaaaatccgctgctccttttctaaattttcccttgcaagttgcaatgtctcctttctaagctcgccacgcacattgttctgggttttcacttgatcgaatgtgttaaagaatgcattatatgcctctttctctttcaatagcctctgn

SEQ ID NO: 7064 - DNA, 408 bp, Zea mays
  misc_feature: Ceres CLONE 346997-F
  misc_feature: Encodes the peptide sequence at SEQ ID NO. 7065
atacggtataccataccggcaccggcaccggcagcgagcagtcgggagccatggctccgccgctcctgctcttcctcctcctcctccccctcctcacggccctcgctgacggacaccagcacctgtcctcctacggctcctccgcgctctccgattggcgccccgccaaggcatcctactacgccgccgaccccgaagacgccatcggtggggcgtgcgggttcggggatctggggaaacacggctacgggatggcgacggtggggctgagcacggcgctgtttgagcgcggcgcggcgtgcggcggctgctacgaggtcaagtgcgtcgaggacctcaagtactgcctccccggcacctccatcgtcgtcacggcaacaacttctgcgcccaaactacggccttccc

SEQ ID NO: 7065 - protein, 119 aa, Zea mays
  misc_feature: Ceres CLONE 346997-F
MAPPLLLFLLLLPLLTALADGHQHLSSYGSSALSDWRPAKASYYAADPEDAIGGACGFGDLGKHGYGMATVGLSTALFERGAACGGCYEVKCVEDLKYCLPGTSIVVTATTSAPKLRPS

SEQ ID NO: 7066 - DNA, 475 bp, Zea mays
  misc_feature: Ceres CLONE 347045-F
  misc_feature: Encodes the peptide sequence at SEQ ID NO. 7067
agtgttttgggctgatctgcaaacttgcggtgaaattccggtttcggcttccgcggggtgggaatttggatagcgcggcgcaggaaaaatggcggcttccgctctccacctccgcctccacccctcgccgccggcgggtgtgaagcttcagcagcggaaactgcgctcgaaaatacagaggcagggtggcctatctcgaagattttcaaaagttgtgtcctattacggtctcacaaccccaccatataaactggatgctctggaaccttatatgagtaagaggacagttgaacttcactggggtaagcaccatcaagattacgtggatggcttgaataagcagttggctaccagccctctgtatggatacactctggaggatctgataaaagaagcttataacaatggcaatccattaccagagtataacaacgcagcacaggtctggaacatcacttcttctgagaatcaatgc

SEQ ID NO: 7067 - protein, 129 aa, Zea mays
  misc_feature: Ceres CLONE 347045-F
  misc_feature (45)..(123): Pfam Name: Sod_Fe_N Pfam Description: Iron/manganese superoxide dismutases, alpha-hairpin domain
  misc_feature: SWISSPROT Homolog: EC 1.15.1.1 Superoxide dismutase
MAASALHLRLHPSPPAGVKLQQRKLRSKIQRQGGLSRRFSKVVSYYGLTTPPYKLDALEPYMSKRTVELHWGKHHQDYVDGLNKQLATSPLYGYTLEDLIKEAYNNGNPLPEYNNAAQVWNITSSENQC

SEQ ID NO: 7068 - DNA, 475 bp, Zea mays
  misc_feature: Ceres CLONE 347113-F
  misc_feature: Encodes the peptide sequence at SEQ ID NO. 7069
acacacacacacagcaccatgcttcacaggaggagccgcacgctgggagggagctccgatcgacctgcgcgccgagctgtcgcggtgaagagcgggagggggagcaatggcgcggccacggacctgctcgtctgcttcccgtcgcgggcgcacctcgccctcatgccgcccaaggccatctgcagcccgtcgcggccgtcggcgtccgagccggtcaagcgccggcacagcaccagccggccgcccagcgggctctacaagtcggccgcggccaggaacccgagccgccgcggcgcggacgtccccgtggacgacgagcccacgtcgcccaaggtgacgtgcgcggggcagatcaaggcccgccaggccaagcccaagggccccgggcccggcggtggcggtggcaagaagaccaagaaggccacgtggctgcaggcgctggggatcaagaaggacgcactggcgctcttggacg

SEQ ID NO: 7069 - protein, 152 aa, Zea mays
  misc_feature: Ceres CLONE 347113-F
MLHRRSRTLGGSSDRPARRAVAVKSGRGSNGAATDLLVCFPSRAHLALMPPKAICSPSRPSASEPVKRRHSTSRPPSGLYKSAAARNPSRRGADVPVDDEPTSPKVTCAGQIKARQAKPKGPGPGGGGGKKTKKATWLQALGIKKDALALLD

SEQ ID NO: 7070 - DNA, 459 bp, Zea mays
  misc_feature: Ceres CLONE 347128-F
cttccgctaccaccttcatccatcctggcgtcggtgtcttgccctgccccagcgccgccgctccttcccccaccccgaagcgccgcctcttctgcctccgtcgacggtggtggtgctcctgatccccgccgttgaactggccataggagagcaaagaggaaggggaggccgcgagggcgccagtagatatattcatcttcatctcggcttgcgatatttttgaattttctattccgtattgaaggcgtcgatggccttgtccgccctaatcagcaccctcctcgccgccgccatctggtgcgccgcttacctcgccgctgccatctcctccgccttctgattcccactccccaaccctaacctcccccctgtagcacaccccacctctagctttgtaggtcctactatacttgcaacctctcccgctgactcgcttcgatctacccgccctcgcgtcac

SEQ ID NO: 7071 - DNA, 429 bp, Zea mays
  misc_feature: Ceres CLONE 347167-F
  misc_feature: Translation starting site: 40
atttccaccaggcaaacggttcacacgttcgaaccccatatggctgaacccaagtcaaataatggcggggcggacgcgacggcatcgatgatgctccacggccgcgtagccattgtcaccggtggtgccggcggcatcggctcggccgtgtcgaagcacctgtcgtcgctcggcgcgcgcgtcgtggtggggtacatcggcgacccggcacctgctctgacgctggtagccgccatcaactcctccgagcaccccggcgagagccagcagccgcgagccatcgcggtcgaggcggacgtgtccgacgcggcagccggtgaaggcgctgttcgacgcggccgccgcagccttcggcggggagctccacatcctggtaacgttggcggcggtgctggactactcctacccgccgctggcggagaccagcga

SEQ ID NO: 7072 - DNA, 105 bp, Zea mays
  misc_feature: Ceres CLONE 347212-F
aaatctcgtgccattctaaataggaagcaatactgatggcccaaaacaagatgattgtggtggttctcctcctttccacctttattgtggtggcaagatcgttgt

SEQ ID NO: 7073 - DNA, 456 bp, Zea mays
  misc_feature: Ceres CLONE 347227-F
  misc_feature: Encodes the peptide sequence at SEQ ID NO. 7074
ccttcttacagccgccgccgccgcatcccagcctccatcaccgtttccgtctcgttgccatgggtaaggtgcacggatcgttggcgcgcgccgggaaggtccgcgggcagacccccaaggtggcgaagcaggacaagaagaagaagccccgcggccgcgcgcacaagaggatgcagtacaaccgccgcttcgtcaccgccgtcgtcggcttcggcaagaagcgcgggcccaactcctccgagaagtaggcgccgctcggctcgtaccggttcctcatccttcctgctctccgtatgcttatgctcttgatggtactagtttcgttgttcgcaagcagaggaagaaccttctgtagattcggttttgttgtccatgtgctcagatgggaacttgagattgtatgaatttgagatatggtgatatgagctgatgatttttattatgcttattgttgct

SEQ ID NO: 7074 - protein, 62 aa, Zea mays; identical to SEQ ID NO: 6893
  misc_feature: Ceres CLONE 347227-F
  misc_feature (3)..(61): Pfam Name: Ribosomal_S30 Pfam Description: Ribosomal protein S30

SEQ ID NO: 7075 - DNA, 468 bp, Zea mays
  misc_feature: Ceres CLONE 347261-F
  misc_feature: Encodes the peptide sequence at SEQ ID NO. 7076
aaaaaactccctcgattgtaataacagagaaaaaaaaaccatccgccggaggccggagggcagattctccaccatcgcctccactccaccctcactacgcgaatccgcggcgaacccccctctctgattccttctctcctcccgccccgatcgcgtcgtccagagaccgccaggctccggcgcccccgcccgcccgggttcgccgggggtcgggatgccctgctgctcgcctttgctgctcggagtcgggccgcgggtgcgctcctttctccgcgactacgacgccctccagtccctcgccctcgcactcatctacctccagattggttgtgcgctgattgggtcacttggggcattgttcaatggggttcttgtgatcaacctagtgattggtctatttgctgttgttgcaatcgagagcagcagccagagacttggccggacatatgctgtccttctcttctttgc

SEQ ID NO: 7076 - protein, 84 aa, Zea mays
  misc_feature: Ceres CLONE 347261-F
MPCCSPLLLGVGPRVRSFLRDYDALQSLALALIYLQIGCALIGSLGALFNGVLVINLVIGLFAVVAIESSSQRLGRTYAVLLFF

SEQ ID NO: 7077 - DNA, 447 bp, Zea mays
  misc_feature: Ceres CLONE 347269-F
  misc_feature: Encodes the peptide sequence at SEQ ID NO. 7078
aacgacgatgaaatcaatacctgagggtgtgcaacgcaagctcctcctccacctccaccctctaaaataagacgttgcagccaaccaggggaggccctccgcggtccgtggctccgtgccatcctctcctgggcagcgagcagtggtggccgcgggttcccccgcctcgtcctcccggatccggcgacgaagattaattgaataacttcgataagatgggtcgtggtattagcagtgggggtggtcagagttccttgggctatctctttggcagtgacgaagctccaaaatcatttgagaagcctgcaccagttcaaaagccaactcctccatcctctgcagagagactaaaagatatcgctgctggtattcaaagtagtaaatcaaacaattacaaaagatctgaaggccagaactgtggaaatttccttacggaccgtccgtcga

SEQ ID NO: 7078 - protein, 77 aa, Zea mays
  misc_feature: Ceres CLONE 347269-F
MGRGISSGGGQSSLGYLFGSDEAPKSFEKPAPVQKPTPPSSAERLKDIAAGIQSSKSNNYKRSEGQNCGNFLTDRPS

SEQ ID NO: 7079 - DNA, 354 bp, Zea mays
  misc_feature: Ceres CLONE 347279-F
  misc_feature (83)..(83): n is a, c, t, g, unknown, or other
gaccggactccggtctagttatcgagtggaacgaagcaagacaagagggaggccgagccgcctagggtagccccgtccggtcnyctgcgtcbgcgaccgactgcctggcgccggcgaatcgatbbggctactggtggcaccygcgtcgtgctgccggtgcggcgggcgtggctcggcgtcgcgtcccgcttckcgggttcggcaaaccgggttgtggaggctgyggcaggaggtgagcacgtgcgagtacgaggacgtgcacgtgatgtgggagatgctgagccgcaccacggcgccggykcccscgcycaccaggcggcagcacagccggttccggccgcagccgcggccgcg

SEQ ID NO: 7080 - DNA, 481 bp, Zea mays
  misc_feature: Ceres CLONE 347284-F
  misc_feature: Encodes the peptide sequence at SEQ ID NO. 7081
acgccaatcacctgtccagctgtcctattcctacctccagccacaaagacgagctccacgattccacccacaccgaatcttgacggaacgattccaccaagaaccgcgggcaacaattcacaccgcgcttctcttctccagcgatgcagacgacggcggcggcggctgtggcatgggcgcctggcccatcggcgtccacctcgtcatcgtcctcgccgtccaccttcagggtgggggttgcgtcgacggccgtgcgggcttgttccgcgcccaggcttgttgcgtcctccgcgcccctgggctgtcgacggctgcgacaagtggttcaagctgttgccaatccagaccctgcgatcgagcttccattgactgctgaaaatgttgagatggtgttggatgaagtaaggccgtatcttatggcagacggaggcaatgttgcgttgcatgagattgatggggaacgtggtaaggttaaagctgc

SEQ ID NO: 7081 - protein, 112 aa, Zea mays
  misc_feature: Ceres CLONE 347284-F
MQTTAAAAVAWAPGPSASTSSSSSPSTFRVGVASTAVRACSAPRLVASSAPLGCRRLRQVVQAVANPDPAIELPLTAENVEMVLDEVRPYLMADGGNVALHEIDGERGKVKA

SEQ ID NO: 7082 - DNA, 345 bp, Zea mays
  misc_feature: Ceres CLONE 347293-F
  misc_feature: Encodes the peptide sequence at SEQ ID NO. 7083
ataaggctggtctgcaattaggtgcctcgactgcttgctagccgccggattaatctttccctaccctaaggctcaggttttagtgggatatgatgaagctaaaaagtggacgacgaccgttctataaggatgttaagcctgtagactgccgttcaggctcaagtcttccacatttggctgctcaagcaaagtttgcagccatgaacatgcagaatgaagatgtcaagcctcgtcgaccagttcaagtcagacgaagtagatgggttcttggtgatgtaaccgaggtgttggatcataattcgtggaggcttgggaagattacagaagttctgaagaatgactatt

SEQ ID NO: 7083 - protein, 85 aa, Zea mays
  misc_feature: Ceres CLONE 347293-F
MMKLKSGRRPFYKDVKPVDCRSGSSLPHLAAQAKFAAMNMQNEDVKPRRPVQVRRSRWVLGDVTEVLDHNSWRLGKITEVLKNDY

SEQ ID NO: 7084 - DNA, 506 bp, Zea mays
  misc_feature: Ceres CLONE 347295-F
actgctaattagcctcctagccagcctccgcctggaggtccatccccgacctcgacgcttcccggccaaacgccgacgcccctcaccctcggcgcagcgccgcagcgtcgcggtgctccatacccatccccctccatggccggcgactgcatcccccggcatcgcggtgctggatcccctccctctctcgcgttacgctagagttcgagaaggggaaaagcgacgtagggttcggcaacgacacctctgtgtcccctcctccctcgcgcactcattttccttcgtctcgttgctactcagagtgcgttccatccgagcggtgatgtgagatgtgtcccccctattcttcatcggtttgcttgcaatgattgagatagatgtgctcattcgccttgcagaaaatgaaaaataaagatatctttgtgcccagattcagagatggtttgactacctaatcatatatgcatggtacaacagccataaaactgaattttatttggctagaa

SEQ ID NO: 7085 - DNA, 770 bp, Zea mays
  misc_feature: Ceres CLONE 347309-R
  misc_feature: Pfam Name: Sec6 Pfam Description: Exocyst complex component Sec6
  misc_feature (18)..(18): n is a, c, t, g, unknown, or other
caatcttttttacctctntctcttacttatttcccccctataaccaacgctatacgaatgcgtacgggccccccctcgaggtcgacggtatcgataagcttttttttttttttttttacaaataacaaccattttattgaataaagtacatgtttgctcctcaagctgagtacatactgatagtataaacgtgaaacccaacagtagcatccaaaaaagaatgatcatagagaagtgaaatgtacaatctttgacttggtgataaattcgtccactctgctgcaagtcgccacttactgcccaagcttcctccatatgcctttctttgctgtcaagcacttcaatttgccgaacacaaaacctgacttgcgagggttgccatccacgagccagttctcgtatatctctttgcatacttgaacaatctccttggcttcctttcttggaatgtcttcatgcattgccaaaagcttctcaacaacctcaagcgggataatcagcttaatgttccagactatttgcgaaaactcaaaactcaagctatctaaattcccagcttaaactagattcttctcatatcctgcaaaaatttgacactctaactttcaaaattccagtcaagataaacaatgctcccctaaataaaaatccattaaacccttccactttaatcctaaacccccacccctcttattaatacggtttccatccttttaatagaaaaaattttctctccggcaactaggataaaatcaatttctactttccgt

SEQ ID NO: 7086 - DNA, 532 bp, Zea mays
  misc_feature: Ceres CLONE 347310-F
  misc_feature: Encodes the peptide sequence at SEQ ID NO. 7087
ccaatcccgtaatcgcagcctcgccccgctcgcatcttcctctccctctcagcactggtgctcaatctacaggttgtcccgctccctacgcacccgccctccggtgtgaacctccatgacgtccacaaccactctccggtatgaatcccgcgtgcgcttacacgaagattggtaatagtggcgacccagtcgcagccgtggaccttctcctcctcatcgcttgctcgttgtcgtcttttgcctacgtctgcacccgacgctgctacccttcgctcacctgttcatcatccatcagatctgctgtcgtgacctcatccagccgtgctgtggcagtggatcgaagttcgctccagctctgattgggggaaaatgactagggtatcaagtggaaaaacataatggtccaggttctactgcggcacctctttcaggctaagcatctaaacaacaatatgaattccactactatatgtgccacttgaagttgttatgtcaaaataatatggtgaaaacgagcgtctattgggatcta

SEQ ID NO: 7087 - protein, 72 aa, Zea mays
  misc_feature: Ceres CLONE 347310-F
MNPACAYTKIGNSGDPVAAVDLLLLIACSLSSFAYVCTRRCYPSLTCSSSIRSAVVTSSSRAVAVDRSSLQL

SEQ ID NO: 7088 - DNA, 459 bp, Zea mays
  misc_feature: Ceres CLONE 347342-F
  misc_feature: Encodes the peptide sequence at SEQ ID NO. 7089
actctctcttgtctccaagtttgtaaccctagccgccaagcttgaagctccagccgtgctcgtgtagggctgcagggcatccgggctccggcttccggcatccaccaggcgtccttagaatacggtgcagcgagcagcaagtcgccgagcagccgagccaccgccgagcacagggcgccgccgagcagccgagccgccgccgagcgccgagtcttctctgagtgacttcggtacagacgacaaactttctccacacataccgcgccactccgccactcaccgtgctgacggatggggtggtgctccccgtccacttcccggcagcttctctccacggcctcactcttcgccttcggcgcgggtctcctcaccttcggcatccacctctcctacgtccacatcgagccccagcgcgctcgcacgctcgctcgggaccaattcgtccgcgaytacctccgc

SEQ ID NO: 7089 - protein, 56 aa, Zea mays
  misc_feature: Ceres CLONE 347342-F
MGWCSPSTSRQLLSTASLFAFGAGLLTFGIHLSYVHIEPQRARTLARDQFVRDYLR

SEQ ID NO: 7090 - DNA, 446 bp, Zea mays
  misc_feature: Ceres CLONE 347346-F
  misc_feature: Encodes the peptide sequence at SEQ ID NO. 7091
  misc_feature (441)..(441): n is a, c, t, g, unknown, or other
gtttgcagcagcagcagcagccgccgacgccgacgtaaaagcccgagtcgctcgtctcttcccagatcctccgagcacaacagctctccgtcgccgtcgccatgggtaaggttcacggatcgcttgcccgcgcggggaaggtgcgtgggcagacgcccaaggtggcgaagcaggacaagaagaagaagccccgcggccgcgcgtacaagcgcatgcagtacaaccgccgcttcgtcaccgccgtcgtcggattcggcaagaaacgcggccccaactcctcggagaagtagatatagccatgtctttgtgttttgatcccccactagtttccttgtactgatggcaagttgctgaagacttatatgctattattatctgtatcgatgtgttactgcaacactatgaaatatggtatgcatcgttgagcaaaaaacaaaaaanaaaag

SEQ ID NO: 7091 - protein, 62 aa, Zea mays
  misc_feature: Ceres CLONE 347346-F
  misc_feature (3)..(61): Pfam Name: Ribosomal_S30 Pfam Description: Ribosomal protein S30
MGKVHGSLARAGKVRGQTPKVAKQDKKKKPRGRAYKRMQYNRRFVTAVVGFGKKRGPNSSEK

SEQ ID NO: 7092 - DNA, 466 bp, Zea mays
  misc_feature: Ceres CLONE 347358-F
  misc_feature: Encodes the peptide sequence at SEQ ID NO. 7093
ccccacgcaattcccacatctcagcttcgccgccgccctcgttcgcccagcccagccgcctcctcccgtcctccgcctgtccatggaccgccgccatcgagccgtaccttactccgcgcgccagcagcagcagcggttcctccggcccggcgcgctcgcgcggctccgggactcgaggatcgtcgcccgctccgtccggtcgtcggcgtgcctcttgctcccgcggtccgcccctccgtctccgtcccccgcgcccccggtcgtcgccgcggacgagctggccgccgcaccgcgcttcctggggaccacgagcggctctggacggtacccgctccgcaggagggtcgtcgccgccaggggcgtggcgttctcgccgtcgtcgccgtagcctggcacggacggaggcgccgtagctgagaacttgtgactagatttgtgtttagttcagtattgctgtgcagatgtt

SEQ ID NO: 7093 - protein, 101 aa, Zea mays
  misc_feature: Ceres CLONE 347358-F
MDRRHRAVPYSARQQQQRFLRPGALARLRDSRIVARSVRSSACLLLPRSAPPSPSPAPPVVAADELAAAPRFLGTTSGSGRYPLRRRVVAARGVAFSPSSP

SEQ ID NO: 7094 - DNA, 711 bp, Zea mays
  misc_feature: Ceres CLONE 347396-R
  misc_feature: Encodes the peptide sequence at SEQ ID NO. 7095
ccaattgggtaccgggccccccctcgaggtcgacggtatcgataagcttttttttttttttttttgtagcaagcaaaaggtagtctccgatcaccaagttttagcttttgttcttgtttgttgagtagcaaacaggacgcagccaatcaactgaacacagggtaaaaaagcatcaaggtaaaaaaaaactcacgcgcttccttctttcttcttcattcttccttcttagtaagaagatctcctctaagtgcaaggtaaaaaaaagaacagcctcgaccaacggtgaatcaaggagagaccgagagagagaaaaaaggccgagcccacaacttaaaaacaaaagacccttttcatacatgcctatctctattacttatatatgagcagtggcatcgtcagcacctcctgtatatatatctaggacatcagctggcgaggggcgcgaggacgcacgggcgtcttggacgggctcacccttattggcaaggatcccagtaccacaccgctacagttgagagcggcagtagcactttctgccatcacgaattccacaaaagcgatgcgggtagaatgatggtagtcgccaagcaacctcagccgaaagacctcaccacatatggactcaaagaataactttagatctgcttgagtgaccttcttgtcaatgtttgtgcagtagatagtccttgcacacatttcacgttcatcgtc

SEQ ID NO: 7095 - protein, 40 aa, Zea mays
  misc_feature: Ceres CLONE 347396-R
QLGTGPPLEVDGIDKLFFFFFCSKQKVVSDHQVLAFVLVC

SEQ ID NO: 7096 - DNA, 711 bp, Zea mays; identical to SEQ ID NO: 7094
  misc_feature: Ceres CLONE 347396-R2

SEQ ID NO: 7097 - DNA, 1018 bp, Zea mays
  misc_feature: Ceres CLONE 347410-R
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (20)..(20): n is a, c, t, g, unknown, or other
  misc_feature (49)..(49): n is a, c, t, g, unknown, or other
  misc_feature (80)..(80): n is a, c, t, g, unknown, or other
  misc_feature (81)..(81): n is a, c, t, g, unknown, or other
nnnnggggtgggggggggtngcttctttggtgtggggcgaaaaaaacanggattatataaaaaataaaaagcggaggatnnaatacaaatgggtaccgggccccccctctaggtcgacggtatcgataagcttttttttttttttttttgaacaggcaaccacaaatgactcggcagcagttgccatggaatggtaacatagaacagaagcagaataccaccgcttaatgatttgtatgaacaccagatgacatcacttaaaaacgggatggagataagctcctagaaaagcccaaaaaccaagacaaaattaaattcaaggctaaatgctagtgcagagcacaagagccatatacctgatgcaatgtgtctagctcaaacgtgaacgtacccgcgtggaaacaaaggtgaggtcacgcggatggctccggggtagtgcggggaacaaacgttcacggtaaagaatcctgattaatgatacgacacaaaggggcccaaagaagaaaaatttaatgacaagaagatcaaggactattacctttgtgaaaagtctactagacctcgtgagggcgaccgaggaagcccgtttgctttgaaatgattgtttgtctctcattacacacaaaacacggcatcggctttcggcgccgatcggaaggaatccattggatactcggcaaaacaacagcggggtgggggacaaccccgctgtcgggaccaaattcgcacacaccccgataagggcttgcaaaaacaagggggaatggagacacagacacaaacaaagggaagagaaaaagcgaccacggaagggggcggagaataaatggtgtggcgccatacacactggggggtggaggatctatactatgaaaagtacatacccagttacatagtttctctctgatgtaaccaccaaaacagcggggcgtgccacaaagtgtaggtgtgcagcgtatatcaacgatacgcggccaattacaccataaaagtaccgtggattgacgtaaatcggcgg

SEQ ID NO: 7098 - DNA, 1106 bp, Zea mays
  misc_feature: Ceres CLONE 347423-R2
  misc_feature (1)..(1): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (743)..(743): n is a, c, t, g, unknown, or other
  misc_feature (823)..(823): n is a, c, t, g, unknown, or other
  misc_feature (953)..(953): n is a, c, t, g, unknown, or other
nccctaaaactacgtgttataacacccccttctccttnnnnnngcgaattgggtaccgggccccccctcgaggtcgacggtatcgataagcttttttttttttttttttgtaattcctgactcaatttattccggcccacgcatgacaaaaatagttttttctcctcctcactctaaagagactgttccatgcctagtaaaattgtttttcactagaaagtattattacatggtgaaagaaccctatggtgccgctgcagcagctgctgctggagccttcttgggcttctccacaacgattgcttgggtagccagcaccattccagccacggaggcagcgttctgcatgccgcacctaatcactttggcagggtcgatcacaccagcctccaccacgttctcgtgtttgtccgccatggatgttgcaaccgaactcccaactcgctttcccggattttatccataatcacactcacctttccacccccaacatttattgggctattaacctctgaagcgtggccccccaaaccccttctggaatgaaattccgcaccttaggcgcctcctccagggatcctctccaaccccctccctttgcatatgcccggtaccgaaaatggcctcataaaacgggcaatataacctctgtccccccgcccttcctgggaaaacaaagaaccctcttccctcccaatttggccgtgcgaaaacaaggtcctgcaatctctcttacggcgcgnacactcttcataattacggagagctcttttgcgcgctcccccctctaaagctctccgcttctcccagcccgcatagggtnctcaacccccttatacaccgccgaattaacctcctccacctttataaaacttttctcgcaatatctctctcttggcaacaactttttacgaaagccatttatctccgaagccccccctcaaaaaaaagcnctcctccctcacggtgccgataatattgcaccccggcaacacgccccttgttttaacacccagcgctaataaggtctcctaagacactcgaaatttttccttcccgaattagacacatctttcccccgtggtctctccaatttcttatcaatt

SEQ ID NO: 7099 - DNA, 1020 bp, Zea mays
  misc_feature: Ceres CLONE 347423-R
  misc_feature: Pfam Name: Cpn60_TCP1 Pfam Description: TCP-1/cpn60 chaperonin family
  misc_feature (217)..(217): n is a, c, t, g, unknown, or other
  misc_feature (673)..(673): n is a, c, t, g, unknown, or other
tccccaccgccacccttcccacccccctctccccctcaaaatcccaccccccccctgctgcctcttttattctgggccagaagtgactctacgggttttagctcctcatcagtgatatcaaggtgctacaggccctaaaaaaattgtttttcactaaaaagtattattacttggtgaaagaaccctatggtgccgctgcaccacctgctgatggagncttcctgggcttctccacaacgattgcttgggtagccagcaacattccagccacggatgcaccgctctgcagggcgcacctagtcactttggcagggtcgatcacaccagcctccaccaggttctcgtgcatgcccgccatgtcgttgcaaccaaactcccactcgctttcccggattttatacacaatcacctcaccttccacccaaacattatccgatatcaacgctccaagtgcccccacaccctcccgaatgatatcaacatcctaggagtttccaccagatcatccaaccgtcctcctagaaagccggtcaccacatggccactatctgcgacttaattctgcaccgccctcctgggaacaaaccaccctccctctattcgttgacaaaaactccgtcattccttcgcccttccatcctatgctggcctccttgggcgccccctactcagnttcctgcccctgggctccgaaaggcctcacaaccttttaacccacacccacatcctaccccccctgaaatagactatctcccacattctccctcctccccaactcttcccccaagaaacataaatcctctcaacaattccacctattaaacaaaacgtctccccctacttcgactcgacataacaatccccgagatcgaggctacaaccaccctcttctcaaccaaaacaccatctataataatgtctcctccccgaggcaaaccctcaaaattgtcccactttttccgcaaccaattaagcccctatttcctccacctcctcacactacccccccccatacaacaa

SEQ ID NO: 7100 - DNA, 479 bp, Zea mays
  misc_feature: Ceres CLONE 347504-F
  misc_feature: Encodes the peptide sequence at SEQ ID NO. 7101
atttgcgacaattcatctgcatacaggggcaacatatctagcagctactccgcccccaaatgctcgccggcatatcccgtttcctcactcgccgccgcccgccctttccgcttgccgctaccgcgctgcagcagccatgtcgtcgtcgtcgtccacggcagcgaacatctccgagcgtccgatctctccggacaccacccgcgtggcctgggtggggacgggcgtcatgggccagtcaatggccggccacctcctcgccgccggctacgctctcaccgtcttcaaccggacggcatccaagacccagggccttgtctcccgcggcgccagcctcgcggacagcccgcgcgcggccgccgcggctgccgatgtcatcttcctcatggtcggtttcccctccgacgtccgctccaccgccctcgatccatccacaggcgccctctccggcctcaccccaggcggtatcctcgtcgatatga

SEQ ID NO: 7101 - protein, 114 aa, Zea mays
  misc_feature: Ceres CLONE 347504-F
  misc_feature (20)..(114): Pfam Name: NAD_binding_2 Pfam Description: NAD binding domain of 6-phosphogluconate dehydrogenase
  misc_feature: SWISSPROT Homolog: EC 1.1.1.60 2-hydroxy-3-oxopropionate reductase
MSSSSSTAANISERPISPDTTRVAWVGTGVMGQSMAGHLLAAGYALTVFNRTASKTQGLVSRGASLADSPRAAAAAADVIFLMVGFPSDVRSTALDPSTGALSGLTPGGILVDM

SEQ ID NO: 7102 - DNA, 468 bp, Zea mays
  misc_feature: Ceres CLONE 347519-F
  misc_feature: Encodes the peptide sequence at SEQ ID NO. 7103
agtagtcctctcctcccatccatgcttcggtccacgcacccacccagccccaccagcggcagctccgcggcgccggcgtccagctccgacgccgcggcgatggtcgggggcggcgcggcggcgggcagcggcggcgcaccgagcggcgccaagctgctgcagatcctcaacgtgcgggtcgtgggcagcggcgaccgcgtggtggtgctgtcccacgggttcggcacggaccagtcggcgtggagccgcgtgctcccctacctcacccgcgaccaccgcgtggtgctctacgacctcgtctgcgccggcagcgtcaacccggagcacttcgacttccgccgctacgacacgctcgactcgtacgtcgacgacctcctcgccatcctcgacgcgctccgcatcgcgcgctgcgccttcgtcggccactccgtctccgccatgatcggcatcctcgcctcyatccgccgc

SEQ ID NO: 7103 - protein, 149 aa, Zea mays
  misc_feature: Ceres CLONE 347519-F
MLRSTHPPSPTSGSSAAPASSSDAAAMVGGGAAAGSGGAPSGAKLLQILNVRVVGSGDRVVVLSHGFGTDQSAWSRVLPYLTRDHRVVLYDLVCAGSVNPEHFDFRRYDTLDSYVDDLLAILDALRIARCAFVGHSVSAMIGILASIRR

SEQ ID NO: 7104 - DNA, 420 bp, Zea mays
  misc_feature: Ceres CLONE 347539-F
  misc_feature: Encodes the peptide sequence at SEQ ID NO. 7105
gcaaacccacgtttcaaaaaaaagagaggaaagcaaagttccttcttccctcggaaaaaaaatcagtctcgcaatggagagcagcgtaggcatagagaaggccgcagcggtggcggttggtgcaggtgtgggcggtggaggagggtacggctgcggcgggtgggagacgccgaagcgcgaggagtgccgcatcccggcgacgctgccgtgccccgcggcgccgaggaaggccgtgccggacttcgggaagcggcgcagcccgcccaagaacggctacttccagccgccggacctggaggcgctcttcgcgctcgcgccgcgccgccaggccttctgcgcgtgacttggcgcggactcgatttttggggagggagttgtagatagcttgccggtctcgctctgttgtactctttctagtgg

SEQ ID NO: 7105 - protein, 89 aa, Zea mays; identical to SEQ ID NO: 6918
  misc_feature: Ceres CLONE 347539-F

SEQ ID NO: 7106 - DNA, 458 bp, Zea mays
  misc_feature: Ceres CLONE 347589-F
  misc_feature: Encodes the peptide sequence at SEQ ID NO. 7107
aagcttctagggttttcgcgccgccgccgccgcttcgtcgtctccgccgcagcgatgccgtcgcacaagaccttccggatcaagaagaagctggcgaagaagatgcgccagaaccgccccatcccctactggatccgcatgcgcacggacaacaccatcaggtacaacgccaagcgcaggcactggcgccgcaccaagctcgcgcgccgtaagaccgtcaccgccatggacgtcgtctacgcgcttaagcgccagggccgcaccctctacggcttcggcggctaggcctgccgcgccgcgcttcgccgtcgctgcggttctggtgttgctgcagttcgcaagttgtttgtgtgggcggaaaaatgctagatactgtagaactgcagtgcggtatgctgcacatgctgtgtttgtctgaagaaatgttgtcaatgctggcttgctctggactcaaaaaa

SEQ ID NO: 7107 - protein, 76 aa, Zea mays
  misc_feature: Ceres CLONE 347589-F
  misc_feature (9)..(51): Pfam Name: Ribosomal_L39 Pfam Description: Ribosomal L39 protein
MPSHKTFRIKKKLAKKMRQNRPIPYWIRMRTDNTIRYNAKRRHWRRTKLARRKTVTAMDVVYALKRQGRTLYGFGG

SEQ ID NO: 7108 - DNA, 413 bp, Zea mays
  misc_feature: Ceres CLONE 347602-F
  misc_feature (292)..(292): n is a, c, t, g, unknown, or other
actcaacccaaacaccacaatccccttcaacaaacgcaccgcactccacggcagccagaaaacacaatccacagagtctccgtgaggtctgagcgaggtaggactagctctgagcgagttcttccgtcttccaggtataatcctagcaactctcactatcctcttcgcatcgctcgtctctttttgagaccagttggatttctcttatttttccttggatcctactacctaatagaacagagctccggagccttttagtttctggtctctgatctactcattttcttttctnccccttttggtgacataggtaggtctagttaagatctgtcgtgcctgttctttgattttagctaagaaccaggcgatttagtcttcttcttccttacaaaaaaaatccccaaaaaaaaaaa

SEQ ID NO: 7109 - DNA, 414 bp, Zea mays
  misc_feature: Ceres CLONE 347621-F
  misc_feature: Encodes the peptide sequence at SEQ ID NO. 7110
tcgattcaccacattcagctcgccgtgttgcggtcactcaaccaaatccaatcccggcggagggaagcgtcgtctaaattccaaccctaggccatggcgaatgcggcctcatccgcatcgtcgccgggggcaggttcctcctcctcgcagcaggccggtggagacgggggaggggacgcgcacacgccgcggcagcggcagggccggccctcgcgcgccggctccgacccgctcctcatcgtctgcggctgcttcagcgtcgtcacggttgccaccgcgctcctctgcgtcgccgtcaacgtcgtctccgccgtccagtccttccgcgccggcttcgacatattcgggggcatattccggtgctacgcggtcgtcttctcgctattcgtcgccgtcctcgagaccgagtggggg

SEQ ID NO: 7110 - protein, 107 aa, Zea mays
  misc_feature: Ceres CLONE 347621-F
MANAASSASSPGAGSSSSQQAGGDGGGDAHTPRQRQGRPSRAGSDPLLIVCGCFSVVTVATALLCVAVNVVSAVQSFRAGFDIFGGIFRCYAVVFSLFVAVLETEWG

SEQ ID NO: 7111 - DNA, 380 bp, Zea mays
  misc_feature: Ceres CLONE 347654-F
  misc_feature: Encodes the peptide sequence at SEQ ID NO. 7112
acttgtaccaggctataccagcatcagcgaagagccggcgttcttgagacttgagagaggagagcgaccgacgacctcgaagcttggcctgcgcggtggtgacgatggatgtcaaatgccggcgtctggaggggaaggtggccgtcgtgacggcgtccacgcaggggatcggcctagccatcgccgagcgcctcggcctggagggcgccgccgccgtcgtctcctcccgcaagcagaagaacgtggacgaggccgtggaggggctcaaggccaaggggatcaccgtggtgggcgccgtctgccacgtatccgacgcacagcaacgcaagaacatcatcgagacggccgtcaagaactttgggcacattgatattcttgtc

SEQ ID NO: 7112 - protein, 92 aa, Zea mays
  misc_feature: Ceres CLONE 347654-F
  misc_feature: SWISSPROT Homolog: EC 1.1.1.184 Carbonyl reductase (NADPH)
MDVKCRRLEGKVAVVTASTQGIGLAIAERLGLEGAAAVVSSRKQKNVDEAVEGLKAKGITVVGAVCHVSDAQQRKNIIETAVKNFGHIDILV

SEQ ID NO: 7113 - DNA, 482 bp, Zea mays
  misc_feature: Ceres CLONE 347669-F
  misc_feature: Encodes the peptide sequence at SEQ ID NO. 7114
gtgattttctgggtgaatttttcccggcctccgctccggccagatcggcgcgggtgaaccccggcccctaccgatccggatccgtccccatcgcctcgtgtgttttccgtcgagtattttagcgagtttgtcatggcgtctaagcgcatcctcaaggagctgaaggacctgcagaaagacccccccacatcatgcagtgcaggtcctgctggtgaggacatgtttcattggcaagcaacaattatgggaccacctgacagtccctatgctggcggtgttttcttagtgaacattcatttcccgccagattaccccttcaaacctccaaaggtttctttcaagacaaaggtcttccatcctaatatcaacagcaatggaagtatatgccttgacattctcaaagagcagtggagccctgctctgacaatttctaaggtcctgctctccatctgctccctgctgaccgactccaacccggacga

SEQ ID NO: 7114 - protein, 116 aa, Zea mays
  misc_feature: Ceres CLONE 347669-F
  misc_feature (5)..(116): Pfam Name: UQ_con Pfam Description: Ubiquitin-conjugating enzyme
  misc_feature: SWISSPROT Homolog: EC 6.3.2.19 Ubiquitin--protein ligase
MASKRILKELKDLQKDPPTSCSAGPAGEDMFHWQATIMGPPDSPYAGGVFLVNIHFPPDYPFKPPKVSFKTKVFHPNINSNGSICLDILKEQWSPALTISKVLLSICSLLTDSNPD

SEQ ID NO: 7115 - DNA, 517 bp, Zea mays
  misc_feature: Ceres CLONE 347751-F
  misc_feature: Translation starting site: 148
taatcgaaaaactcctcgacgtttcgtcggggtctctcgccgtcgctctctctgctctccaccatcctcctccccctcccctcgacctctcatcctcctcctgcttccccgcccggtcaacccataatccaaggcatacctgtgctgatggatcgattggaaatgcaggacgactcgaagagatccaataggcccaaatattctaagtttacgcagcaagagcttccagcatgcaagccactgctaactccagcaattgtcatttccgccttcttactggttggcatcctattcgtcccaattggtctcgcatcgctttctgcgtcacaagagattgtggagctggtagatagatacgatacaagttgtgtgcccgtggctgacaaagtgggttcattcagaacactaaaacggacaaatcatgcacaagaactctaactatccctaagcatatgaagagccaattcaaatatattaccagatcggtgacttctatcaaaaccatcgacggtatgtg

SEQ ID NO: 7116 - DNA, 481 bp, Zea mays
  misc_feature: Ceres CLONE 347766-F
ccgctaccaccttcatccatcctggcgtcggtgtcttgccctgccccagcgccgccgctccttcccccaccccgaagcgccgcctcttctgcctccgtcgacggtggtggtgctcctgatccccgccgttgaactggccataggagagcaaagaggaaggggaggccgcgagggcgccagtagatatattcatcttcatctcggcttgcgatatttttgaattttctattccgtattgaaggcgtcgatggccttgtccgccctaatcagcaccctcctcgccgccgccatctggtgcgccgcttacctcgccgctgccatctcctccgccttctgattcccactccccaaccctaacctcccccctgtagcacaccccacctctagctttgtaggtcctactatacttgcaacctctcccgctgactcgcttcgatctacccgccctcgcgtcaccatggggtacgcgcagctcgtcatc

SEQ ID NO: 7117 - DNA, 454 bp, Zea mays
  misc_feature: Ceres CLONE 347793-F
  misc_feature: Encodes the peptide sequence at SEQ ID NO. 7118
ggcggttaccgatcgagactagttccaaccaggagttggaaacgaaacctccacccaggagcccctgctcgagccggcggaggcggcggcccgagcagattaacagagcttttcgagcttgcaaggaggattcaacatgcggaggaagctgctgcagttcccgtccctcgtcgcgcagcacgccctccgcggggccccaacacccagattccaaccccagccccaccaccaccgcttcctgcactccccctccgcgcccacatccgcatccccttccccctccccgtcggcccacctcatatggaatcgcctctccggctctaccgggatctctcccttaccgaggaccgccgcggacgtcgcagcggccgcgcggaccgccgcgtcccggtggttggccaccgcgcgcggcgcccgctctctcgatctcttctcgctgccgcggtggcgcagg

SEQ ID NO: 7118 - protein, 106 aa, Zea mays
  misc_feature: Ceres CLONE 347793-F
MRRKLLQFPSLVAQHALRGAPTPRFQPQPHHHRFLHSPSAPTSASPSPSPSAHLIWNRLSGSTGISPLPRTAADVAAAARTAASRWLATARGARSLDLFSLPRWRR

SEQ ID NO: 7119 - DNA, 526 bp, Zea mays
  misc_feature: Ceres CLONE 347816-F
  misc_feature: Encodes the peptide sequence at SEQ ID NO. 7120
actgcggactagcttactgaatctaccccttgtaacctgtctatgtgtgcagcggctgagaaagcaagagctaagagtaatgggctcaccaaagaggcttcagtgccaaaggatgccaacggcaatgccatctcagcgcagactttcaccttccgtgagctcgccaccgccaccaggaacttcaggcctgaatgcttcctgggagaaggaggttttggacgtgtttacaagggccgcctcgagagcacaggccaggttgttgctataaagcagcttaacagggatgggcttcaaggaaacagagaatttctagtagaagttctcatgctcagcttactacatcatcaaaacttggttaatttgattggctattgtgctgatggagatcagcgacttcttgtttatgaatatatgccctctggatcacttgaagatcatttgcacgatatacctcttgataaagaggccttggactggaacaccaggatgaaaattgcagcaggtgctgccaaggacyggagtacct

SEQ ID NO: 7120 - protein, 161 aa, Zea mays
  misc_feature: Ceres CLONE 347816-F
  misc_feature (47)..(161): Pfam Name: Pkinase_Tyr Pfam Description: Protein tyrosine kinase
  misc_feature: SWISSPROT Homolog: EC 2.7.11.1 Non-specific serine/threonine protein kinase
  misc_feature (159)..(159): Xaa is any aa, unknown, or other
MCAAAEKARAKSNGLTKEASVPKDANGNAISAQTFTFRELATATRNFRPECFLGEGGFGRVYKGRLESTGQVVAIKQLNRDGLQGNREFLVEVLMLSLLHHQNLVNLIGYCADGDQRLLVYEYMPSGSLEDHLHDIPLDKEALDWNTRMKIAAGAAKDXST

SEQ ID NO: 7121 - DNA, 1243 bp, Zea mays
  misc_feature: Ceres CLONE 347820
  misc_feature: Encodes the peptide sequence at SEQ ID NO. 7122
ccaggccaagtcgtctcctcttccaccaccaagctcccgtctcttcacctcctggtctcagcgactccatcctctccctctccagatccccgcccgtgacgccgccggctgttacatctccggactccggctcatcgtcctcaggtccaggtcttgatccgcgatccgccgatttccatccggcgcttagggcgctactcggtgtcccgtcagctgcgggttttgctgtgcggggaggctgatccggcgagcgccttggatgaattcgcgccggtctcggtcggtgaagctggtgtcagcgcgcgccaacggggacggggccctggaggtggacgtacctgaggaagagggggacgcgcggatgagctcctcggccgccaacaccgtgtactgctgcatcgccaggggccggagcgtgatctaccggtacagcagcaagggcggcgacccgcaggcggaggccacggcggcgctctgcctggaccggtcgccgccgcaccaccggcattacgtgcacacctccgggcgcaggagctacgggtacctgacggccgacggccacaccttcttcgccatcatcgaccccagcgtcggcagcgccggcgcgctgcagttcctggagcgcgtacgcgacgcgttccggagcagcgcaggcggcggcggcgggcgccagccgcacgagtcgctggtgccggccgtgcagcggctggtggcgtcgctggagaagatgccccacgccgcgttcgtgctcgatggcgcgggcgcgggcgcgggcgacggcgacggcgacggctgcacgtcgtcgtcgtccaaggcgcccctgctcgggaagagcgggagcaggaaggagaagcggcggtccagggacaagctgtcgtcagcggcggcgggggcggggggctgtgaggacgagcaccacgggacccgagcggtgaggatagacgtgatgccggccgaggacgtcggcggcatgtcgctggagcgcagcggcagccagtccaggctgcggaggcagcagtcgtcgcggtcgctgtggatgcggcacgtgaaggtcatcgtcgccgtggacgccgtcgtctgcctcgtgctgttcgcggcctggctggcggtgtgcaaggggttccagtgtgtgtccgggtgatggtgatcggttgtgtacagtagtacagtgtttgtggagagctgaggatggattcaatgcaaattgcctatttcgattgattgaacaaaaaaaaaaaaaaaa

SEQ ID NO: 7122 - protein, 293 aa, Zea mays
  misc_feature: Ceres CLONE 347820
MNSRRSRSVKLVSARANGDGALEVDVPEEEGDARMSSSAANTVYCCIARGRSVIYRYSSKGGDPQAEATAALCLDRSPPHHRHYVHTSGRRSYGYLTADGHTFFAIIDPSVGSAGALQFLERVRDAFRSSAGGGGGRQPHESLVPAVQRLVASLEKMPHAAFVLDGAGAGAGDGDGDGCTSSSSKAPLLGKSGSRKEKRRSRDKLSSAAAGAGGCEDEHHGTRAVRIDVMPAEDVGGMSLERSGSQSRLRRQQSSRSLWMRHVKVIVAVDAVVCLVLFAAWLAVCKGFQCVSG

SEQ ID NO: 7123 - DNA, 703 bp, Zea mays
  misc_feature: Ceres CLONE 347846-R
  misc_feature: Encodes the peptide sequence at SEQ ID NO. 7124
cgattggggaccgggccccccctcgaggtcgacggtatcgataagcttttttttttttttttttcttttttttttttttttttttttttttttttttttttttttttttttttttttttttacggaaagcgtactattattgggtttaggttggttttgggatgaggtaaaaattaaactatgctaagggtccgtttggcaaggcagccttgtctcgcttcgagctgatgcgtcaactcctcaatcaaactaaacagatcggaacctgcacatcatcacaaaacaaaaccatgcgtttcgaaaaatcaagtaacagagcaagactccccgttgttcgatcggaccaagcatctgatcctgaagccacccggaggctcaaatctagacgaaaagaggatttcctcaggcaagaggaacgcggcgacttttcttcaccaaggtccaaggcttttgattaggatgttctagggaatggtctcgtgcgaattcctgcagcccgggggatccactaattctagagcggccgccaccgcggtggagctccagcttttgttccctttagtgagggttaattgcgcgcttggcgaaatcatggccaagctgtttcctgggggaaaatgttattcccctcccaattcccccaacatacaagcccgaaacaataaaaggaaaaaccccgggggcccaaagaagggaacttacc

SEQ ID NO: 7124 - protein, 54 aa, Zea mays
  misc_feature: Ceres CLONE 347846-R
RLGTGPPLEVDGIDKLFFFFFSFFFFFFFFFFFFFFFFFFYGKRTIIGFRLVLG

SEQ ID NO: 7125 - DNA, 483 bp, Zea mays
  misc_feature: Ceres CLONE 347847-F
gcacaagctgctccgggctccgctgctaggctagggtttggactttggattggagccgcaccgccgcaccgccgccgcagtgccgcacagccgccactcccgtcttggtcttgcggccagtcgccctcgggcctcgaccatcagcccctcgcccgctcgccgagacaccgagtcggcatcgaccgtcgtcgcgtctccgaggtccagcgcctagtggcccagctccaagcctccagccatcggcgcccgccctcctccgacgagacgccgagtgccgagcgcccgagcaccccggtccccagcgcccaacaagctagcaggctgcaggtatgcgctctttgttgatgcgtccaaggagttgagctgaatgcccagaaggctagcaggctgcagaaactgaaggaaaaggcggcattcaggaacccggatgagttctattttaaaatgatcaacagtagggctgttggtggaattcatagacct

SEQ ID NO: 7126 - DNA, 463 bp, Zea mays
  misc_feature: Ceres CLONE 347984-F
  misc_feature: Encodes the peptide sequence at SEQ ID NO. 7127
ctaccgggcgggagagagccaggaagaggagggcgacgatggcgtccggctggggcatcaacgggaacaagggccgctgctacgacttctggctggagttcagcgagtgcatgagccgctgccgccagccctccgactgcggcctcctccgcgaggactatctcgagtgcctccaccactccaaggagttccagcgcaggaacaggatctacaaggaggagcaacgtcagatcagagctgctgctcgtaaggccaaggaggaagctgagggtgcccctgctgttgcagcacaccattagtctccctgtctattttttgtgttgttgttttctgttaactcatctttggttcagttatgatgctaagggcaaggcaataatctccagctgttggactacacagattttttcccccatgacttaaatatcaagactcattttgtgcttctgctggtttctgcttg

SEQ ID NO: 7127 - protein, 86 aa, Zea mays
  misc_feature: Ceres CLONE 347984-F
MASGWGINGNKGRCYDFWLEFSECMSRCRQPSDCGLLREDYLECLHHSKEFQRRNRIYKEEQRQIRAAARKAKEEAEGAPAVAAHH

SEQ ID NO: 7128 - DNA, 457 bp, Zea mays
  misc_feature: Ceres CLONE 347989-F
  misc_feature: Encodes the peptide sequence at SEQ ID NO. 7129
actccgtactcgccgctcctcccccgtcgccgccggaaatcaggaagcccaagtgctcccttgggtgcgctcgtcgccggtggcagtgagccagtgatgcaccttcatctccggcttccttactaggatcagcccgtcgatcgatcatggcgtcgtcgagctcggctgctactaccagtggcgacagtcagggcctcaaggctcgagatgcctgcatcgtcggcgtcgcccgcacgcccatcggcgcacttctcgggtcgctgtcgtccctccccgccaccaagctcggctccatcgccatccagggtgctctcaagagggcgaaggtcgacccggcgctcgtgcaggaggttttcatgggcaacgtcctcagcgccaacctcggccaggctccggcaaggcaggcagcccttggcgccggcttgccaactccgtgccatgtaccacatcaacaaag

SEQ ID NO: 7129 - protein, 103 aa, Zea mays
  misc_feature: Ceres CLONE 347989-F
  misc_feature (19)..(103): Pfam Name: Thiolase_N Pfam Description: Thiolase, N-terminal domain
  misc_feature: SWISSPROT Homolog: EC 2.3.1.9 Acetyl-CoA C-acetyltransferase
MASSSSAATTSGDSQGLKARDACIVGVARTPIGALLGSLSSLPATKLGSIAIQGALKRAKVDPALVQEVFMGNVLSANLGQAPARQAALGAGLPTPCHVPHQQ

SEQ ID NO: 7130 - DNA, 744 bp, Zea mays
  misc_feature: Ceres CLONE 347991-R
  misc_feature (41)..(41): n is a, c, t, g, unknown, or other
gtgtttcgccccgcgggggcccccgtcccctcctttccccnatccaccgacacctttcgtattgggtaccgggccccccctcgaggtcgacggtatcgatattttttttttttttttttcaaaaagagtcaatacgatcaatatagaacacaggtccataatgatggacgaaacaagcttcagcatactaaccacggtcatccggaaactgatgccaaaactttgtcacggtcatcccacgccaaatttcggacaacacaagcctaagcttgtgaaaggggaaacaaacaatgtaaaaacagaaaataccaggatagtcttacagtcaacatctaatctaataatttataaccaatgtaaatacaagcctaagctttgccgtacgttgcctcacagcaagtagaactgcgagtacagaagctccctgattttgtaacagtcctcgcagagggggccctcgatgaggatctggtgcacaccctgtgctgccctttaggatagaatcaccaactttgcgcaccatgatgtattcgccacaccgtaaaccacctccggcaaattcaacctgccagcctttgttttccacaaattgtttaaaatcgcaacaactttggatcacccacaataacaggctttatggaggtggtgggtgtggaccaatggggggaaacagaaaaaaagctatctccttcttccttttcccaagcttccgcgaacccccccacggcaattttcgctcgctcc

SEQ ID NO: 7131 - DNA, 459 bp, Zea mays
  misc_feature: Ceres CLONE 347999-F
  misc_feature: Encodes the peptide sequence at SEQ ID NO. 7132
acaccgagaatcacaatacgaaacgaattaatccccaatcaacacagcaagtcagcaacaagcaaagcagcgatccgagagatggacgcgaggatgttcgggctggagaaccccctggtggcggcgctgcatcacctgctggacgtgcccgatggcgacgccggagcgggcggcgacaaggcgggcggcggcgccacgcgcacctacgtccgcgacgcgcgcgccatggcggccaccccggccgacgtcaaggagctcgcgggagcgtacgcgttcgtggtggacatgccggggctgagcacgggcgacatcagggtgcaggtggaggacgagcgggttcttgtgatcagcggcgagcggcgccgggaggagcgcgaggacgccaagtacctgcgcatggagcggcggatgggcaagttcatgcgcaagttcgtgctgccggacaacgccgacgtggac

SEQ ID NO: 7132 - protein, 126 aa, Zea mays
  misc_feature: Ceres CLONE 347999-F
  misc_feature (55)..(126): Pfam Name: HSP20 Pfam Description: Hsp20/alpha crystallin family
MDARMFGLENPLVAALHHLLDVPDGDAGAGGDKAGGGATRTYVRDARAMAATPADVKELAGAYAFVVDMPGLSTGDIRVQVEDERVLVISGERRREEREDAKYLRMERRMGKFMRKFVLPDNADVD

SEQ ID NO: 7133 - DNA, 466 bp, Zea mays
  misc_feature: Ceres CLONE 348066-F
  misc_feature: Encodes the peptide sequence at SEQ ID NO. 7134
atagtatagcgtagtgtagtatatgtacctgcaggcagcagcaacgatgccgcagccatggttagttgtttgtataataatactctgccgttttgcacccctagctagcgctacaactcctccgccgcctatccaccacatctatttcgccctatccaccaggacttacgatgatctgtatagcgaggagcaggtcggcatacgatccccggcccacacgtgatgcaaagataatacatccatgtcgtcggcgccggggaagaagacaaggtaactctggccatagccatcgattgccttatatattatcggcttcagtaacgccaccggccattggtgcaagtttagtggtggagacttgttcttgttcaaaggtctgccggtgccgggagccaccgagctccccggtcacaatgaactatggacaactgatccagggagggcacaccgagcttaawttggcggg

SEQ ID NO: 7134 - protein, 98 aa, Zea mays
  misc_feature: Ceres CLONE 348066-F
  misc_feature (96)..(96): Xaa is any aa, unknown, or other
MICIARSRSAYDPRPTRDAKIIHPCRRRRGRRQGNSGHSHRLPYILSASVTPPAIGASLVVETCSCSKVCRCREPPSSPVTMNYGQLIQGGHTELXLA

SEQ ID NO: 7135 - DNA, 416 bp, Zea mays
  misc_feature: Ceres CLONE 348098-F
  misc_feature: Encodes the peptide sequence at SEQ ID NO. 7136
agacaacaacgagttaacgaaagccttttatccaagctcaggaaagctcacagtttcgttggatccaatcttagttttatccaagctcagcaatggcttctcgtcagcagcatcctactagctaccacgccggcgagacaaaggcccgtgccgaggagaagacgggtcaagtgatgggggcggcgcaggagaaagggagggaggccaagcacaaggcgtccgacgccgccgaccgcgccatggggatgggccacgacgccagggaggcgaccagggagaaggcgcgcgccgccgcggaccgaaccatggggatgggccacgacgccggggagacggccaaggacagggcgtaccgggccaaggacgcggcctccggtgccgctgtccgcgccagggacactgcgtccgacgcggcc

SEQ ID NO: 7136 - protein, 108 aa, Zea mays
  misc_feature: Ceres CLONE 348098-F
MASRQQHPTSYHAGETKARAEEKTGQVMGAAQEKGREAKHKASDAADRAMGMGHDAREATREKARAAADRTMGMGHDAGETAKDRAYRAKDAASGAAVRARDTASDAA

SEQ ID NO: 7137 - DNA, 799 bp, Zea mays
  misc_feature: Ceres CLONE 348176
  misc_feature: Encodes the peptide sequence at SEQ ID NO. 7138
aaaacactcgtctgagccaccaaacacttgctatgcccgctcctccccgcgcactgctcagcacgccgtgcccgtgagaccatggacgcgagcgcggccaccgccaggcgcaagcgcaagcgccccgacgccgacaaggcctcggacgccgaggtcgaggagttctacgccatcctgcggcgcatccgcgacgcctcccgccggctgtgcggcgccggcgcccggcccgccccgcgcgcgccggcgtggcggcccagcttctcctgggaggacttcgcgacgccggcccctggcgcgccggcgcctgagaccccgacccccgcgcagcaggagccagcgcagccgcggcccgacgagcctgtagccgtcgtccgcgctaccgccccgtcgccgcgtgccgggctggacctgaacgcggagccggagccggaggcgccggccacccctcgctcggcgcgcgtccaggcgtagcgtagcgcgcggcgcatcgtcgcctgcctcctgcaccgcgccaagttgggcccgcgcgtcagctcggctgctgggaggcgggcggcacagcacacacagtgcgtaccttcccctcggtgaattactgatacgaatccccatcatgtaatcgtatttttttagtggctctctttggtgcgctgctccgtgtggacaggtgagactggttcgttgctttggttgcaggaaaataccttttaatcggatcagttgatgtaccgtccgaaaaaatgacgtgtttaactattcgttgcgttttatgtatcaaaaaaaaaaaaaaaaaaaaaaa

SEQ ID NO: 7138 - protein, 129 aa, Zea mays
  misc_feature: Ceres CLONE 348176
MDASAATARRKRKRPDADKASDAEVEEFYAILRRIRDASRRLCGAGARPAPRAPAWRPSFSWEDFATPAPGAPAPETPTPAQQEPAQPRPDEPVAVVRATAPSPRAGLDLNAEPEPEAPATPRSARVQA

SEQ ID NO: 7139 - DNA, 463 bp, Zea mays
  misc_feature: Ceres CLONE 348228-F
acacacactcctcactcccatcccagccgccacacggtggacgctgcagctgctgcagacagctgctgctcgccctctccctgtctcctctctatttcccagccacggtttccccttcccccgtccgcacgttagggcacgaggcaaatctgtggccctctcctagtctcccgaagtccgactcagccgtctcccatctcccgctcgctcgaactcgggttggggaggcacggagtcactgaccccttcgcgtttggcggtgcccctgcaccggctcttcgtctaaggtgtagtcaagctgccggccacgcccggcacccccctatccagtacaaggccttctccgagatccagtacaaggtcgtctccaagatccagtacaaggtcgtctcctccaagatctgaccccgacgctagtgagggaagagagggtggacgaagtggggaggatgagcgaggagag

SEQ ID NO: 7140 - DNA, 435 bp, Zea mays
  misc_feature: Ceres CLONE 348264-F
  misc_feature: Translation starting site: 12
  misc_feature: Pfam Name: DUF1308 Pfam Description: Protein of unknown function (DUF1308)
agcgagcgaaaatggatgcacggtttgtgtgcgccgccgactctgagctccagctggcgcaggcgcaggcccggtgcgtcgcgctgcaggaccacctcgccgcttcgccggacctgccacgccatcccgcgctccgctccctccttcgcctcgtcaacgccgagctgcgcttcctctcctcgctccgtctcgcccctgccacgccgctctcctccaacctgccccacctcgtggcgctccacctcgtcctcacccaccctgccatacggagcccgtcccggctctcgccgctccccggcgtagatttctcctgcgccttccgcggccggcccgcgtgggtgctcgtgtccgcgagcaaccccgccaggcttgcctgggccccgcccgggggtctccgtgcccgcttcgcggcggcgctagaagccgcgcgcggtg

SEQ ID NO: 7141 - DNA, 737 bp, Zea mays
  misc_feature: Ceres CLONE 348314-R
  misc_feature: Pfam Name: DUF1680 Pfam Description: Putative glycosyl hydrolase of unknown function (DUF1680)
  misc_feature (737)..(737): n is a, c, t, g, unknown, or other
cgattgggtaccgggccccccctcgaggtcgacggtatcgataagcttgatgggctcaccagcaggcagtggcttaggagcttgaagttgaccgggtccacccgaagcttgtgcgcgtgcaggtcgctcagggcggacagcgcgttgggcatgtcgtccacgtgcgccacggcgttggtcagcgcgtcggccaccttcttgccgtggcccttaacctgggcagagccgtggctcaggtcgaagtgcgggaagtaggtcttggtggtggggaaggacaggaacatcctctccagggcctccgcacgatactcgccagcgtgcgcgccgaccttaccccaggcggccttgacgttggtcttgtcatcgaattcaccagcagatgtgccaccagttgcgtagctatgagaagaatttattgtatccataaagaatgacgcaatttgcttgtaaagaggatctccagtaacttcatacctcatttgcgcaccaatgacaactggaatgtgtgtgtttgaatgaaaaccggaaatactgtcagcctgaactgccagcaacccaagaaagcatggcttatcgaagagatgagctagtgtcaaatgcttcatatcgtgcgttatcgtgtagagctgatagagaacatcattcatcccaccagtctcctcattgagagattcccagtgcctctcaatgctataattctgtatgacattcttcacccggtcactgaaataattagn

SEQ ID NO: 7142 - DNA, 583 bp, Zea mays
  misc_feature: Ceres CLONE 348316-R
  misc_feature: Pfam Name: DUF936 Pfam Description: Plant protein of unknown function (DUF936)
  misc_feature (497)..(497): n is a, c, t, g, unknown, or other
cgattgggtaccgggccccccctcgaggtcgacggtatcgataagcttttttttttttttttttcagtaccaaaacaaccactgcaatctcaatccagcccatttttacatttaaatccagaccggcccatgttttggctcagccaagttaacggcccaattgggccttccttcgcggcccactatcgtcaccccttcttcccgttcgccaccggtgccggcgccatctcgcagccgccgagcacggcggcagcagagtccacgttggtgaggaggtactcgtagatcttcttcctgagcctctctatcgtctcctccggcacgccgctggccgcgccgccgttggcagtgggtgccgccgcttcgccgtccgcttccggtggcggatgcggcgccatctctgccgacttcccgatctcgctcagccagtcgttgacgcgcttaagctgcgggagcatcctcgcggcgcggtcgcggtcccacggcgcggccgccgnaacgcccgcggccgggaagcgccccgcgagcgccgggaacacgcccgggcgggaggcgcgagaccgcggcggagatgtgcctggtg

SEQ ID NO: 7143 - DNA, 449 bp, Zea mays
  misc_feature: Ceres CLONE 348332-F
  misc_feature: Encodes the peptide sequence at SEQ ID NO. 7144
acaatgtggcccagcctcaaaaggcccaataggtggtcactctactacccgaagccgcgggctcaaccctaactgacccagagcgatcggagctgacgacgatggccgggaaggcggcggccgcgacggcggcgaggtgggcggaggggtacccgtggaaggagaagctggcaaagtacaagggtgagctcgggaagggggtgtggggatactgggagctcggcgcgtggaagccgctcggcatcagcgctcgcaagcgcgcccgcctccgcaaggaggtgctcctcgccggcgaggactggagctacgatcctccccgcggggagatgcgtaccaagcgcaagggccacaagtgcgaccgcatctccgccgagaagcgagcaaatactgttgagctgatgaagaagatgccccagatgctgctcgactacaagaaacgtwggtgggag

SEQ ID NO: 7144 - protein, 116 aa, Zea mays
  misc_feature: Ceres CLONE 348332-F
  misc_feature (114)..(114): Xaa is any aa, unknown, or other
MAGKAAAATAARWAEGYPWKEKLAKYKGELGKGVWGYWELGAWKPLGISARKRARLRKEVLLAGEDWSYDPPRGEMRTKRKGHKCDRISAEKRANTVELMKKMPQMLLDYKKRXWE

SEQ ID NO: 7145 - DNA, 502 bp, Zea mays
  misc_feature: Ceres CLONE 348430-F
  misc_feature: Encodes the peptide sequence at SEQ ID NO. 7146
tcctgggtcctggcttctccttccactccggagatcgacggctgcttgccgcactcgcgctcgctcccacggccggcaaccatggccgccgccgctgccgcggtgccagccaccttcctctcgggcctcccctctccacggaccccgtctcctgtgctccactcgcccgtacagagagcccatcccgtcgccgctcctctcttcctctccgccaagcgccgcgcctatgcctgcgccgccacggcctccggctccttctattcctccaactcaggaaatcaaacctcactgatgccgtcgttcagctttgcatttgacgaaggttcttctagttccaaaaggctatatagatggaagagggtattgcttaaagtaagtggagaagctcttgccggcgaccacacagaaaacatcgacccaaagattacaatggctattgcaagagaggttgcttctgtcaccaagctaggtgtagaggttgctattgttgtttggcggtggc

SEQ ID NO: 7146 - protein, 140 aa, Zea mays
  misc_feature: Ceres CLONE 348430-F
MAAAAAAVPATFLSGLPSPRTPSPVLHSPVQRAHPVAAPLFLSAKRRAYACAATASGSFYSSNSGNQTSLMPSFSFAFDEGSSSSKRLYRWKRVLLKVSGEALAGDHTENIDPKITMAIAREVASVTKLGVEVAIVVWRW

SEQ ID NO: 7147 - DNA, 475 bp, Zea mays
  misc_feature: Ceres CLONE 348652-F
  misc_feature: Encodes the peptide sequence at SEQ ID NO. 7148
atctttgtggtcgtggtcctcccgtcgtcgtcgactcgtcgtcgtcggtgttgctccgatgggcaaggactcgaagccgaaggacgccaaggggaagggcaagcaggcggccggctcctctggcggcgacgacggcggcggcaagggaggcaagggcaatggcaagggcaagggcggcaagtccgctgacggactcggcacttgcacctacgtcaaagctaggcacgtattgtgtgagaagcaggggaagatcaatgaagcttataagaagttgcaggatggatggctgaataatggggacaaagttcctcctgctgagtttgctaaggtagcacaagagtattctgaatgcccatcagggaagaaaggtggagatcttggttggttcccgcgtggcaagatggctggtcctttccaggaggttgctttcaacacacctgagggaactgttagcgcaccattcaagtccacgcac

SEQ ID NO: 7148 - protein, 139 aa, Zea mays
  misc_feature: Ceres CLONE 348652-F
  misc_feature (56)..(139): Pfam Name: Rotamase Pfam Description: PPIC-type PPIASE domain
  misc_feature: SWISSPROT Homolog: EC 5.2.1.8 Peptidylprolyl isomerase
MGKDSKPKDAKGKGKQAAGSSGGDDGGGKGGKGNGKGKGGKSADGLGTCTYVKARHVLCEKQGKINEAYKKLQDGWLNNGDKVPPAEFAKVAQEYSECPSGKKGGDLGWFPRGKMAGPFQEVAFNTPEGTVSAPFKSTH

SEQ ID NO: 7149 - DNA, 245 bp, Zea mays
  misc_feature: Ceres CLONE 348658-F
gcccgtggaaatatccacccgcggtccgggtcaccccgcaaggccgcaacgcctccgctttcattcttcttctcttttctcgttccccccgttggggttttgagctccgacgaaccctaataatcgccggggaccggcgaccgatcgcccgccggcrtgcaccattagcagcggatgaagcaggcagcggcggccgcggccgcggcgcagcaggcactgcatccatgcagcagcagtcgcagccg

SEQ ID NO: 7150 - DNA, 420 bp, Zea mays
  misc_feature: Ceres CLONE 348677-F
  misc_feature: Translation starting site: 142
aattcaggcgaggccgacgggctcgcagcgcccgcggggcatccaagagcaggaggggataaagcagccctgcagcagctccctccttcacaagcgacgcgaagcaccgaggagaggcggcgagagttcttggtcggctagatggaaaaggcgggccagaagcggcggccgctgacggtgatggcatcctcatcgtcgcaggtggcagcagcgcggggcatgggcatgaccaacccactggcggagtggaccgaccgcgtcaggtcgctggaggccggcgtgcgggcgtggctagctaagcagcccacccacgtcgaggccgccgtggtcacggcggtcggcgccgtgcagggcgccgcgctcggcgggctcatgggcacgcttgcgcccgacggcggggccgcgctccctgtgccgccg

SEQ ID NO: 7151 - DNA, 453 bp, Zea mays
  misc_feature: Ceres CLONE 348737-F
  misc_feature: Encodes the peptide sequence at SEQ ID NO. 7152
accacgttttttcatgcaaaacaaaagctttcgtgccatttgccgtccggtccgaccgccttctccgcgagcgctaggagcaataaacggcaggcaccattctcggactcggaggcaacgcccagacgcgcaagcggaaggaagggggagcgcaacacgcgcggtcgccgggagagagagagagagaaagggcgagctagcgagcgagatccccctctcccgctgccggatccgatctgacctgacctcgtcgccgcctgccgtgggagggagaagaggaagaggaggcggaggcggcggagatggcaccggtgtcagcgctcgccaagtacaagctcgtcttcctgggggaccagtccgtcggcaagacgagcatcatcacccgcttcatgtacgacaagttcgataacacctaccaggctacgattggtattgatttcctgtcaaagacaa

SEQ ID NO: 7152 - protein, 50 aa, Zea mays
  misc_feature: Ceres CLONE 348737-F
MAPVSALAKYKLVFLGDQSVGKTSIITRFMYDKFDNTYQATIGIDFLSKT

SEQ ID NO: 7153 - DNA, 442 bp, Zea mays
  misc_feature: Ceres CLONE 348763-F
ccaccagtagtcctactggtccttgacgtccgtggccactcaggttgtgttctctgagttctttcgccgggtggggaggcggagtgcgcggtcgaggaaggcccccttagcggtcggatcgatcggcgccgtgcttgactgcctgtacatgaggagcggctgcggcggcggcggcggagggagacaacctggggaaggaggcgggggaggcgctggggctgctgggctgcgtcaatgaggtggtggcggcggtggcggccacgtgggggcccatgaccgacggcgcgcgcgtcgagacggcgcccaggctcgcccaatggcgcgtcgacccgctcccctgctacacctaccgcaagtcactccccttcctcatcggcctctggaactggtgcatatctgtggagagaaataacaagcaaaccctgtgttaagctctttgcag

SEQ ID NO: 7154 - DNA, 413 bp, Zea mays
  misc_feature: Ceres CLONE 348775-F
  misc_feature: Encodes the peptide sequence at SEQ ID NO. 7155
acaggctgtacgtagggccgtgccgtcgcccctccttccttcgtcgatctctctctcggcgacgactgggcgaccgctgcctcctgttgccctggtctccattgggccctttgccagattttctttcgcctctccgccggcgacgaacaccaccaccaggaatgggcttgtggacgttgctggagggttttttgcttcttgcaaatgcgttggctatattgaatgaagaccgctttctcgctccaaggggatggagcatgtctgaagtatcaggaaatgggcaaacgaagtcgttgaagggccagatcgtggggctaatctatgctacacaatttctgaggattcccttaatagcactcaatgttctgatcattgttgtgaaactggtgtctggctgaggctcattatctagt

SEQ ID NO: 7155 - protein, 78 aa, Zea mays
  misc_feature: Ceres CLONE 348775-F
  misc_feature (3)..(78): Pfam Name: Yos1 Pfam Description: Yos1-like
MGLWTLLEGFLLLANALAILNEDRFLAPRGWSMSEVSGNGQTKSLKGQIVGLIYATQFLRIPLIALNVLIIVVKLVSG

SEQ ID NO: 7156 - DNA, 445 bp, Zea mays
  misc_feature: Ceres CLONE 348795-F
  misc_feature: Encodes the peptide sequence at SEQ ID NO. 7157
cttttttttccgcttctgcgcgaaaaataaaaaaaaaacgaagcgaaagcgaggctgctgtctcacggctgcggctgcggctgcggcggttcgggctcctcctccagactccagggatggccgccggtgcgggaggcggcgaactggaggcgctggagggcgtgcgctccatcgtgctcaagccgtcggagtcgctcgacgagtcgcggttcacgaggatcgccggcgccgacttcaacgacccggccgtcggactcgaggggctgctcgcctcgctcgcgtccaccgggttccaggcatccaacctcggcracgccatcgacgtcgtcaaccagatgttagactggaggttgtcgcatgagaagcccagcgaggattgtgatgaasctgaacttgaccctaaatatagagcatctgtgaagtgcaagatatttctgggcttcac

SEQ ID NO: 7157 - protein, 109 aa, Zea mays
  misc_feature: Ceres CLONE 348795-F
  misc_feature: SWISSPROT Homolog: EC 2.5.1.46 Deoxyhypusine synthase
  misc_feature (66)..(66): Xaa is any aa, unknown, or other
  misc_feature (91)..(91): Xaa is any aa, unknown, or other
MAAGAGGGELEALEGVRSIVLKPSESLDESRFTRIAGADFNDPAVGLEGLLASLASTGFQASNLGXAIDVVNQMLDWRLSHEKPSEDCDEXELDPKYRASVKCKIFLGF

SEQ ID NO: 7158 - DNA, 460 bp, Zea mays
  misc_feature: Ceres CLONE 348811-F
gcttagatctcattggcgcacaaatcagcaacaggcgcggcgaagcaaatggggcgtctgtagtccggaggccttcttagtttaggggctctggcccaggtcgaccttgttttttttttccaatagcggattagcccaacagagaacctttcacggccctgctagagagagtttaacaatcaaaatagaaaacagaaacaaaattcatcagagtgagagttcatcttcttctccaagctgatttctgcttgttagctactcacgtcaacagaaaatctcgcgttcagctcctctccagtctctccgcctcccgcttacttctctgactctgtcctctttcgtttctttcttgtcggcgacggctggcggctggggtgctgcgccgctctcaccttcaccgccgacgagcattcacaagtagtggtctcttactggtggcggcgtagaggtgacgaaaaag

SEQ ID NO: 7159 - DNA, 163 bp, Zea mays
  misc_feature: Ceres CLONE 348817-F
agattgcttgagatagccttactgcggccgcccctttctgctgcgtcgagggtacgaaatcaacccaaaccctagcatcccctttgctcgagggagacgaagatgggccgcccgaagaggaagatgagtggcgacggcgtggtagaatcgccagctgacgagt

SEQ ID NO: 7160 - DNA, 509 bp, Zea mays
  misc_feature: Ceres CLONE 348872-F
  misc_feature: Encodes the peptide sequence at SEQ ID NO. 7161
cattcccttcgtgcttgtttgctctagggtttttgccacgccgccgccgctctgccccttccaccccaccgatataccaagatgacggcgcaggctgcggaggagctcgccgcccagatcgagcagcagaagctcgaggagcagaagaccgaggcagaagaggttgtggtggaggaggatgacgaggatgatgaggatgacgatgatgatgacaaggatgatgatgaactggatggacaagaaggggatgggagtggcaagtcgaagcaaagcaggagtgagaagaagagccgcaaggccatgctgaagcttggcatgaagcccatcactggtgtcagccgggtcactgtgaagaaaagcaagaatatgctttttgtcatctcgaagccagatgtgttcaagagcccaaactcggacacctatgtcatattcggcgaggcgaagatcaaacagcgcaaggttcagaaagatgacacgtaatttctaatacaacgtatcatcttcttcgg

SEQ ID NO: 7161 - protein, 132 aa, Zea mays
  misc_feature: Ceres CLONE 348872-F
  misc_feature (65)..(124): Pfam Name: NAC Pfam Description: NAC domain
MTAQAAEELAAQIEQQKLEEQKTEAEEVVVEEDDEDDEDDDDDDKDDDELDGQEGDGSGKSKQSRSEKKSRKAMLKLGMKPITGVSRVTVKKSKNMLFVISKPDVFKSPNSDTYVIFGEAKIKQRKVQKDDT

SEQ ID NO: 7162 - DNA, 455 bp, Zea mays
  misc_feature: Ceres CLONE 348874-F
  misc_feature: Encodes the peptide sequence at SEQ ID NO. 7163
gtgccacacatccgtttgcctcttctccctcttgccggtcccgaataaagagcagcagcgcaagaggtcggtagagcgagaagaaggcaatggcggccgagagcttccttttcacctcggagtccgtgaacgaggggcaccccgacaagctgtgcgaccaggtgtcggacgccgtgcttgacgcatgcctcgcgcaggaccccgacagcaaggkggcctgcgagacctgcaccaagaccaacatggtgatggtgttcggcgagatcacgaccaaggcgaccgtggactacgagaagatcgtgcgcgacacctgccgcgagatcgggttcacctccgacgacgtgggcctcgacgccgaccgctgcaaggtgctggtgaacatcgagcagcagtcccccgacatcgcgcagggcgtgcacgggcacttcacgaagcggcccgaggagatcggcgcg

SEQ ID NO: 7163 - protein, 122 aa, Zea mays
  misc_feature: Ceres CLONE 348874-F
  misc_feature (4)..(103): Pfam Name: S-AdoMet_synt_N Pfam Description: S-adenosylmethionine synthetase, N-terminal domain
  misc_feature: SWISSPROT Homolog: EC 2.5.1.6 Methionine adenosyltransferase
  misc_feature (42)..(42): Xaa is any aa, unknown, or other
MAAESFLFTSESVNEGHPDKLCDQVSDAVLDACLAQDPDSKXACETCTKTNMVMVFGEITTKATVDYEKIVRDTCREIGFTSDDVGLDADRCKVLVNIEQQSPDIAQGVHGHFTKRPEEIGA

SEQ ID NO: 7164 - DNA, 458 bp, Zea mays
  misc_feature: Ceres CLONE 348933-F
  misc_feature: Encodes the peptide sequence at SEQ ID NO. 7165
aagcgccctgccgctctaggcaccaaaacctcgcgaggcaaccgccgccggcgccgccgacgtagcaagagggtgagctgaggactagaggagagggaagatgtcgttccgcgcgcgggagatgtacaagaaggtggtgcggcgcttgggtggcgaggggaagctgccggctgagctgatgaagtcggtgaaggacatactgccggacagcaacgtcgtcatggggcgggccaagcgcggcatcttcgcggggcgacacatccggttcgggaacaaggtctccgaggacggcggcaacaaatcaaaggaggcggcaaatcattggatgcacctgggcaaataatggaaggcttgctacttgcgcactaactgtacccccttttcgggagcagcagtgtatgttaagccagcatatcttgtatatcaatgtcttgccgttgtaaagcagcttttatgtg

SEQ ID NO: 7165 - protein, 80 aa, Zea mays
  misc_feature: Ceres CLONE 348933-F
MSFRAREMYKKVVRRLGGEGKLPAELMKSVKDILPDSNVVMGRAKRGIFAGRHIRFGNKVSEDGGNKSKEAANHWMHLGK

SEQ ID NO: 7166 - DNA, 472 bp, Zea mays
  misc_feature: Ceres CLONE 348969-F
  misc_feature: Encodes the peptide sequence at SEQ ID NO. 7167
atccacattattacgggaacaaaaagaaaaaaaaacacgagaaaaatcaaatcaggagacggggattccagagagcccctgtcgggtagggaagggaaggagaggcgaagcggaggcgagatgggggcggccgaatccgtgccggatacctccatacacgaattcaccgtcaaggattgcaacggcaaggaagtgagcctggaaacctacaaggggaaggtcctccttgttgttaacgtcgcctccaaatgtgggttcacggagaccaattacacgcagctgacggagctttatcagaagtacagggacaaagacttcgagatattggcattcccttccaatcagttcttgcgacaggagccaggtactgatcagcagatacaagactttgcttgcaccagatttaaagctgaatacccagtttttcagaaggtgcgcgtaaacgggccagatgcggcgcccggtttacaag

SEQ ID NO: 7167 - protein, 117 aa, Zea mays
  misc_feature: Ceres CLONE 348969-F
  misc_feature (12)..(117): Pfam Name: GSHPx Pfam Description: Glutathione peroxidase
  misc_feature: SWISSPROT Homolog: EC 1.11.1.12 Phospholipid-hydroperoxide glutathione peroxidase
MGAAESVPDTSIHEFTVKDCNGKEVSLETYKGKVLLVVNVASKCGFTETNYTQLTELYQKYRDKDFEILAFPSNQFLRQEPGTDQQIQDFACTRFKAEYPVFQKVRVNGPDAAPGLQ

SEQ ID NO: 7168 - DNA, 474 bp, Zea mays
  misc_feature: Ceres CLONE 348999-F
  misc_feature: Encodes the peptide sequence at SEQ ID NO. 7169
actgccagcaggtgccaccgcatctctgctctgctctcgcaacgcaagcacacgcccggccgcctgmcacagttgcsatggcgaccatagccacgatggcgctgctgaagcccgccgccaaggccgcggcgcggtcggcgccgtccaccagcagcggcagcgtctcgctgcgcgtccggacggggcaggccgccaagaaggctgcggtgtccgcgtccgcgtcgtccacgctggcgggcgccttcttcgcggcgctggcgtcgtcgcccgacgctgcgctggcggacgtcgtggcggcggcggacgccggcggcgacagccgcggccagctgctgctcgtcgtggtggcgcccgccatcgggtgggtgctgtacaacatcctgcagccggcgctgaaccagctgaaccgcatgcgcagcagccaggccgtggccgctggcctgggcctcggcgccgccgccgccgggatggcgg

SEQ ID NO: 7169 - protein, 132 aa, Zea mays
  misc_feature: Ceres CLONE 348999-F
  misc_feature (80)..(114): Pfam Name: PsbY Pfam Description: Photosystem II protein Y (PsbY)
MATIATMALLKPAAKAAARSAPSTSSGSVSLRVRTGQAAKKAAVSASASSTLAGAFFAALASSPDAALADVVAAADAGGDSRGQLLLVVVAPAIGWVLYNILQPALNQLNRMRSSQAVAAGLGLGAAAAGMA

SEQ ID NO: 7170 - DNA, 469 bp, Zea mays
  misc_feature: Ceres CLONE 349019-F
aaggacgcaaaccaaaacgcacaggttgcctaatccaaaccggccgtcgctcgtcccgcttcctgatcctcacccctgcctgcgcggctcggctcctcggctttccgcgttcgctacggtcggtttgtgccagcagccgtgccggatcgttggccttgcgccgttgcgcggttacaccgtgctccaggcaatggcgagccaacagcaagcaaaaggcacaatcctgtgagccaatcaacactcactaggactctaggagccagggcattgattcagagaactctgagaccatttttgttgcatcttttgacagaattacatgatgagtgctcttgtttttcctctggttgtatatgttatccagtgaacacatgtttaattttataaacatttcaatttttgtcatgtttgaatctattattttctagctttcgcagtttcaaaaaagtgtggtccagtgtctgtactt

SEQ ID NO: 7171 - DNA, 449 bp, Zea mays
  misc_feature: Ceres CLONE 349030-F
  misc_feature: Encodes the peptide sequence at SEQ ID NO. 7172
agtcttcagcacacaccaatcgcccacaagcgctcgcaggagaggtcgaaaccctagcttttgcggcgacggcggcggcggcgagagaagatgatctacgacgtgaactcccccctcttccgttccttcctcagccagaagggcggcgccgacaagaggaaaatggaggagcataaaccaaaggagcagaggcccaaggccaacgagaacaagcctgtgatgaacgaatgaatatctccagaagctttgttcaatgtgcaaccaaatgcgatgtccgtttgctctggttagcttaaaaccaacgcttccaataatcctattggtgtcttagtttccccttatagtgttatttgctcggcttgaacatggcaacggaaatgaaacttgaactacctatggtactgtcatcaatttgagacccccatgattgacaacttttgtgcagctct

SEQ ID NO: 7172 - protein, 46 aa, Zea mays; identical to SEQ ID NO: 7044
  misc_feature: Ceres CLONE 349030-F
  misc_feature (1)..(46): Pfam Name: Wound_ind Pfam Description: Wound-inducible basic protein family

SEQ ID NO: 7173 - DNA, 454 bp, Zea mays
  misc_feature: Ceres CLONE 349046-F
  misc_feature: Encodes the peptide sequence at SEQ ID NO. 7174
gaaaacccctctcgtatgtcgcatcgcgtctaaacccttgtctccttcttatccccacctccctcgcggatcactcgccgccgccgccggccgcagccatcgccgtgatgctgtccctgtcgagggcgatcgggaggcggctcttctcgtccgccgaggccgcgtcgacggctgcggtgaggacggcgcagaacccgctcgaggagttcttcgaggtcgagcggagcaccgaggagggcaagcctcctccccactacggtcgcagctggaaggcttctgaactgcgactaaaatcttgggatgaccttcagaaattgtggtatgttcttctaaaggaaaagaacatgctaatgacacagcgtcaaatgctgcattcagagagcatgaggttcccaaatccagaacgaatttccaaggtaaagaaatcaatgtgccggataaagcatgtcttgac

SEQ ID NO: 7174 - protein, 115 aa, Zea mays
  misc_feature: Ceres CLONE 349046-F
  misc_feature (31)..(115): Pfam Name: MRP-L47 Pfam Description: Mitochondrial 39-S ribosomal protein L47 (MRP-L47)
MLSLSRAIGRRLFSSAEAASTAAVRTAQNPLEEFFEVERSTEEGKPPPHYGRSWKASELRLKSWDDLQKLWYVLLKEKNMLMTQRQMLHSESMRFPNPERISKVKKSMCRIKHVL

SEQ ID NO: 7175 - DNA, 442 bp, Zea mays
  misc_feature: Ceres CLONE 349053-F
  misc_feature: Encodes the peptide sequence at SEQ ID NO. 7176
aagtcgaacagcggccgcgcgcggggaagttgcccggcggcggcggatctcggaggcagcgacgcgcgggtggaggagctcagtgacagcgccagtgcctatcgagcgagcgaatcgagtagattctccccactgtttctttcctgctgattccgatttcgcgttgaaacaccggggggagaagaattgcgggcgaccataactcggcaagaagcggctccaaaaagggcatctacctttgccgattccggcaccgatggatcccgcggcgtcggggaggttcgacaagctccagagctcgttcaagctctccatccagtgcctcctcaccgcctgctcccgcgaggatgtcaatgacgctttctcgtccttcactgatgctgagaaggagcgtttgcaccggatgctcacccttgtgatgaagaatctgcatgccaacgta

SEQ ID NO: 7176 - protein, 62 aa, Zea mays
  misc_feature: Ceres CLONE 349053-F
MDPAASGRFDKLQSSFKLSIQCLLTACSREDVNDAFSSFTDAEKERLHRMLTLVMKNLHANV

SEQ ID NO: 7177 - DNA, 438 bp, Zea mays
  misc_feature: Ceres CLONE 349070-F
  misc_feature: Encodes the peptide sequence at SEQ ID NO. 7178
atggatgcagggcaacgctgaaccaggtgctgttcgtcgtggggctcaagtccaccagcgcgaccgtggcgtgcgcgctcaccaacacgctgccggcgctgaccttcgtgatggcggcggcgctcaagatggagccgrtgcggccgggcacgrcggcgagggcagrccaagctggtgggcacggcggtgtgcgtgggctgatccatgctcatacccttctacaagggccccgtcctcagggtgtgggcgtccccgatccactggcgcttcgcggagcacgcgtcgccccccgccgccgccgcggcggcggcaggcgccacacgggccccgccgcggtgctcggggacgtcctcgtcatcgccagctgcgtcgcctgggccgtctggttcattctccacaccaagatctccgaggggttctccgcgccctacaccagca

SEQ ID NO: 7178 - protein, 145 aa, Zea mays
  misc_feature: Ceres CLONE 349070-F
  misc_feature (46)..(46): Xaa is any aa, unknown, or other
  misc_feature (51)..(51): Xaa is any aa, unknown, or other
  misc_feature (55)..(55): Xaa is any aa, unknown, or other
GCRATLNQVLFVVGLKSTSATVACALTNTLPALTFVMAAALKMEPXRPGTXARAXQAGGHGGVRGLIHAHTLLQGPRPQGVGVPDPLALRGARVAPRRRRGGGRRHTGPAAVLGDVLVIASCVAWAVWFILHTKISEGFSAPYTS

SEQ ID NO: 7179 - DNA, 481 bp, Zea mays
  misc_feature: Ceres CLONE 349071-F
  misc_feature: Encodes the peptide sequence at SEQ ID NO. 7180
  misc_feature (458)..(458): n is a, c, t, g, unknown, or other
acacagacacacacatatccgtcaaagaaacaagtgcacacaaataaatacatcgctcactagattgccaagagcaatggcctctaggtcatccatcctgctcgtcacggtggcgctggctacgctattcacggtcggttcgtgcaccaccccgctcaccttccaggtcggtaagggctccaagcycggccacttagtcctcacccccaacgttgccaccatctctgacgtggagatcaaggagcacggtggcgacgacttctcctttacgctcaaggagggtccgactggcacctggacgcttgacaccaagaccccactcaagtaccccctctgcatccgcttcgccgtcaagtccggtggctaccgcatcgccgacgatgtcatccccgccaatttcaaggccggcaccacctacaagacaaccctcagcatctgattagcctcttatgacgaanaatayttcaagagagctcatccg

SEQ ID NO: 7180 - protein, 120 aa, Zea mays
  misc_feature: Ceres CLONE 349071-F
  misc_feature (27)..(105): Pfam Name: Pollen_allerg_1 Pfam Description: Pollen allergen
  misc_feature (37)..(37): Xaa is any aa, unknown, or other
MASRSSILLVTVALATLFTVGSCTTPLTFQVGKGSKXGHLVLTPNVATISDVEIKEHGGDDFSFTLKEGPTGTWTLDTKTPLKYPLCIRFAVKSGGYRIADDVIPANFKAGTTYKTTLSI

SEQ ID NO: 7181 - DNA, 659 bp, Zea mays
  misc_feature: Ceres CLONE 349110-R
  misc_feature: SWISSPROT Homolog: EC 5.2.1.8 Peptidylprolyl isomerase
  misc_feature (659)..(659): n is a, c, t, g, unknown, or other
cgattgggtaccgggccccccctcgaggtcgacggtatcgataagcttttttttttttttttttgtctgagaatgacttaattaagtagaagttagtaatcgtacacttcagctgcatttacatattttttgctgggagtattcattttctagcaattagcacaagacaagggcactgaactacaatcagatcaggcggctggcggctcggcatcccccagcaattcctcgctctcgtgcttatctctactctacagctgtaagttctgtacatataacagtcatctagcctgatagtatggtcgaaatgcttgattaggtcccccagatagacggtctctcgatctagttttagcaacatcaacaactatcatccagccgtttatgatctgtccattcattgcttttagagcagcacctccagcttcctcggtagtgtattctacgaaggcatagccttttgacctttttgatatcctgtccataattatcttcacttcaacgagctcaccgaaaggctcaaacgctgcccgtagggtcttctcagatgtataaaatgaaaggcctgtaacaaagagccttttagttttgatatcgaccgctccagtcccttcagatgatttcacgccatcatcacctttgtaatttttgttgtctgn

SEQ ID NO: 7182 - DNA, 833 bp, Zea mays
  misc_feature: Ceres CLONE 349137
  misc_feature: Encodes the peptide sequence at SEQ ID NO. 7183
aaatacccagtaagtgagacttgtcgtccattctgaagtccggcggcggcgacagcggcgaggcgaggcctctgcgacttccagatctccccgacgaggaggaagtctctacagcggaggggagggagatgtcgtacatgcggggtgacctgctgacgagaatgcggaagctggtgaagggcctcgccaggcccgagccccggtggctcaaggccttggaacgggctccgccagtgacatttcctcgcccagaggggaagatcaagactctggtgcttcctgaggatgtgtatgtcacgaagttcaacagaatacatccagattcgctttaccatgatgcaatcaagataagtggatttgatccaccgccagctcgagtgtttgcttggcgtgtcctggagttgaaagagcaaggagtcgatgaagatgttgcaatggctgtagcagataacgagtaccgggacagagaagaagggccaaagaagaaagcgtacaaggagctgaaagaaatcgcccgcagtgaagggaggaagccacctccgaatccatacccgagtgccataaaggaaatacaagcggaggaaaagaagtatgtcatggaccgtttgcataacccgaaggtaatcgagattgcgaacaagatgaaggaggagcgagacaggatgttgagggatagagcagcaggtcagcggtagtcgtagcagcaggtaatgtttggactggccgactgggtgttgttgttcacgacatgggccaactggcgtcataaataatggttgttggagattgatatggcaaatatgaaactcttgtttctaaaaaaaaaaaaaaaa

SEQ ID NO: 7183 - protein, 188 aa, Zea mays
  misc_feature: Ceres CLONE 349137
MSYMRGDLLTRMRKLVKGLARPEPRWLKALERAPPVTFPRPEGKIKTLVLPEDVYVTKFNRIHPDSLYHDAIKISGFDPPPARVFAWRVLELKEQGVDEDVAMAVADNEYRDREEGPKKKAYKELKEIARSEGRKPPPNPYPSAIKEIQAEEKKYVMDRLHNPKVIEIANKMKEERDRMLRDRAAGQR

SEQ ID NO: 7184 - DNA, 523 bp, Zea mays
  misc_feature: Ceres CLONE 349140-F
  misc_feature: Encodes the peptide sequence at SEQ ID NO. 7185
gtgtgggtgtcgggcggccgggcgggccagcagctggacaagcaagcaagcaagccaataatggcgtctcactctcatcggtcccggcctcccacggcgccctgtcccagctgggggcacgcccacgcgccgcggtgccgccggcggctcgtccgggcactgctgctcgtagcggcgctggcgctggcggcggcaggtggtggtggtcgtggctccgcggccgccgccgccgccgccacccagcagaggatcccggccatcttcatgttcggcgactccatcgtggacccgggcaacaacaacaaccggctgacggaggccaaggccaacttcccgccgtacgggcaggacttccccggcggcgtcgccacggggaggttctccaacggcttggtccccggggacctcctagcttccaagctgggcatcaaggagctgctgccgccgttcatcggcaccgacctgcagctcgaggacctgctcaccggcgtggccttcgcctgcggcggcagtggctacgatc

SEQ ID NO: 7185 - protein, 154 aa, Zea mays
  misc_feature: Ceres CLONE 349140-F
  misc_feature: SWISSPROT Homolog: EC 3.2.1.51 Alpha-L-fucosidase
MASHSHRSRPPTAPCPSWGHAHAPRCRRRLVRALLLVAALALAAAGGGGRGSAAAAAAATQQRIPAIFMFGDSIVDPGNNNNRLTEAKANFPPYGQDFPGGVATGRFSNGLVPGDLLASKLGIKELLPPFIGTDLQLEDLLTGVAFACGGSGYD

SEQ ID NO: 7186 - DNA, 394 bp, Zea mays
  misc_feature: Ceres CLONE 349149-F
  misc_feature: Encodes the peptide sequence at SEQ ID NO. 7187
gttctcttcgttccgtctcgcagtggtagcaccgcagcagagagaagagagatcttctagcctagtagtagcatctacttactagtgagtgagtaggagtacttggctaggacgggggggccttgacgacggtagcagcatgagctgcaacgggtgccgggtgctgcgcaaaggctgcagcgaggcctgcgtgctgcgcccctgcctccagtggatcgacgccgccgaggcgcagggccacgccaccgtgttcgtcgccaagttcttcggccgcgcgggcctgctctccttcatctccgctgtcccggacgcgcagcggccggcttactgtggtccatggcacctcctcgcagccctgttccagtcgctgctgtacgaggcggcsgggcggact

SEQ ID NO: 7187 - protein, 85 aa, Zea mays
  misc_feature: Ceres CLONE 349149-F
  misc_feature (2)..(85): Pfam Name: DUF260 Pfam Description: Protein of unknown function DUF260
MSCNGCRVLRKGCSEACVLRPCLQWIDAAEAQGHATVFVAKFFGRAGLLSFISAVPDAQRPAYCGPWHLLAALFQSLLYEAAGRT

SEQ ID NO: 7188 - DNA, 423 bp, Zea mays
  misc_feature: Ceres CLONE 349158-F
  misc_feature: Encodes the peptide sequence at SEQ ID NO. 7189
agcaacaagaccgcgcccaatccaatctgcgctgcgctgcgaaaggccagaagagcacacacaacacaggtacagctagcgcgcgcgggcggtgcggggctgtctggcaattacgcagccttggcagcttgcaccaccgcgcaagctagcgctgacggagggaacaagggcttgcgcgcgcacgcagggaggggagggaacgcctgccgccgatcgcctggtggatctcccggcggcgggggaagcagcagagaggggacggccagcagcgcaaccaatggcgccgccggacgcgggtgcggcagcagcgtgcggcgcgcggtgggtgaggcgggacacgctgctgggcctcgcgctgggccagttcgtctcgctgctcatcaccgccaccggcttcgcctcctccgaactcgcccgccgagg

SEQ ID NO: 7189 - protein, 48 aa, Zea mays
  misc_feature: Ceres CLONE 349158-F
MAPPDAGAAAACGARWVRRDTLLGLALGQFVSLLITATGFASSELARR

SEQ ID NO: 7190 - DNA, 484 bp, Zea mays
  misc_feature: Ceres CLONE 349163-F
  misc_feature: Encodes the peptide sequence at SEQ ID NO. 7191
ctcgactcccacaacacggtccgtacggtaaagagagagaaggtgggagtggaatcgacaggggaaaaccaagcctgcgtttcagagacaactcaggcggcgcgatggcgatggcggcgctgcgacgcgaggggaggcgcctcctcctctcccccaccgtccccaacccgtcttcggcggccgcttccgctgcggtgacgcgatcctccgccatgtcgcaaccggagatggctccacttggtgcacgttctatttcaactcaagttgtgaggaaccggatgaagagtatcaaaaacatccagaagatcacaaaggctatgaagatggttgcagcatcaaagcttcgggctgttcagacgaggactgaaaattcacgcggcttgtggcagccgttcaccgcccttcttggggacgcttcctagtgttgatgtcaagaagaattgtgattgtggccattacctctgataagggactcttgtggtgg

SEQ ID NO: 7191 - protein, 105 aa, Zea mays
  misc_feature: Ceres CLONE 349163-F
  misc_feature: SWISSPROT Homolog: EC 3.6.3.14 H(+)-transporting two-sector ATPase
MAMAALRREGRRLLLSPTVPNPSSAAASAAVTRSSAMSQPEMAPLGARSISTQVVRNRMKSIKNIQKITKAMKMVAASKLRAVQTRTENSRGLWQPFTALLGDAS

SEQ ID NO: 7192 - DNA, 396 bp, Zea mays
  misc_feature: Ceres CLONE 349179-F
  misc_feature: Translation starting site: 237
aaaccaacaggtgttgcctgcccaagtgcccagcctcgcttctccagtcaattctcagcctcgtcctccgcctccgcgtcccgctctctcctctccttggcctccgcttccgctcctgcctggaggctgcatcaaaccctaccgctccggayctcccggctggccgcgagatgcgacgcytgtccggcccctaatccttctcctcgatactgcccctcgcccgcccgcccgccggcatgggccgctacgggcccttccctgccgccgccggtgatggcgggggctgcctgcccctgccgattgtagcggctgaaggcgcgctggctgtcctggacggcgccattgcgaccgcggccttcgtgcagttagcaaggattcataggcacaaccagctac

SEQ ID NO: 7193 - DNA, 457 bp, Zea mays
  misc_feature: Ceres CLONE 349187-F
  misc_feature: Encodes the peptide sequence at SEQ ID NO. 7194
agatttcccaactttttgttcctcgcgccgccgccgccgccgccgtgacggaaggaagaggaggagcaaggagcacgacgcgatgggccactccaacgtgtggaactcgcaccctaagaactacggccctggctcccgcgtctgccgggtctgcgcgaaccctcacggtctgatcaggaagtacgggctcatgtgctgcaggcagtgcttccgcagcaacgccaaggacattggtttcatcaagtaccgttgaagaggccactgtgctgctgtggagaacttcctacatcaaagaaatgggtccttcattagaaggcctaatttatgcgctttagctttttgttcagaacttgagactcatgtgttaaactcgacttgttaaagttttgatggctactttgtgcttgttggaccagctataatcagaagattgaatcgcaaaaaaaaaaaaaaaaag

SEQ ID NO: 7194 - protein, 56 aa, Zea mays; identical to SEQ ID NO: 1999
  misc_feature: Ceres CLONE 349187-F
  misc_feature (3)..(56): Pfam Name: Ribosomal_S14 Pfam Description: Ribosomal protein S14p/S29e

SEQ ID NO: 7195 - DNA, 627 bp, Zea mays
  misc_feature: Ceres CLONE 349210-R
  misc_feature (426)..(426): n is a, c, t, g, unknown, or other
  misc_feature (496)..(496): n is a, c, t, g, unknown, or other
cgcgacatggcttacattcaacaagcgagccaaactgccacatacaaacacacgagatttcgtcccactctcacacacaagaagaacaagtcgcagcaaacagagatttaactgcagggacgaactttatcaaaaagaagggaagagtcggagagagacagagagagttgaaaaaaaaaaaactcgacagctagacaaactgggccaattaactgtggcggcagcagaaccgcactccaggccaggccggcaggcaggcacaggcacgcagccaccacacatggcgcaatcgactctgcaaactatactggtactacgtactagctactgatggctagccggacggcgctggcagacgcccggcgcgacgacgccctgcgttcaaatgtcgacggcgatgtcagccgaggccggcggtgcggcggnggcgtcggtggagggcgcgtccgcgccggcgccggcgccggcccccgcgaggccgagcagcatgtggcgnaggccgcgcgcgtactcgagcaggcggtccaccgcggggatggtctcccggacctcgtccagggcccccgaagtcgcgcagcccaggcggggaagcggcggtaaggcgtcgggcgtccaccaaggcccacc

SEQ ID NO: 7196 - DNA, 464 bp, Zea mays
  misc_feature: Ceres CLONE 349229-F
  misc_feature: Encodes the peptide sequence at SEQ ID NO. 7197
atgactcatgagtgaccaggtcacgtcacgaggagcggaacacacacacactcgggtttccgatggcggcggccgcaccaacacacgcgcccgtgtcctcctcagcgtgccgttcgggattctcctctagcgatgtatccttccccaattttcgctcggcggcggcttcggcccctgggtggcggcgcagggagccgtacccggcagtctccgtagtgtcgagctccccgcagtctgtgccaggagctataactgtcgacaccgaggttgacacattgctagacagtgtgaagtgggacagcaaagggttggctgttgccattgcacaaaatgtggatactggagccattcttatgcagggttttgctaataaagaagcccttgcaaaaactatatcaaccaggaaagctacattctttagccgttcacggtcttccttgtggacgaaaggggagacatccatg

SEQ ID NO: 7197 - protein, 134 aa, Zea mays
  misc_feature: Ceres CLONE 349229-F
  misc_feature (98)..(134): Pfam Name: PRA-CH Pfam Description: Phosphoribosyl-AMP cyclohydrolase
  misc_feature: SWISSPROT Homolog: EC 3.5.4.19 Phosphoribosyl-AMP cyclohydrolase
MAAAAPTHAPVSSSACRSGFSSSDVSFPNFRSAAASAPGWRRREPYPAVSVVSSSPQSVPGAITVDTEVDTLLDSVKWDSKGLAVAIAQNVDTGAILMQGFANKEALAKTISTRKATFFSRSRSSLWTKGETSM

SEQ ID NO: 7198 - DNA, 420 bp, Zea mays
  misc_feature: Ceres CLONE 349255-F
  misc_feature: Encodes the peptide sequence at SEQ ID NO. 7199
atcagacggactcacagctcgcatcacctgaaccacttgacaaccagccagctagctaaccaaccggcggagccaagaacaagcaagagacaacttgccccgtccagacagcatgtgcaactccaacgtcaagttcgcgggcgtcgcccagatcgacggccgcccggtgctgcagccggcgggcaaccgcgtggcggcgccggacgccgcccgcccgctcaagaagtccctgcacaagtccttctccatgccgccttcctacgacaacaatgccaccgtggcctcccgtcccgtccctgccgagaacacccgtgcggcggcggcggcttctctgctgcctcctacgacgccggcggctccggccgccgcgagggcgaccaaggcggcgggcgctgtgcccgcggagaagcccaggtccaa

SEQ ID NO: 7199 - protein, 102 aa, Zea mays
  misc_feature: Ceres CLONE 349255-F
MCNSNVKFAGVAQIDGRPVLQPAGNRVAAPDAARPLKKSLHKSFSMPPSYDNNATVASRPVPAENTRAAAAASLLPPTTPAAPAAARATKAAGAVPAEKPRS

SEQ ID NO: 7200 - DNA, 783 bp, Zea mays
  misc_feature: Ceres CLONE 349294-R
cgattggtgaccgggccccccctcgaggtcgacggtatcgataagcttttttttttttttttttgcaagaatcatcatcattatcatcatcatcctcaagaaacagacgtgtctgaaacaagacatgcatccatattatatttttctattccgctaacctgccttgagctgttacttaaaattcactgctatcacgacgataaaataaaacccatgacaatttatttatttacatacaagggcacatccagatgcatgcagacttgatcaaatttataggccaatcttgcatcaccacagttgcatgtaacctggccatttatcagatcttgaagtgcttgtatccatactccaagcatcgtcatgacctctatccagtaaaccatattcatgcccccaaaaactacttgtttgataacccccccctccggagtttaagtgggattaaaacgtttaacaaacacctcccaacccaggggattctggaggtttccagggccaacaaaaaacccttgccccaatttgtcttggcaactcaacgtcccctatattccctggaaaaaaaaaagcgttttaactggggaaaccctttttccaaaaactattaaaggggggtgttatgccaaaccatgaaagggcccactctttcaaatttggaaaaatgtggggctctcaaacccttcccaagagaataccaagatttgggacaatatccccccccggggggcaaacctcccccccctcctgtgtttcctctaccaacccccaccacccaaagagaaa

SEQ ID NO: 7201 - DNA, 346 bp, Zea mays
  misc_feature: Ceres CLONE 349312-F
aactagtctactactactaccaacattccgccatcgtcttccccagccggcgaggccgttccaatccgttcccccggttctcattcccaccccgcctcctattctcctcgctcgcgctgacgcgctcccacacgcaccccccgctgtgccgccacaccaacaccgcactccaccgccacagtccccgtccccgcgtcgctgtcgtccgtcatcggtgccgtcgcttccccagcacggtacccctagcaccagcgcacgctataaggcaccgcggcctagccatggcgcccgcaccggcatcgctctccgcgcccaacgccctctccctgctcgcgcccgctagagt

SEQ ID NO: 7202 - DNA, 444 bp, Zea mays
  misc_feature: Ceres CLONE 349318-F
  misc_feature: Encodes the peptide sequence at SEQ ID NO. 7203
gtcaattcccctacgccaaggcaatcgtgattccgtgtctccgtgaactgtccctctacctctctaagcttgccaagaactgccacacagcctcgcacctctgacgatctgagcttactgaagccatgaggccggcaccaagtgtttacaggcccacgtcaacgtcgacgacttcgccggcagcgcatccaccggcggccgcgaagctggcgtcctcgccgtggcactcaacggtgccctacctgttcggagggctagccgccatgctgggcctcatcaccctggcgctcctcatccttgcctgctcgtaccggaagctcaacaactacctcagcaccggcgacgcttcctcttccccctccagacccgaagccacggatggcaacggcttcaagtcgccggcggccactgcccggcctatccagcgaccttcgccgacctcgt

SEQ ID NO: 7203 - protein, 60 aa, Zea mays
  misc_feature: Ceres CLONE 349318-F
MLGLITLALLILACSYRKLNNYLSTGDASSSPSRPEATDGNGFKSPAATARPIQRPSPTS

SEQ ID NO: 7204 - DNA, 394 bp, Zea mays
  misc_feature: Ceres CLONE 349353-F
aacattttcaatcttttagcacgtacaggaaaataagaactgaaacaagcgcatgtcccccgtcccgagtcctagcgcgactccgtgcgacggcgaggcctctgtcccgtcctcgtctcctcgaggcccggaggctgcgagtctgtgacacttgaccgtgaggcggacggcgactcggaggacttcaccagcgagtccctcaagcaccgaggccgagccgcccaccgcccgccgccgcctcgcctggcgctagtcgccgttgccgagcctgttcggcacatccgttggggtgccggggcaccgatcaggctgcgcacagccgaagtcggcctccgggtgcccaagctgcagagcagcgcgccagcgcccgtggaccggtgaatcagactaccct

SEQ ID NO: 7205 - DNA, 526 bp, Zea mays
  misc_feature: Ceres CLONE 349386-F
  misc_feature: Encodes the peptide sequence at SEQ ID NO. 7206
aatccaatctgcgctgcgctgcgaaaggccagaagagcacacacaacacaggtacagctagcgcgcgcgggcggtgcggggctgtctggcaattacgcagccttggcagcttgcaccaccgcgcaagctagcgctgacggagggaacaagggcttgcgcgcgcacgcagggaggggagggaacgcctgccgccgatcgcctggtggatctcccggcggcgggggaagcagcagagaggggacggccagcagcgcaaccaatggcgccgccggacgcgggtgcggcagcagcgtgcggcgcgcggtgggtgaggcgggacacgctgctgggcctcgcgctgggccagttcgtctcgctgctcatcaccgccaccggcttcgcctcctccgaactcgcccgccgagggatcaacgcgcccacctcgcagtcgctcctgaactacgtcctcctcgccgtggcctacggcggcgtcctcctctaccggcggcagccactcacgataaaatggtactactacttaatactt

SEQ ID NO: 7206 - protein, 89 aa, Zea mays
  misc_feature: Ceres CLONE 349386-F
MAPPDAGAAAACGARWVRRDTLLGLALGQFVSLLITATGFASSELARRGINAPTSQSLLNYVLLAVAYGGVLLYRRQPLTIKWYYYLIL

SEQ ID NO: 7207 - DNA, 486 bp, Zea mays
  misc_feature: Ceres CLONE 349478-F
atggcagccatcctccattgcttcctcccccaagatctccccctacgcagcaaggatcgagaaaaggaggggcacgttgaattgaagaggaagagaggatcaaggagatgttcttccccatctcctcttgaagatttcttggggaaaccctaggtggctacactccagatcatgtctagtacatttcttcttcttcgatgaaggcaagtgaatgtagcggtggttgcttccgttctgacctgttatttctatcgcctacactctaatattcagaagtatcagattctttcataattggactctatggtgatgctttacttgcttgcattatactgattctcaatcatatattgatgatgattatgatttgagtatgactcatgagattaattcacacccctgaaggtaaatgaagtattatttgaggttggtattgtatctgaaggyaaatgmagtattatttgaggtytgtgttgtatctgaagg

SEQ ID NO: 7208 - DNA, 158 bp, Zea mays
  misc_feature: Ceres CLONE 349485-F
  misc_feature (100)..(100): n is a, c, t, g, unknown, or other
ggatgagtgtccactgtccacaagtccagattccaattccagtccgatcgtgagctcagctcagctccgctagtcctctccccgcacgcaccaccaccangcaagcagtccagcaccatagggcggcgccctwgctcctcacgctgctcctcgcggcc

SEQ ID NO: 7209 - DNA, 442 bp, Zea mays
  misc_feature: Ceres CLONE 349494-F
  misc_feature: Encodes the peptide sequence at SEQ ID NO. 7210
gcagctcgtcccttttgccccaatcttcttctccaaaccacatcctctggcctctgacaggtgacgagtcccatgggtgccgcggcgaggaagcccgccgccgctctgctgccaatctggctctgtctcgtctgcgtgtcaagagcgcagccgtacatcggcgtgaactacggcgaggtagcggacaacctgccgtcgccggacaagacggcgaggctgctcaagtcgacgtccatctccaaggtgcggctgtacggcgtggacgcggggctgatccgcgcgctggcggggtccggcatctccgtggtggtgggtgtggccaacggcgagatccccacgctggccgccgacccggccgcggcgtcgcggtggctggccgccaacgtgctgcccttcgtcccggcgaccaccatctccgccgtggccgtgggcaacgaggtgc

SEQ ID NO: 7210 - protein, 123 aa, Zea mays
  misc_feature: Ceres CLONE 349494-F
  misc_feature: SWISSPROT Homolog: EC 3.2.1.39 Glucan endo-1,3-beta-D-glucosidase
MGAAARKPAAALLPIWLCLVCVSRAQPYIGVNYGEVADNLPSPDKTARLLKSTSISKVRLYGVDAGLIRALAGSGISVVVGVANGEIPTLAADPAAASRWLAANVLPFVPATTISAVAVGNEV

SEQ ID NO: 7211 - DNA, 474 bp, Zea mays
  misc_feature: Ceres CLONE 349548-F
  misc_feature: Encodes the peptide sequence at SEQ ID NO. 7212
accgaattcgagacctccaattccctcgtagcagcagcaccagtagagtctccttcctctccggcggcgatgtctgggcgcggcaagggcggcaaggggctgggcaagggcggcgccaagcggcaccgcaaggtgctccgcgacaacatccaagggatcacgaagccggcgatccggaggcttgcgaggaggggcggcggcccgcccgcccgcccaccagccgccgccgcaccgccaccgcgcgacctcccttcttcgccgcaaaccgctctgggcgcttgaagatggcggtgccgctgttgactcagaagatcgtgaagaagcgggtcaagcagttcaagaggccccacctcgaccgctacaagtgcctcaagccaagctggcgcaggcccaagggtatcgactcccgtgtcaggcggaagttcaagggatgcaccttgatgcctaacattggatatggctctgacaagaaga

SEQ ID NO: 7212 - protein, 63 aa, Zea mays
  misc_feature: Ceres CLONE 349548-F
  misc_feature (14)..(63): Pfam Name: Ribosomal_L32e Pfam Description: Ribosomal protein L32
MAVPLLTQKIVKKRVKQFKRPHLDRYKCLKPSWRRPKGIDSRVRRKFKGCTLMPNIGYGSDKK

SEQ ID NO: 7213 - DNA, 618 bp, Zea mays
  misc_feature: Ceres CLONE 349621
  misc_feature: Encodes the peptide sequence at SEQ ID NO. 7214
ctagccgccgccagaccattcgtttctcgcgagccatcgcttctgtaattctcaggcatccggaagaaatggccaagtcgaagaaccacacggcgcacaaccagtcgttcaaggcgcacaagaacggcattaagaaacccaagcgccaccgccagacctccaccaaggggatggaccccaagttcctgaggaacctgaggtattctaggaagggcaacaaaaagagtggtgaggcagcggcggcggcggctatggtggtggtcagagtacgagttcttgggactgaactgaactctgattagaagtgaaaaatgggccaaccttttgggcgtgaaaaatgggtcaaccgttatcgattagtccctgttggatggagcgaatgcttgaaatttgttgcttgacatacgattaatcttgcgttgtgttgtgctaagggattggcttatgttattatctggattggtggtttttctacgcctcatgcttgtgctgtctcgtttcacaaaatatcttttttgcttatgtcatagatataatttcatctaggtctgtcatttatatcaacttctgacttcgaccattatcgtgtcaaatcttcttgcaaaaaaaaaaaaaaaa

SEQ ID NO: 7214 - protein, 77 aa, Zea mays
  misc_feature: Ceres CLONE 349621
  misc_feature (3)..(42): Pfam Name: Ribosomal_L29e Pfam Description: Ribosomal L29e protein family
MAKSKNHTAHNQSFKAHKNGIKKPKRHRQTSTKGMDPKFLRNLRYSRKGNKKSGEAAAAAAMVVVRVRVLGTELNSD

SEQ ID NO: 7215 - DNA, 396 bp, Zea mays
  misc_feature: Ceres CLONE 349672-F
  misc_feature: Encodes the peptide sequence at SEQ ID NO. 7216
agggtactagagataatataactccacctccatccactccagctctactcctctccccgagtcctctcctctccggggtattgaattcgaaccaaaaaatcaaaacaactcagcgattcgattcgcggcgagtcaagcgggatgccgccgcgcacggctccggcggcgacctcaaccccgccgcggaaggtgcccctccggaagctgctgcgtgcggcgtcggtcgcctgcggggtgcagttcggctgggcgctgcagctgtcgttgctgaccccgtacgtgcaggagctgggcatcccgcacgcctttgccagtctcgtctggctgtgcggtccgctgtccggcctcctcgtccagcccctcgtcggccacctctccgaccgcatcgggcccgcc

SEQ ID NO: 7216 - protein, 85 aa, Zea mays
  misc_feature: Ceres CLONE 349672-F
MPPRTAPAATSTPPRKVPLRKLLRAASVACGVQFGWALQLSLLTPYVQELGIPHAFASLVWLCGPLSGLLVQPLVGHLSDRIGPA

SEQ ID NO: 7217 - DNA, 480 bp, Zea mays
  misc_feature: Ceres CLONE 349686-F
  misc_feature: Encodes the peptide sequence at SEQ ID NO. 7218
ctaccctgcatccctactgtatgctacgagactacgacactgctgtccctgcctgcaccctgatccagttccsggtagcrtaccaccatgggcctctgcatatccgtgtctctctggaaggagaagctctacggcgccgacggcagcagccggtcagtgcagtgtcgcgtcgtccatgaggttgccggcgtggagagtggtgactgcgagtgcgggaacttgggaagcgacgccgacgcgctgggggtagagcacaaggcggcggcggcggcggctccggcggccatgggcgtgaaaagcggtggagtggagggagctgccgctgccgtgtcgggtggcactcctgtgcggccgatatggcagaggagggtgctgatgggcgtcaagtgccagctgccgcggttcagcgggatggtactctacgacgagagcggccggccggtgtgcactggcgtccgggacagagctcgtgaccaggag

SEQ ID NO: 7218 - protein, 131 aa, Zea mays
  misc_feature: Ceres CLONE 349686-F
MGLCISVSLWKEKLYGADGSSRSVQCRVVHEVAGVESGDCECGNLGSDADALGVEHKAAAAAAPAAMGVKSGGVEGAAAAVSGGTPVRPIWQRRVLMGVKCQLPRFSGMVLYDESGRPVCTGVRDRARDQE

SEQ ID NO: 7219 - DNA, 450 bp, Zea mays
  misc_feature: Ceres CLONE 349716-F
  misc_feature: Encodes the peptide sequence at SEQ ID NO. 7220
atttgaggctttgagctatggtttatggaaagcttgccggcctttgacgctggaaggagaaaccagtcagtctccggcgctgcccctccgccgtggccggcgacgggtggaggcagtatgtgagcgagagacagtgggcagccggagacggcgtgtccctctgaaggcctcacgacctgccggcttctgatggccacgagcgcgtgcgcgtgagcgtcagcgtcagcgtccgacctccagtggtccgtgtttccccgaacaagagcgaacaacagtttggcggcggctgatggcaccaagcgcagccgccggaccgccgtccctggcccggccatcgtcatcgagtagcagccacctgcggcgcgccggcagtgccctccagcccgtctccgtcccgcgcgccttggtgctggggcggaggcgcctcacgggcgccgtccgagccgcgcc

SEQ ID NO: 7220 - protein, 53 aa, Zea mays
  misc_feature: Ceres CLONE 349716-F
MAPSAAAGPPSLARPSSSSSSHLRRAGSALQPVSVPRALVLGRRRLTGAVRAA

SEQ ID NO: 7221 - DNA, 487 bp, Zea mays
  misc_feature: Ceres CLONE 349742-F
  misc_feature: Encodes the peptide sequence at SEQ ID NO. 7222
actcatacatttcgactctcaactcccaaggtcccttttttttctcgatctggaagcgccgcagtagcagccatggacgtgagcagagcaggcgggaaggcgaagaagggcgcggccgggcgcaaggccggcgggccgacgaagaagtcggtgtcgcggtcctccagggccgggctgccgccaccacttgctcgccttcgccccttctgtctccbttcgtccgtagcagaccaggaacgcccaaggcgctagcgtctccaagatggtgctgcaaaacgacattgacttactcaatccaccggcagagcttgagaagctaaagcacaagaagaagcggctagtccagtcccccaactccttcttcatggatgtcaagtgccagggctgtttcagcataaccactgtgttcagccactcccagactgtggttgtgtgcccaggctgccaaactgttctgtgccaactaccggtgggaaggccaggctca

SEQ ID NO: 7222 - protein, 75 aa, Zea mays
  misc_feature: Ceres CLONE 349742-F
  misc_feature (30)..(74): Pfam Name: Ribosomal_S27e Pfam Description: Ribosomal protein S27
MVLQNDIDLLNPPAELEKLKHKKKRLVQSPNSFFMDVKCQGCFSITTVFSHSQTVVVCPGCQTVLCQLPVGRPGS

SEQ ID NO: 7223 - DNA, 465 bp, Zea mays
  misc_feature: Ceres CLONE 349756-F
  misc_feature: Encodes the peptide sequence at SEQ ID NO. 7224
caggatgagcaaggaggatgtgctcaaggtgcagactttgatgctgagagtgaacatacactgtgacgggtgcgagaagaaggtcaagaagaccctccacaagatcgacggtgtctatcagagcagcatcgacgcggaacaggggaaggtgacggtgtccggcctgctggatccggacaccatcatcaggaagctcaacaaggccggcaagccggcccagctgtggggctccaagcctggcgtccctcagaacggccatggcggcggcaaaggccagcctaaggacgccggcgttggcaagggccattccaaggatgccggcggtggcaaggcccaaaagggcggtgcgggtggcggcggtcacaagggtgccggtgccggtggggccaaggatcctaagatggtgatgccgcagcccgacgccgcagcagctccagcagcagttgcagatgaaggggctgaagc

SEQ ID NO: 7224 - protein, 153 aa, Zea mays
  misc_feature: Ceres CLONE 349756-F
  misc_feature (13)..(73): Pfam Name: HMA Pfam Description: Heavy-metal-associated domain
MSKEDVLKVQTLMLRVNIHCDGCEKKVKKTLHKIDGVYQSSIDAEQGKVTVSGLLDPDTIIRKLNKAGKPAQLWGSKPGVPQNGHGGGKGQPKDAGVGKGHSKDAGGGKAQKGGAGGGGHKGAGAGGAKDPKMVMPQPDAAAAPAAVADEGAE

SEQ ID NO: 7225 - DNA, 508 bp, Zea mays
  misc_feature: Ceres CLONE 349809-F
  misc_feature: Encodes the peptide sequence at SEQ ID NO. 7226
atactgaaatttggaacagagcaactcagcgagtataagctaacctgatcgttttcctcatttcaccttccaccctcccccactttctcctcrccgagtcacaaagccaaaccctaattcacggccgccggagatgggacaaggttctcccggcgggatgggcaagcagcccggcctcccgggcgaccgcaagcagggagacggcaagaaagagaagaaatatgaaccacccgctgccccttcccgtgtcggccggaagcagaagcggcagaagggctccgaggcggcggcgcggctccccgccgtggcgccgctctcaaagtgccgccttcgcctactcaagctcgaacgcgtcaaggactaccttctcatggaagaggagttcgttgccagccaggagcgcctgcgccccagcgaggataagacggaggaggaccgatccaaggtcgacgacctccgcggcactcccatgaacgtcggatcgctggaggagatcatcgacgagagc

SEQ ID NO: 7226 - protein, 125 aa, Zea mays
  misc_feature: Ceres CLONE 349809-F
MGQGSPGGMGKQPGLPGDRKQGDGKKEKKYEPPAAPSRVGRKQKRQKGSEAAARLPAVAPLSKCRLRLLKLERVKDYLLMEEEFVASQERLRPSEDKTEEDRSKVDDLRGTPMNVGSLEEIIDES

SEQ ID NO: 7227 - DNA, 446 bp, Zea mays
  misc_feature: Ceres CLONE 349849-F
  misc_feature: Encodes the peptide sequence at SEQ ID NO. 7228
catccaactcacacacaggctcaccccaccaacagcaagcgaaaatctcccgatcccctctggtctccgcggcgaagatgtcggggcgcggcaagggcggcaagggcctgggcaaggrcggagcgaagcgccaccggaaggtgctccgcgataacatccaggggatcacgaagccggcgatccggcggctggcgcgcaggggcggcgtgaagcgcatctccgggctcatctacgaggagacccgcggcgtcctcaagatcttcctggagaacgtgatccgcgacgccgttacctacaccgagcacgcgcgccgcaagaccgtcaccgccatggacgtcgtctacgcgctcaagcgccagggccgcaccctctatggcttcggcggctaggccggccgcgcctcgctgtcgtcgctgcggttctattgttttttgcaatccgcaagt

SEQ ID NO: 7228 - protein, 103 aa, Zea mays
  misc_feature: Ceres CLONE 349849-F
  misc_feature (25)..(94): Pfam Name: Histone Pfam Description: Core histone H2A/H2B/H3/H4
  misc_feature (14)..(14): Xaa is any aa, unknown, or other
MSGRGKGGKGLGKXGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7229 - DNA, 490 bp, Zea mays
  misc_feature: Ceres CLONE 349851-F
  misc_feature: Encodes the peptide sequence at SEQ ID NO. 7230
gtctccgcagacgcctcccttttcttctcactccactccgccgcccggattcagagcgacagcgagaggaggcggagagggcggacatggcggcgatgttggtgggcgcgctgcggaggggaagtggatgccgcggcggcttgcgccttatcgctcattcgcttcgcagattcgtgagcacgctcgtcgtagcggagcacgaaggcgggttcgtcaagccgtcgtcgctgagcgcattggccgccgcggaggcaattgccaaggacaacaaagtttctgtcctgctgggtggttccgggccggcgcttcacaaggccgccgaccatgccgcgtgctgccatccactggtgtctgaggtgctcgtggccgattccgaagccttggcgcatcctctggctgaaccctgggccgagctactccgttccgttcagcagaaaggatgctactctcatgtcatagcttcatccacatcattcgggaagaatttgct

SEQ ID NO: 7230 - protein, 134 aa, Zea mays
  misc_feature: Ceres CLONE 349851-F
MAAMLVGALRRGSGCRGGLRLIAHSLRRFVSTLVVAEHEGGFVKPSSLSALAAAEAIAKDNKVSVLLGGSGPALHKAADHAACCHPLVSEVLVADSEALAHPLAEPWAELLRSVQQKGCYSHVIASSTSFGKNL

SEQ ID NO: 7231 - DNA, 334 bp, Zea mays
  misc_feature: Ceres CLONE 349896-F
  misc_feature: Translation starting site: 150
  misc_feature (139)..(139): n is a, c, t, g, unknown, or other
gcactgcttggaatccaacgagccaatcattcaaatcctccccggaaccgcgttgagcagggcacggtcgattggatctagggtgagggtccgtcgccgaagaaactcgcaggcggtcacgaaggaggccgcsgggganggcgggggagatggcctcggaggagatgacggcgacgagtggcygcgctgcyggacttgaagccgcacccggagggcggcttctacatcgagaccttccgcgacrgctccatcacgctcaccacgtyccarctcccgscccactacaaggtttaaccgtgctgttagcaccgcaatctatttcctacttcccgca

SEQ ID NO: 7232 - DNA, 531 bp, Zea mays
  misc_feature: Ceres CLONE 350031-F
  misc_feature: Encodes the peptide sequence at SEQ ID NO. 7233
acgggctccgtaagcacttcccgagaaaaggaagacagagaaggaaactgcagtgaagtcgccggcgccgccgcgacaggaggaaggagcagcagcggcaggggaggcccggcgatctcttctgttgcgtgcggcgagggagtaaaaggagccgcgacaggatgcactcctttgggcaccgcgccaacgcggtggcaacgttcgcggtcaccatactggccgcgatttgcttcgccgcctccttctccgacaacttcaacaccccgacacccactgcctccgttaagatcttgaatctaaactggttccagaaggaggccaacggcaacgacgaggttagcatgacgctgaacatttcggccgacctttcgtctcttttcacgtggaacacaaaacaggtgtttgtttttgtggcagcagagtatgagactccacagaatgctttgaatcaagtttccctttgggatggcattatacctgcaaaggagcatgccaaatttttgatccataccacaaaccagtacagattta

SEQ ID NO: 7233 - protein, 123 aa, Zea mays
  misc_feature: Ceres CLONE 350031-F
  misc_feature (1)..(123): Pfam Name: SPC22 Pfam Description: Signal peptidase subunit
MHSFGHRANAVATFAVTILAAICFAASFSDNFNTPTPTASVKILNLNWFQKEANGNDEVSMTLNISADLSSLFTWNTKQVFVFVAAEYETPQNALNQVSLWDGIIPAKEHAKFLIHTTNQYRF

SEQ ID NO: 7234 - DNA, 229 bp, Zea mays
  misc_feature: Ceres CLONE 350096-F
  misc_feature (184)..(184): n is a, c, t, g, unknown, or other
gatagacttcgtaggtgcggacaggttttcgctctaccccgacacagacccgacccgttacgccgcaccactcttcttcctctgctccgcctyttcacccagcgtcttccgattgctgacggatccctcttcgccgcggccgscgccgcggaccgaccgtgggagagaaggcgaggcgggagcnatggaggccgccgaytacggcaagctcttcgtcggcggcatctca

SEQ ID NO: 7235 - DNA, 511 bp, Zea mays
  misc_feature: Ceres CLONE 350099-F
  misc_feature: Encodes the peptide sequence at SEQ ID NO. 7236
aaaccgaaaaggaggacaaaatttctcctctcgaagaaccctagcggcaaaacctttgctccgtcccgccgtcgcctgctcccatcccgccgccggcgctgccacccgcatctgccaaggggctcgccgccggggaggctgctcgcggtgccgcgctctctcccgcgcccgaccttggccctcccctcctccatgatctgcgcgatctccggcgaggtgccggacgagccggtcgtttcgaagaagtcggggctactcttcgagcggcggctcatcgagcgctacattgaggaccactgscaagtgtcccgccaccaaggaggacctccaccatggatgatatcgtgccggtcaagaccaacacgatcgtgaagcccaggcctttgcaggctgcaagcattccaggactccttgggatttttcagaacgagtgggatgctctcatgcyttctaattttgcyttggagcagcagcttcacacagcaagacaagaacttagtcatgcactcta

SEQ ID NO: 7236 - protein, 59 aa, Zea mays
  misc_feature: Ceres CLONE 350099-F
  misc_feature (18)..(59): Pfam Name: Prp19 Pfam Description: Prp19/Pso4-like
  misc_feature (39)..(39): Xaa is any aa, unknown, or other
MDDIVPVKTNTIVKPRPLQAASIPGLLGIFQNEWDALMXSNFALEQQLHTARQELSHAL

SEQ ID NO: 7237 - DNA, 460 bp, Zea mays
  misc_feature: Ceres CLONE 350153-F
  misc_feature: Encodes the peptide sequence at SEQ ID NO. 7238
gcatcgaacaccaatggcattcttgcattgaaggaaccttccctccacctccaccgcccgagagcgagcggccggacggggttttggttgggcatggctgccccggcgatgctccaagtggtgatcctcgccgcggtcctccttctcccgttcctcagcgtgccgggcgccgaggcacagaccaagaagttctgcctcacgcagttcgccatcgctagccaggcctgcgccatcctgccacccaccagtcctgagcaccaccaccatcatcacgatgacgaggacaatgacgaggacaacgacgaagatgaggacgaagacgaggacaacgatgaagatgaagacgaggacaatgacgacgatagcggtttgacagctagtggctgcggtggcggcctgctagctgctgttggtgtgatggcgcgtgtgcgtgtcggtgagctgagtaccgcgggtggtt

SEQ ID NO: 7238 - protein, 122 aa, Zea mays
  misc_feature: Ceres CLONE 350153-F
MAAPAMLQVVILAAVLLLPFLSVPGAEAQTKKFCLTQFAIASQACAILPPTSPEHHHHHHDDEDNDEDNDEDEDEDEDNDEDEDEDNDDDSGLTASGCGGGLLAAVGVMARVRVGELSTAGG

SEQ ID NO: 7239 - DNA, 473 bp, Zea mays
  misc_feature: Ceres CLONE 350284-F
aaaccaagctcgatccatctcactctccgctggtcgctcactcttgcagctccacccttcactcagtcttagtctcttattagctctaggctctagctagccgcgccactccttcgtgtagccatcagccttctcatcgccaccaatggccactgcgaggtccagaccccgaccgtcgtggcggccgaggaagcgcccgtggtggagaccccgccgccggccgtcgtgcccgaggagtctgcccccgccgaggccgaggccgaggccgaggctgctgctcctgctgatcccgaggagcttcccgcggccgagcagcaggcagccgccgaggcggaggccgcggctcctgctggtgccgaggagcccgtcgcggccgaaccggccgccgaggcggaggctgctgctcctgctggtcccgaggagactcctgcggtcgagcaggaggcagccgccgaggaggaggctgctgctgc

SEQ ID NO: 7240 - DNA, 438 bp, Zea mays
  misc_feature: Ceres CLONE 350293-F
  misc_feature: Encodes the peptide sequence at SEQ ID NO. 7241
gaaaaactcagaaaacccagccgccgccgcatcggcctcccaggtaagcagtagcgtccaccccagccgccgccatgaagcgcaacccccgcgtcacgagctcccgccggaagtgccgcaaggcgcacttcacggccccgtcctccgtccgccgcgtgctcatgtccgcggcgctatcgacggagctccgccacaagtacaatgtgcgttccatcccgatccgcaaggacgacgaggtgcaggtcgtgcgcggcacctacaagggccgtgagggcaaagtggtgcaggtgtaccgccgtcgctgggtcatccacgttgagcggatcacccgcgagaaggtgaacggctccaccgtgaacgtgggcatccacccttccaaggtcatggttacaaagctgaagcttgacaaggaccgcaaggcgctcctcgaccgcaagg

SEQ ID NO: 7241 - protein, 121 aa, Zea mays
  misc_feature: Ceres CLONE 350293-F
  misc_feature (51)..(82): Pfam Name: KOW Pfam Description: KOW motif
MKRNPRVTSSRRKCRKAHFTAPSSVRRVLMSAALSTELRHKYNVRSIPIRKDDEVQVVRGTYKGREGKVVQVYRRRWVIHVERITREKVNGSTVNVGIHPSKVMVTKLKLDKDRKALLDRK

SEQ ID NO: 7242 - DNA, 467 bp, Zea mays
  misc_feature: Ceres CLONE 350311-F
  misc_feature: Encodes the peptide sequence at SEQ ID NO. 7243
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggaggcgtccctgtcgtgcgtccgctcgtggggcggcgcgct

SEQ ID NO: 7243 - protein, 127 aa, Zea mays
  misc_feature: Ceres CLONE 350311-F
  misc_feature (10)..(127): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MVSSSMDTTSDKRASSMLAPNPGKATILALGHAFPQQLVMQDYVVDGFMKNTNCDDPELKEKLTRLCKTTTVRTRYVVMSDEILKNYPELAQEGLPTMNQRLDISNAAVTQMATEASLSCVRSWGGA

SEQ ID NO: 7244 - DNA, 398 bp, Zea mays
  misc_feature: Ceres CLONE 350329-F
agacggcacggcggaccgctctcctctcctctcctcttcttccggctctccctctccgcatgccattccaacgcattacaggtatttttagccgccggaggagacgggtagctgcgtagccacactagcgagagagagagagagagagagggaggggaaaccatagctcctggccgttccgcgttcctcacgggcggcctccgtccgttctgcctgcccatccaccgcggcgccggccggccgtctcccgtccacatccctcctcctctcctgcaaggttcctgtgcggtatggtatgctagctcggctccctgtggtttccccyctcatccggaatgtgatggcgcggtggatggtgttttgatctgtgttcgcttttggcggatctggtcgcgcgc

SEQ ID NO: 7245 - DNA, 518 bp, Zea mays
  misc_feature: Ceres CLONE 350353-F
  misc_feature: Encodes the peptide sequence at SEQ ID NO. 7246
gctccttcgtattctcgacccaaccaggattcagccgcagattagcaggccgcctgcgctccttgcccctaagcctcgtttccggtgtacgactccaacgacgacgagatggcgctccgtcggagcttcccctccctcggccgcgcgcttctcacgccggcgccggcgccggcgcggacgctctccgcggaggcctccgatgccctcgttgagatcaagcccggggagattgggatggtctccggcatccccgaggagcacctccgccgtaaggttgtaatttattcaccagctaggactgcatctcagcaaggttcaggcaaagttgggaggtggaaaattaactttttgtcaacccaaaagtgggagaacccgttgatgggatggacatctactggggatccatatgctaatgtcggtgaagcaggacttacattcaacagtgcggagtcagcaaaagcatttgctgaaaaacatggatggaattatgtggtacggaaacggcatacacctcttct

SEQ ID NO: 7246 - protein, 136 aa, Zea mays
  misc_feature: Ceres CLONE 350353-F
  misc_feature (54)..(136): Pfam Name: ETC_C1_NDUFA4 Pfam Description: ETC complex I subunit conserved region
MALRRSFPSLGRALLTPAPAPARTLSAEASDALVEIKPGEIGMVSGIPEEHLRRKVVIYSPARTASQQGSGKVGRWKINFLSTQKWENPLMGWTSTGDPYANVGEAGLTFNSAESAKAFAEKHGWNYVVRKRHTPL

SEQ ID NO: 7247 - DNA, 479 bp, Zea mays
  misc_feature: Ceres CLONE 350364-F
  misc_feature: Encodes the peptide sequence at SEQ ID NO. 7248
aagaaccaccacaaaacctgctcctagctgctctcgtgtgttttgttacatccaatattaagcgagagcgggctagctataggtaagaccgtaagaggatgatggtggacaggcagcgcgtgaggcaatgcgacattgaggtcatgaagatggccatgctcaagcacgaagaaaccttcaggcagcaggtccacgagctgcatcgcctgtaccgtatacagagggagctgatgacgatgacgacgagtgacgacctgaccggagccaagccggtgaccaccccccgccggcgcagcaagcagccgcggcgggcgctgccgctgggcctgcagctcccggccgacgagtacatagccagcgccgacgaggatgaggacgccgccgccggcacggagctggagctgacgctcgccgtcggtgggcgctgctcacccgccggccgtcgcaagagcgacaggaggaggaggaggcaagcagca

SEQ ID NO: 7248 - protein, 127 aa, Zea mays
  misc_feature: Ceres CLONE 350364-F
MMVDRQRVRQCDIEVMKMAMLKHEETFRQQVHELHRLYRIQRELMTMTTSDDLTGAKPVTTPRRRSKQPRRALPLGLQLPADEYIASADEDEDAAAGTELELTLAVGGRCSPAGRRKSDRRRRRQAA

SEQ ID NO: 7249 - DNA, 446 bp, Zea mays
  misc_feature: Ceres CLONE 350402-F
  misc_feature: Encodes the peptide sequence at SEQ ID NO. 7250
gtgctttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgaaggccctggagaagagctgccgcaacgcctcctacgccggctgctcgcgatgcgtgcagt

SEQ ID NO: 7250 - protein, 115 aa, Zea mays
  misc_feature: Ceres CLONE 350402-F
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAASDVEYRCFVGGLAWATDDHSLHNAFSTYGEVLESKIILDRETQRSRGFGFVTFSTEEAMRNAIEGMNGKELDGRNITVNEAQSRGGRGGGGGEGPGEELPQRLLRRLLAMRA

SEQ ID NO: 7251 - DNA, 2165 bp, Zea mays
  misc_feature: Ceres CLONE 350412
  misc_feature: Encodes the peptide sequence at SEQ ID NO. 7252
gagccgactcctgctcctattatccgcgtcgctcctcagggcggagaggaggcaagaggaaggaagcgccgcgggagcgccagacagacagacgaaccgagcaccaccgccactagaaaaagccagcccaaaaccctagctccggcgcgccaccgcgcagatccggtgctcccgcgcgatgtcggaggcggaagcggcgggtgtcgttgtcgagcgcggcgaaatggaggacgaggagggggcggcggcgatggaggcggatgcggcgcacagcgggaggggcgaggcggaggatgaggaggtcgagagcagcgactacacgtcggaggacgagggcaccgaggactaccgtcgtggtggataccatgccgtccgcgtgggaaactccttcaagcagggcgcmtacgttgtgcagtacaagctcggatggggccacttctccaccgtatggcttgcctgggacacaacccactccagatatgtggcgctgaaggtgcagaagagcgctcaacactacacagaagcagccatggatgaggtcaagatcttgaagcagattgctgatggtgatcctgacgactcaaaatgtgttgttaagcttcttgatcacttcaagcactcggggcctaatggtaaccatgtgtgcatggtttttgagtttctcggtgataacctgttgaccctgataaagtacacggactatcgtggaattccccttccgatggttaaggagatatgccgccatgtgctcattggccttgattacctccaccgtacactttctattattcacactgaccttaaaccagagaacatattgcttgtgtctaccattgatcccacaaaggaccctcggaaatcaggcgtacccctagttccgccttcaacgaggacagacgagccacctcctaaggtgcctgcacaatcaggaaatggtggcctcaccaagaaccagaagaagaagatccggaagaaagctaaacgtgcagttgctgcaacttcagaaggaagtagtgctgtggcatctgcggacacagatgggtcagatgaccgaggagatctgggtacaacaaatgagggtagtcctagacaggatggagctaagaagcgggtgacacgagataggcgcggtagcaaaggggccaagaagatgatggcaatgaaggctgatctaaaatgcaagctggttgactttggaaacgcatgttggacatacaagcagttcacaaacgacattcaaacaaggcagtacagatgtcctgaggttatacttggttccaagtattctacatctgctgacatgtggtcctttgcatgcatttgctttgagcttgccactggggatgtgctattcgatccacatagtggcgataattttgacagagatgaggatcacctcgcgctgatgatggagctgctaggaatgatgcctcgaaagattgcgttgggtggtcggtattcacgtgatttcttcaatcggtatggggatttgcggcacatccgacgcttgcggttctggcctctcaacaaggtgctgatggagaagtacgagttcactgaaataaatgctaatgggatggcagattttcttgtcccaatacttgattttgttcctgagaagcgccctacagctgctcaattgcttcagcatccatggcttgatgttggtcccctccgacagcaacctaaaacacggccagagtcagcacagagtccaggtgatggtgtttcagagaagcaaaagaaagagaaagaagaaagagaggcaatggccgtagagttagggaatattgccatagatggtgcttcttcttccaggatggcaaatgacccccaatcaagcacaaataaaacaaccgctacctcttctaagaagtgagctgcatttgatttcatgagttaagctgtaaaacttgttttcattcgagaattgctccatgagtgggaaacatatgtttttttttaggtttgagatatgttaggatagctaccgagggaaaagaacagtaggctaaatatttgttgtatggggttgggtggacaaggttagatttgtcgtggttgcagtaaccctagccctttctttgagaacatattcttttgtacaattagaatccgcgatttgtttaatggtagcattgagcaactgaaaaaaaaaaaaaaaa

SEQ ID NO: 7252 - protein, 566 aa, Zea mays
  misc_feature: Ceres CLONE 350412
  misc_feature (76)..(494): Pfam Name: Pkinase Pfam Description: Protein kinase domain
  misc_feature (332)..(495): SWISSPROT Homolog: EC 2.7.11.1 Non-specific serine/threonine protein kinase
  misc_feature (56)..(218): SWISSPROT Homolog: EC 2.7.12.1 Dual-specificity kinase
  misc_feature (75)..(75): Xaa is any aa, unknown, or other
MSEAEAAGVVVERGEMEDEEGAAAMEADAAHSGRGEAEDEEVESSDYTSEDEGTEDYRRGGYHAVRVGNSFKQGXYVVQYKLGWGHFSTVWLAWDTTHSRYVALKVQKSAQHYTEAAMDEVKILKQIADGDPDDSKCVVKLLDHFKHSGPNGNHVCMVFEFLGDNLLTLIKYTDYRGIPLPMVKEICRHVLIGLDYLHRTLSIIHTDLKPENILLVSTIDPTKDPRKSGVPLVPPSTRTDEPPPKVPAQSGNGGLTKNQKKKIRKKAKRAVAATSEGSSAVASADTDGSDDRGDLGTTNEGSPRQDGAKKRVTRDRRGSKGAKKMMAMKADLKCKLVDFGNACWTYKQFTNDIQTRQYRCPEVILGSKYSTSADMWSFACICFELATGDVLFDPHSGDNFDRDEDHLALMMELLGMMPRKIALGGRYSRDFFNRYGDLRHIRRLRFWPLNKVLMEKYEFTEINANGMADFLVPILDFVPEKRPTAAQLLQHPWLDVGPLRQQPKTRPESAQSPGDGVSEKQKKEKEEREAMAVELGNIAIDGASSSRMANDPQSSTNKTTATSSKK

SEQ ID NO: 7253 - DNA, 412 bp, Zea mays
  misc_feature: Ceres CLONE 350432-F
  misc_feature: Encodes the peptide sequence at SEQ ID NO. 7254
ctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacycggagctcaaggagaagctcaccagactctgcaagacgacgaccgtgaggactcggtacgtggtgatgtcggatgagatcctcaagaactacccggagctggcgcaggaggggcygccgacgatgaatcagcgtctggacatctcgaacgcggcggtgacgc

SEQ ID NO: 7254 - protein, 110 aa, Zea mays
  misc_feature: Ceres CLONE 350432-F
  misc_feature (10)..(110): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
  misc_feature (57)..(57): Xaa is any aa, unknown, or other
  misc_feature (95)..(95): Xaa is any aa, unknown, or other
MVSSSMDTTSDKRASSMLAPNPGKATILALGHAFPQQLVMQDYVVDGFMKNTNCDDXELKEKLTRLCKTTTVRTRYVVMSDEILKNYPELAQEGXPTMNQRLDISNAAVT

SEQ ID NO: 7255 - DNA, 422 bp, Zea mays
  misc_feature: Ceres CLONE 350434-F
  misc_feature: Encodes the peptide sequence at SEQ ID NO. 7256
ctctcctcgtctcctacctcgcccaatcgcccgtttcacctccatccccttccgttgcccaattttactccgagtgagatccatatataaccaggcaaccaccgctgccggtctatctgcctctctcttcccctccctctctggaaccagggtggttgtcaagcggtgttggagttgggagtccttgccattggtacaagagcaagaagcaaggacagggaggggcgagaggaggaagaaagcgagggacactagaaaggtgcttgctttgtttccagttgcttcttctctctccctgggcgggagagaaagaagcaggagagatatgggcgagatggtcgtggccgggtatggcatggacaaggctctgcgggccagcgtcagcttcgacacgccatgcggcgcgctgctgcgcgagcttg

SEQ ID NO: 7256 - protein, 32 aa, Zea mays
  misc_feature: Ceres CLONE 350434-F
MGEMVVAGYGMDKALRASVSFDTPCGALLREL

SEQ ID NO: 7257 - DNA, 479 bp, Zea mays
  misc_feature: Ceres CLONE 350450-F
  misc_feature: Encodes the peptide sequence at SEQ ID NO. 7258
atgatagccttccaatctctaggagaaacgtcttgccctccactccaacatcgacacgactactcgtccgactagaaccaaacttttcaatccatcgttcgcagttcagttcacacttcacaggcgagcgcgaccatggatacccaagcacgtccggttccccgcgtcaagctcggcacccagggattcgaggtgtccaagctggggttcgggtgcatggggctgacgggcgcatacaactccccgctggacgacgaggccggcatcgccgtcatcgcgcacgctttcagccgcggagtcaccttgttcgacacctccgacgtatacgggcccctcaccaacgaaatcctcctcggcaaggcgctgaagcagctgccgcgggagcaggtgcaggtggccaccaagttcgggatacggcgtgacgagagcggcacgcggaccgtgtgcggccggccggagtacgttcgtgcctgctgcga

SEQ ID NO: 7258 - protein, 114 aa, Zea mays
  misc_feature: Ceres CLONE 350450-F
  misc_feature: SWISSPROT Homolog: EC 1.1.1.107 Pyridoxal 4-dehydrogenase
MDTQARPVPRVKLGTQGFEVSKLGFGCMGLTGAYNSPLDDEAGIAVIAHAFSRGVTLFDTSDVYGPLTNEILLGKALKQLPREQVQVATKFGIRRDESGTRTVCGRPEYVRACC

SEQ ID NO: 7259 - DNA, 494 bp, Zea mays
  misc_feature: Ceres CLONE 350486-F
  misc_feature: Encodes the peptide sequence at SEQ ID NO. 7260
cgaaaaagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggggaaggccaagccggcggcggcgtccgggagcccgtggtacggccccgaccgcgtgctgtacctgggcccactgtccggcgagccgccgagctacctgacgggcgagttcccgggcgactacggctgggacaccgcggggctgtcggcggacccggagacgttcgccaagaaccgggagctggaggtgatccactcccgctgggccatgctgggcgcgctcggctgcgtcttcccggagctgctcgcccgcaacggcgtcaagttcggcgaggccgtgtggttcaaggccggctcccagatcttcagcg

SEQ ID NO: 7260 - protein, 140 aa, Zea mays
  misc_feature: Ceres CLONE 350486-F
  misc_feature (65)..(140): Pfam Name: Chloroa_b-bind Pfam Description: Chlorophyll A-B binding protein
MASSTMALSSTAFAGKAVNVPSSSAFGEARVTMRKTAGKAKPAAASGSPWYGPDRVLYLGPLSGEPPSYLTGEFPGDYGWDTAGLSADPETFAKNRELEVIHSRWAMLGALGCVFPELLARNGVKFGEAVWFKAGSQIFS

SEQ ID NO: 7261 - DNA, 508 bp, Zea mays
  misc_feature: Ceres CLONE 350535-F
  misc_feature: Encodes the peptide sequence at SEQ ID NO. 7262
actaccgcaggccgcagcccagcaccggccgctctacgccggcacgtcctcgtttctgtccgaggtcatcgcctccgcaacttcgtggccggtgaggtcgcaccaccatggcgtcgctcctagcccggcaggcagcgcaggcgctccgcgcgaggcaaacggcgcagctcgggccggccgcgtcggcgatgcaagggcacctccgtacctacatgaacgcggggattcccaagcggttcaaagaggatgaggagaaagaacagcttgcaaaagatctcgcaaaagattggaatgctgtgtttgaaaggagcatcaatacattgtttttgactgaaatggtccgtggcttgatgctaactctcaagtacttctttgatagaaatgtcacaattaactatccgtttgagaagggtcctctgagcccccgcttccgtggtgagcacgctctcagacgttatgaatctggggaagagcgctgcattgcttgtaaactatgcgaagctatatg

SEQ ID NO: 7262 - protein, 133 aa, Zea mays
  misc_feature: Ceres CLONE 350535-F
  misc_feature: SWISSPROT Homolog: EC 1.6.5.3 NADH dehydrogenase (ubiquinone)
MASLLARQAAQALRARQTAQLGPAASAMQGHLRTYMNAGIPKRFKEDEEKEQLAKDLAKDWNAVFERSINTLFLTEMVRGLMLTLKYFFDRNVTINYPFEKGPLSPRFRGEHALRRYESGEERCIACKLCEAI

SEQ ID NO: 7263 - DNA, 508 bp, Zea mays
  misc_feature: Ceres CLONE 350540-F
  misc_feature: Encodes the peptide sequence at SEQ ID NO. 7264
aggaaaagcacgcgagagcttgtcggagggctctctgtctctgtgataaaccgatacgcagaggaagctgcggagaggtgtccctgctctgccggtgagctgcggccagcgggtgaagagaagtggaccggacggggacgaaggagagagagaagaagaaaaaggcgccgcgggggccatggctggacacgcgccggcgagggacaagaccaccaccggcttcgccgctacgtgcagcctgctgagccagtttctcaaggagaagaagggcggcctgcagggcctcggcggcctcgccatggcgccggcgccggcagctggggctttccggccgccgaccaccatgaacttgctgtccgcgctcgacgcggccaaggccaccgtcggggagccagaaggccatggccaacgcaccggcgggaatccaagggaggcagctggggaggaggcgcagcagctgacatcttctacggcggaaaagtggtcgtcttcgacaggttccccctcc

SEQ ID NO: 7264 - protein, 110 aa, Zea mays
  misc_feature: Ceres CLONE 350540-F
MAGHAPARDKTTTGFAATCSLLSQFLKEKKGGLQGLGGLAMAPAPAAGAFRPPTTMNLLSALDAAKATVGEPEGHGQRTGGNPREAAGEEAQQLTSSTAEKWSSSTGSPS

SEQ ID NO: 7265 - DNA, 466 bp, Zea mays
  misc_feature: Ceres CLONE 350564-F
  misc_feature: Translation starting site: 72
gcagcctcgcttagacagacacacacacacactcaacagcaacagctaagcctctcccaccagacagcaacatggctgaggaggaggccaagaaggtggaggtggaggtcaccaaggagcccgaggcggcacccgcggccgccgcggaggcggcggcgaaggaggacgtcgccgacgacaaggccgtcatccccgcgaccgacccgccgccgccgccggcgacgactccaaggccctggccatcgtcgacaaagttgcagatgaacctgctcccgagaagcctgcccctgcgaagcaagggggctccaatgacagggatctcgctcttgcaagggtggaaacagagaagaggaactctttgatcaaagcttgggaagagaatgsagaagacaaaagctgagaacaaggctgctaagaaagtatccgctattctttcatgggaaaacacaaagaaagcaaacataga

SEQ ID NO: 7266 - DNA, 433 bp, Zea mays
  misc_feature: Ceres CLONE 350648-F
  misc_feature: Encodes the peptide sequence at SEQ ID NO. 7267
aaaatagtcggcctcgcgtctggagattttcagatcagaaccaaactcggctcgagagagatcgcatacgcctgcctgcscacccacctccccttttccttcctcttcgccccagcgacgcggccgcycggagaccgagcgaggcaggcaactaaccaccgagaggcagggacaggaacaggaagccggaggcgaagatgtcgtcggtgttcagcggcgatgagacggcccccttcttcggcttcctcggmgcmgccgcagccctcgtcttctcatgcatgggcgccgcrtacgggaccgckaagagcggcgtcggcgtgscgtcgatgggtgtgatgcggccggagctcgtcatgaagtccatcgtgcccgtggtcatggctggtgtgctcggtatctacgggctsatcatcgccgtcatcattagcacggg

SEQ ID NO: 7267 - protein, 78 aa, Zea mays
  misc_feature: Ceres CLONE 350648-F
  misc_feature (14)..(78): Pfam Name: ATP-synt_C Pfam Description: ATP synthase subunit C
  misc_feature: SWISSPROT Homolog: EC 3.6.3.14 H(+)-transporting two-sector ATPase
  misc_feature (42)..(42): Xaa is any aa, unknown, or other
MSSVFSGDETAPFFGFLGAAAALVFSCMGAAYGTAKSGVGVXSMGVMRPELVMKSIVPVVMAGVLGIYGLIIAVIIST

SEQ ID NO: 7268 - DNA, 398 bp, Zea mays
  misc_feature: Ceres CLONE 350701-F
  misc_feature: Encodes the peptide sequence at SEQ ID NO. 7269
atcgaacaccaatggcattcttgcattgaaggaaccttccctccacctccaccgcccgagagcgagcggccggacggggttttggttgggcatggctgccccggcgatgctccaagtggtgatcctcgccgcggtcctccttctcccgttcctcagcgtgccgggcgccgaggcacagaccaagaagttctgcctcacgcagttcgccatcgctagccaggcctgcgccatcctgccacccaccagtcctgagcaccaccaccatcatcacgatgacgaggacaatgacgaggacaacgacgaagatgaggacgaagacgaggacaacgatgaagatgaagacgaggacaatgacgacgatagcggcggtggtgttagtatggactggtttagctggc

SEQ ID NO: 7269 - protein, 102 aa, Zea mays
  misc_feature: Ceres CLONE 350701-F
MAAPAMLQVVILAAVLLLPFLSVPGAEAQTKKFCLTQFAIASQACAILPPTSPEHHHHHHDDEDNDEDNDEDEDEDEDNDEDEDEDNDDDSGGGVSMDWFSW

SEQ ID NO: 7270 - DNA, 485 bp, Zea mays
  misc_feature: Ceres CLONE 350705-F
  misc_feature: Translation starting site: 291
accgagccgaccgatcgtcgctcatctttgtaggacacccgcaccctccgcgtcgaacacccgatccggacaccgctccaggctccacctctctcccatctcacgccaacgctcactggaccattcctccgtgcttgggagcggcggagagctatccacctcgtctcaggcaccctctggcgtccccctccccccgccgcgtgccggcgagctgcggagatccgggattttgacctcgcctccttctgctgacttgtgaacgaggcagcatcatagttcagtttggaaacatgtcatcgaagaagatagagttggatcacaaggacatggtccatgattctgccatcgactactatggcaagcgccttgccactgcctcttcagacttcaccgtgaagatcgttaacattggtgcggcaaatgcccatcccaggtcctggcaacgcttagtggccactatggtcctgtgtggcgtgttgcttggg

SEQ ID NO: 7271 - DNA, 478 bp, Zea mays
  misc_feature: Ceres CLONE 350708-F
  misc_feature: Encodes the peptide sequence at SEQ ID NO. 7272
acgagagggaagttgtctgtcatttgagaatcgagttgtctagacgcacccgctctcgtacgcaaaaagcagcctgcccttgttcattttttctctcctcccgtcggcgaaattttatacgccagcaaaaccgccctgtggaggaaatagagaaaaaaaaccccgaatcatacggccagaaatattagatagacagaaaggaagaggagaatagcggcgaggacgaagtggcccgcccaggaaatggcgtcgatgcagagctggcgcaaggcctacggcgccatcaaggacaccacaaccgttagcctcgccaacctcaactcggacttcaaggatctggatgtggcgatcgtgaaggcgactaatcacgtggagtgcccacccaaggagcgacacctgcgaaaggttgttgcggcgacatccatcaccaggcctagggcggatgtcgcctactgcatccacgcgcttgcccgccgtc

SEQ ID NO: 7272 - protein, 78 aa, Zea mays
  misc_feature: Ceres CLONE 350708-F
MASMQSWRKAYGAIKDTTTVSLANLNSDFKDLDVAIVKATNHVECPPKERHLRKVVAATSITRPRADVAYCIHALARR

SEQ ID NO: 7273 - DNA, 472 bp, Zea mays
  misc_feature: Ceres CLONE 350782-F
  misc_feature: Encodes the peptide sequence at SEQ ID NO. 7274
ccaccgtgaaataattgctactccgtacctatttctctcgccggcgacgagcctccgcggaaaccagtgccaagccagaggtgcttctttctccgccagactgctgctccgcgcgagaagagccaccacggagtctgcgtgactcgggacagtggagaaaatcagcggcacagcgtgggtctcgcgacctccagcgaacggtgagtcgagatccctaagtttcgatccactgtcccagtggatttgggactgcgatggaggagcagttcatcctccgcgtgccgccatccgtcgcagagcggatcgagcgcctcatgaatgaatccgccgcctcctcctccaaccccgacgaggcctccctggacctctccttctcagaggatggaagaaatggcacatttatgatcggtaatgagagctttcctgcttctctcttggatctacctgctgtggtggagtcmtacaaaacata

SEQ ID NO: 7274 - protein, 72 aa, Zea mays
  misc_feature: Ceres CLONE 350782-F
  misc_feature (1)..(72): Pfam Name: TAFII55_N Pfam Description: TAFII55 protein conserved region
MEEQFILRVPPSVAERIERLMNESAASSSNPDEASLDLSFSEDGRNGTFMIGNESFPASLLDLPAVVESYKT

SEQ ID NO: 7275 - DNA, 488 bp, Zea mays
  misc_feature: Ceres CLONE 350795-F
  misc_feature: Encodes the peptide sequence at SEQ ID NO. 7276
  misc_feature (473)..(473): n is a, c, t, g, unknown, or other
gtcgttcggtccaccacctcagctccgccgcttgcccgcttttgctctctccctcccggctctcggcttcttctacacgctaccgtctcacagccgtaaacgcccctcccggatcccgctagttctccaccgccgtccgcccgcccgcccgccgttcgcstcagcatggccgcctcatcgaccgccacctccgtccacgacttcatcgtcaaggatgcgagcggcaaagacgttgacctcagcacctacaaggggaaggttcttctcattgttaacgtcgcatcccagtgtggcttaaccaactccaactacactgagctggcccagctctatgagaagtacaaggaccaaggctttgaaatcctggctttcccatgcaaccagtttggtgggcaggagcctggtaccaatgaggagattgtccagtttgcctgcacacgcttcaaggctgagtacccatcttcgacaaagtngatgtcaacggtagc

SEQ ID NO: 7276 - protein, 107 aa, Zea mays
  misc_feature: Ceres CLONE 350795-F
  misc_feature (10)..(94): Pfam Name: GSHPx Pfam Description: Glutathione peroxidase
  misc_feature: SWISSPROT Homolog: EC 1.11.1.12 Phospholipid-hydroperoxide glutathione peroxidase
  misc_feature (103)..(103): Xaa is any aa, unknown, or other
MAASSTATSVHDFIVKDASGKDVDLSTYKGKVLLIVNVASQCGLTNSNYTELAQLYEKYKDQGFEILAFPCNQFGGQEPGTNEEIVQFACTRFKAEYPSSTKXMSTV

SEQ ID NO: 7277 - DNA, 468 bp, Zea mays
  misc_feature: Ceres CLONE 350806-F
  misc_feature: Encodes the peptide sequence at SEQ ID NO. 7278
aatctatccagtcgcatctccctctccgaaatcaaggtagcgtacaccgctgcagtttctagagccctctctgccactcgtgatcccactagtcacaatgcctgccctcgccaagcccgcctcccgcaccgccaagcccgccgcggctccgaagccgaagcctgccgccgccaagccgaaggcggccaccgctggtgcctcccacccgccttacttcgagatgatcaaggaggctatcacggcgctcaaggagaggaccggctccagctcgcaagcgatcgccaagtatgtgggggacaagcacggcgcgtctctgccggccaacttcaagaagatgctttccatccagctccgtgggtccgcagccaagggcaagctcgtgaaggtcaaggcttcgtacaagctctcggacgccgccaagaaggcatcccccaaggaccaaggctaagccggcaaaggccgccgctg

SEQ ID NO: 7278 - protein, 116 aa, Zea mays
  misc_feature: Ceres CLONE 350806-F
  misc_feature (35)..(105): Pfam Name: Linker_histone Pfam Description: linker histone H1 and H5 family
MPALAKPASRTAKPAAAPKPKPAAAKPKAATAGASHPPYFEMIKEAITALKERTGSSSQAIAKYVGDKHGASLPANFKKMLSIQLRGSAAKGKLVKVKASYKLSDAAKKASPKDQG

SEQ ID NO: 7279 - DNA, 448 bp, Zea mays
  misc_feature: Ceres CLONE 350819-F
  misc_feature: Encodes the peptide sequence at SEQ ID NO. 7280
ccccccccccatctctcctcccctccccatctcgctcttgcggagatcgaagagaagctgaggcctagcgccgcacccgccgccgcatcagccatcagccatggcgatggccgctcgcctcgtctcgcgctcccgtcagctacattcggttcaagcagcttttgcgaatggaggtgccactcaagttcgctcctttgccaaggatgcagctccagctgaccgtcctcctgttggtggggatgatctcctgaagggcatattctttgaggtaaagaagaagtttgagacagctctcggcgtccttaaaaaggaaaagatcactattgatccagatgacccagcggcagtttctcaatatgctcaagtcatgaagactgtaagggaaaaggcggatcttctttctgattctcaaaggattaaatataccattgagaccttcaccaagggc

SEQ ID NO: 7280 - protein, 116 aa, Zea mays
  misc_feature: Ceres CLONE 350819-F
MAMAARLVSRSRQLHSVQAAFANGGATQVRSFAKDAAPADRPPVGGDDLLKGIFFEVKKKFETALGVLKKEKITIDPDDPAAVSQYAQVMKTVREKADLLSDSQRIKYTIETFTKG

SEQ ID NO: 7281 - DNA, 483 bp, Zea mays
  misc_feature: Ceres CLONE 350838-F
  misc_feature: Encodes the peptide sequence at SEQ ID NO. 7282
acttcgcgggcacgcagagagccgcaagacgcacctcgctcgcaacttgttggactcgaaggggcaataggcagcaggcagggccccgaactgcgggaggagattcccaaggatcccgtcggcctggtagaggaagggacggggactggcgatggcggtggacggcggcggcggggtggactgggagagcctggcggaggccacctccggggcaatcggctcgctcgtcagcaccaccgtgctctacccgctcgacacctgcaagaccaagttccaggccgagctccagacgcaccagggcgcgcagaagtataggaacctttcagatgtcttttgggaagcgattcgtaaaaagcaatttttgtccctatatcagggcctgaacacgaagaacattcagtcttttgtctcctcgtttttttatttttatgggtatagctattttaaaagactctacttggagaagagtggagcaaagtctat

SEQ ID NO: 7282 - protein, 110 aa, Zea mays
  misc_feature: Ceres CLONE 350838-F
  misc_feature (12)..(106): Pfam Name: Mito_carr Pfam Description: Mitochondrial carrier protein
MAVDGGGGVDWESLAEATSGAIGSLVSTTVLYPLDTCKTKFQAELQTHQGAQKYRNLSDVFWEAIRKKQFLSLYQGLNTKNIQSFVSSFFYFYGYSYFKRLYLEKSGAKS

SEQ ID NO: 7283 - DNA, 409 bp, Zea mays
  misc_feature: Ceres CLONE 350851-F
  misc_feature: Encodes the peptide sequence at SEQ ID NO. 7284
acaaaccctagcattcaaccacgccgagctcgccggaacaagcccaacccgagcccaatcccgctcgggccccagccgatccgacggctcctcaccagcacaatccggggtaccccgcggatgctagcctgatcgggtccccacggtcgatgggttcgcccgggtccgccaatggcagacgcggcgactatgtgaggatcccggaggaggcggaggtggcgtccaagggggagggagatgccgcggcggcgtcaaggcggccgcggcggcggagtgccctagggtgctgcggtgcagcgcgatccggtggtgggccaaggtcgccgtgctcgggatcgtccttgctggggccggagctgccgcggtcgtcttcctcggcccgctccttatcaagaagaytgttgtacct

SEQ ID NO: 7284 - protein, 86 aa, Zea mays
  misc_feature: Ceres CLONE 350851-F
MGSPGSANGRRGDYVRIPEEAEVASKGEGDAAAASRRPRRRSALGCCGAARSGGGPRSPCSGSSLLGPELPRSSSSARSLSRRLLY

SEQ ID NO: 7285 - DNA, 502 bp, Zea mays
  misc_feature: Ceres CLONE 350866-F
  misc_feature: Encodes the peptide sequence at SEQ ID NO. 7286
acttgtgtagcccaacgagaagagcggcggcgcgggcggacaaggagcaggcggaggaggagctgtgccaagccacaatgggtatctcacgcgactcgatgcacaagcgccgtgccaccggtggaaagcagaaggcctggaggaagaagcgaaagtatgagcttggtcgccagccggccaacaccaagttgtcaagcaataagacagtgaggagggtccgtgttcgtggaggtaacgtgaagtggagggctcttcgccttgatactggtaactactcatggggaagtgaagcggctgtaatttcaaagacgaatgaggagttatcctaccacttctacggatatatggcattggtgccgaagaaatttccagcgttgacagactagtactccctccgccctttttttatttatcatcgtctagttcaaaaatgaacggccgataaatattcgagaattgcaatctactccttgacattgttacattacatggatgcgcagat

SEQ ID NO: 7286 - protein, 102 aa, Zea mays
  misc_feature: Ceres CLONE 350866-F
  misc_feature (1)..(95): Pfam Name: Ribosomal_S8e Pfam Description: Ribosomal protein S8e
MGISRDSMHKRRATGGKQKAWRKKRKYELGRQPANTKLSSNKTVRRVRVRGGNVKWRALRLDTGNYSWGSEAAVISKTNEELSYHFYGYMALVPKKFPALTD

SEQ ID NO: 7287 - DNA, 449 bp, Zea mays
  misc_feature: Ceres CLONE 350874-F
acttgtcactggcactgggcatggcgtggcgcaagcggccgcattgacaaaacgcagcagcaccgcaatttggcgtcctagttgccatgtgggggagccgagccgaggtcgggtgggagtgggaggctgtcccctacaccagccccagtcgtcgccgcgcaccatcacagcctcctccatctatcccctccctctcgagtctcgcctgctgctgctcccttcttcttcttcctcctcctcctcttcttggtcttggagctggaccttcctcttcccctcgttgatcgttcgcggttgccgattcgccatcccctccaaatcaagacaagattgagtgggtcttgggcccctgtccctagctgcattgcgaattgaggcgccaatttgggagacgactgcattgatgaatgccggaggcyacagcactcactgatttagggatcgatgtc

SEQ ID NO: 7288 - DNA, 142 bp, Zea mays
  misc_feature: Ceres CLONE 350972-F
  misc_feature (64)..(64): n is a, c, t, g, unknown, or other
  misc_feature (71)..(71): n is a, c, t, g, unknown, or other
  misc_feature (127)..(127): n is a, c, t, g, unknown, or other
aagatcgagcagcgagagacgggcaggggagagggaaaaaaaaatctaaccctagcatccgcangcgctangggttcgggggttgcgatrggcggcggcggcgagacagcgggggacggtgaaagtnggttcaacgacacca

SEQ ID NO: 7289 - DNA, 808 bp, Zea mays
  misc_feature: Ceres CLONE 351001-R
  misc_feature: SWISSPROT Homolog: EC 2.7.11.1 Non-specific serine/threonine protein kinase
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
nnnggcatttnnnntgggttttcacccaatatggttgcaataccattacatacccgcacaatacacctgctgctgctgctaaacaccatcaaaccaaacgagcagcatagcaaattagaacgctcatcccgccgtggatcaacaacaaaaaattacaccagttgagaaaagtcagtccatcccccaagccccagctccggctcctcgcatgccgcgccaggtgtgttcgtgcagggttagatccttcatctccacatggacttgtctgagtcgtcagtggcacctacgttctcggacagaagcgacggccgcgtggccatcgacgtccggtgagacgcccgcggcgagcggtgctccgtgcggaaggggaactcgtcgccctcgagcatgtgcacgatctgccccatcttgggccgcttgtgcgcgtcggcgtcgatgcagcggaggcagacgagcagcacccggttgagcacccgcggcggcggcggcgcggcgatgcgcgggtccaccaggtcctccacgcgccggctgcccaccatgcccctgaaccactccaccaggttgacctcgccggcggggcggttgtagtccacggggctgcgcccggagatgagctccatgagcagcacgccgaagctgtagatgtcgctgctctcgttcagcatgcccgtggacgcgtactcgggggccacgtacccgaacgtgcccatcacgcgggtcgtcacgtagctggacccggaccccagcaccttggccatgccgaagtccgacaccttgggggctcacttcttgtccagcaggatgttgc

SEQ ID NO: 7290 - DNA, 496 bp, Zea mays
  misc_feature: Ceres CLONE 351075-F
  misc_feature: Encodes the peptide sequence at SEQ ID NO. 7291
actccgctccttccaacttgctctctacctgcaccagcctcgcccacccttcgctcgccgccgccatggggaggggaaagttcaagggaaagcccaccggccgccacagcgtctccacaccagaggagatcgctgctggtacttcaggtcgccctcgcacctttatgaagacatgcaattgaaaaagagaattgatcttttttatgggcgaagtgtcgaagatggctttggtgaaggaaatgtcttgttagcatcaagtaaatggcgacatcacaacccctacaagcttgtgccttaaaacaagaggatacaagaagttggagtgcttttgtgaaggcttttgcgaatcacttgaagcgttagtacttttgtgaatgattttgtaaagtgtttgcaaatatgtgcaaaacataataacatgtgtaggttttgcgaatgattttgtgtgatgcttgttgatggtttatgtgatgtggatctatcattgtgcaatacc

SEQ ID NO: 7291 - protein, 38 aa, Zea mays; identical to SEQ ID NO: 6853
  misc_feature: Ceres CLONE 351075-F

SEQ ID NO: 7292 - DNA, 502 bp, Zea mays
  misc_feature: Ceres CLONE 351087-F
  misc_feature: Encodes the peptide sequence at SEQ ID NO. 7293
ataaaaaaaggtgagaactagaaggaaccgctgtgtcacacacacacacaccacacggcggccggagcggcggagccaccataaattggtgctctctccgtccgaagtgctctctgaaattccccccaaatatcccagccactgccgtcgtgcagtcaaagtgtcaaaccatgccggcagtagcgttcgcgtcggctcctgccatattcgcctccgcctccgcgcgtccctgccgcagcgcggctccgggcatcctttcctccgactccgggcggccccgccgcggcgcgcgtggcgccgtccagtgtgaggtcgcctcctcctcggcaccgtcggcggctggaccccaggccgcccggtgggcccagaggaccgtggtcatcccgccacagcgccgcgggtgccacctcatcaccaacaagatcgtaaatgagatagggaatgacctggccgacttcaagtgtggcatggcgcatctgttcttgcagcacacaagtgcgtc

SEQ ID NO: 7293 - protein, 110 aa, Zea mays
  misc_feature: Ceres CLONE 351087-F
MPAVAFASAPAIFASASARPCRSAAPGILSSDSGRPRRGARGAVQCEVASSSAPSAAGPQAARWAQRTVVIPPQRRGCHLITNKIVNEIGNDLADFKCGMAHLFLQHTSA

SEQ ID NO: 7294 - DNA, 495 bp, Zea mays
  misc_feature: Ceres CLONE 351119-F
  misc_feature: Encodes the peptide sequence at SEQ ID NO. 7295
aacacaggaaaagaaagggcatatcgaggaggtttttagggtggtggtggtgttgtgaggagctgctgcgctgctctccagtctccaccgatggcgatcaagaacatgacggtggcggcgacgacgcggtcgctggacgcggacatgacggtggacgagttcaaggagtggctgcggcggttcgacacggaccaggacgggcgcatcagccgcgacgagctgcggcgcgccctgcgtgccatccgctcccggttcacggggtggaggagcaggcagggcatcagttacgccgacgctgacggcgacggctacatcgacgacagcgaggtcgatggcctcatcgagttcgcgcagaagaacctcggcctcaagatcgtcgcctactgatctcacatggggcgcggcgcgcggcggtcggggggtgggacgcactagctcgccatgagctagctatagcgacaatgcaactcaccatcactctcttccggctaaaat

SEQ ID NO: 7295 - protein, 98 aa, Zea mays
  misc_feature: Ceres CLONE 351119-F
  misc_feature (23)..(51): Pfam Name: efhand Pfam Description: EF hand
MAIKNMTVAATTRSLDADMTVDEFKEWLRRFDTDQDGRISRDELRRALRAIRSRFTGWRSRQGISYADADGDGYIDDSEVDGLIEFAQKNLGLKIVAY

SEQ ID NO: 7296 - DNA, 481 bp, Zea mays
  misc_feature: Ceres CLONE 351142-F
  misc_feature: Encodes the peptide sequence at SEQ ID NO. 7297
gagtcttctgtcttctcttccacctttgtccgttgtctctaggcaagtctacacccgccggtctcctcctctccagatctgcccatccgccatggcgcctccaccgcaccgccacctgctgctcctcctctttctcctccctctggtcctcctcgctggcacacccgccggcgccgatgaccttgtatcggagctccaatctctccgcgcgcggtccccgtccggcgtgatccacctcaccgacacctccgtcacccgtttcctctccgccccctccgcgcgccgcccctactccgtgctcgtattcttcgacgccgcttcgctccactcaaagcctgacctccacctgccccagctccgcaccgagttcgcgctcctctccgcctccttcctcgctcacaaccccgattctggcgacctcttcttcgccgacatcgagttcgccgagtcgcagcactcctttcaccagtttggtgtcaac

SEQ ID NO: 7297 - protein, 130 aa, Zea mays
  misc_feature: Ceres CLONE 351142-F
MAPPPHRHLLLLLFLLPLVLLAGTPAGADDLVSELQSLRARSPSGVIHLTDTSVTRFLSAPSARRPYSVLVFFDAASLHSKPDLHLPQLRTEFALLSASFLAHNPDSGDLFFADIEFAESQHSFHQFGVN

SEQ ID NO: 7298 - DNA, 512 bp, Zea mays
  misc_feature: Ceres CLONE 351193-F
  misc_feature: Encodes the peptide sequence at SEQ ID NO. 7299
  misc_feature (447)..(447): n is a, c, t, g, unknown, or other
aaagaaaaattagaaaccctagcgatgctgcagatccgcctgagcaagattggctcgtcggactccggcgctgccgccaccggctcggcagccgccgccggtgccgccgccgctgtggggtcggctgcggcgctgggcggcggcatcccggaatcggtcaccgtggcatgccccgaccacctggtgatcgcggacctacccgtcgcgaagagcctcggtgccgtcacgacctccgctgccgccgccacgcgcgccatcggccgtcgctcccgtcgcccgctcggggagcgcgtccacatctgctcccgctgcgagttccccatcgccatctacggccgcctcgtacgaacttgctaagcccttttctttatgcggctatcaaaccacgaacttgtyccgcttgtgttgctgctaaggaaactaggggtttaattaaccgcgtgtgtngtggagccacttaccgccacaaactctattattcctctgttgatatcgtaagtgaaaatggagca

SEQ ID NO: 7299 - protein, 110 aa, Zea mays
  misc_feature: Ceres CLONE 351193-F
MLQIRLSKIGSSDSGAAATGSAAAAGAAAAVGSAAALGGGIPESVTVACPDHLVIADLPVAKSLGAVTTSAAAATRAIGRRSRRPLGERVHICSRCEFPIAIYGRLVRTC

SEQ ID NO: 7300 - DNA, 903 bp, Zea mays
  misc_feature: Ceres CLONE 351197-R
  misc_feature (1)..(1): n is a, c, t, g, unknown, or other
  misc_feature (15)..(15): n is a, c, t, g, unknown, or other
  misc_feature (16)..(16): n is a, c, t, g, unknown, or other
  misc_feature (567)..(567): n is a, c, t, g, unknown, or other
  misc_feature (598)..(598): n is a, c, t, g, unknown, or other
  misc_feature (903)..(903): n is a, c, t, g, unknown, or other
ngggtttcaggggannccgggttggtacgccatatagttgcaataccattacatacccgcacaatacacctggctgctgctgctaaacaccatcaaaccaaacgagcagcatagcaaattagaacgctcatcccgccgtggatcaacaacaaaaaattacaccagttgagaaaagtcagtccatcccccaagccccagctccggctcctcgcatgccgcgccaggtgtgttcgtgcagggttagatccttcatctccacatggaacttggtctagagtccgtcaggggggcaacctaacggttcttcgggaaaaaaaaacaaaacggccgccgggggggccatttcgaaaagttcccggggggaaaaaaccaccccgcgcggggcaaaaaacgggggggggccccccccctggggtggggaaaaaagggggggaaaacaccttttttcgcgggccccccccccccacagaaaaaaaacaatttttgttccccccgcaaaattataattttgttgtggccccccccccccgattttttttttttggggggggggaacaaaaacacatncgattagattttttgttggaggcggcggccnaaccgaattactattgaggagaggtgaggtggggctctactattgagggtggcgatggtaccccccccgccgcccaactggatattgggagagaagatgaggcgtcaagcggatgtaaagggagggcgaggggttgtaaaaaagacgccccagccgccctcaacagacgtgagtttgtgagaaaagaaaagataacaccctccacccacggacatgggggggggataaaaaataaggaggagtgggtgaggtgggaagtgcggttagcacatggacgaagggggagaaataaagagaacaaagan

SEQ ID NO: 7301 - DNA, 448 bp, Zea mays
  misc_feature: Ceres CLONE 351223-F
  misc_feature: Encodes the peptide sequence at SEQ ID NO. 7302
ataacacatctggtaagcgagcaccgagcagcaggtggtctcaacggtcgacgcgacaactttccttgtccatgcagcagatcactcgtcgtacgttccctatgctggctcctcctcggctccccctcgtcggggcgctcctgctgctcctcgccgtcgcgctcggcgcggtgccgtgcgagagcgccgcgctccgcctccgcggctccgtcgcctgcctcgactgcgacgaggaacacgatctctccggtgtggtcgtggcggtgaaatgcgccggcgacggcgacggcggcgcgggcctccacgcggcgcagaccgacgatcgcggcaacttcgacgtgaccgtgccagcagaagcgtcagcctcgggcgcgccgtgcgcggccagggtcctcggcgccacggagcagctctgcgcgccgtggggactcacggtcgcgcgcgtcgt

SEQ ID NO: 7302 - protein, 125 aa, Zea mays
  misc_feature: Ceres CLONE 351223-F
MQQITRRTFPMLAPPRLPLVGALLLLLAVALGAVPCESAALRLRGSVACLDCDEEHDLSGVVVAVKCAGDGDGGAGLHAAQTDDRGNFDVTVPAEASASGAPCAARVLGATEQLCAPWGLTVARV

SEQ ID NO: 7303 - DNA, 465 bp, Zea mays
  misc_feature: Ceres CLONE 351250-F
  misc_feature: Encodes the peptide sequence at SEQ ID NO. 7304
actcaaagacaggcccatgcttttgcaacggcccaacgcgaatctacatgtacgtcttcctagggttttggatgcgtcgcagataaaagatccctccctaattacaatcttcctcaacgccgccgctcccagacaccgagcccgactgcccgaccccgatccggcgatccgtctccttcctttccttcgttctgccggccccgatcactcgtcaaccatggcggcggcagcaggcggaggagcggtgcgtgctctgtcccagaaggagcaggacatacagatgatgctcgccgccgacgtccaccttggcaccaagaactgcgatttccagacggagcgctatgtctttaagcgccgttccgacggcatctacatcatcaatcttggcaagacatgggataaactccagcttgcagcgagggttatcgttgccatcgataacccgcaggacatcatcgtccagtc

SEQ ID NO: 7304 - protein, 82 aa, Zea mays
  misc_feature: Ceres CLONE 351250-F
MAAAAGGGAVRALSQKEQDIQMMLAADVHLGTKNCDFQTERYVFKRRSDGIYIINLGKTWDKLQLAARVIVAIDNPQDIIVQ

SEQ ID NO: 7305 - DNA, 397 bp, Zea mays
  misc_feature: Ceres CLONE 351277-F
  misc_feature: Encodes the peptide sequence at SEQ ID NO. 7306
actaccgcaggccgcagcccagcaccggccgctctacgccggcacgtcctcgtttctgtccgaggtcatcgcctccgcaacttcgtggccggtgaggtcgcaccaccatggcgtcgctcctagcccggcaggcagcgcaggcgctccgcgcgaggcaaacggcgcagctcgggccggccgcgtcggcgatgcaagggcacctccgtacctacatgaacgcggggattcccaagcggttcaaagaggatgaggagaaagaacagcttgcaaaagatctcgcaaaagattggaatgctgtgtttgaaaggagcatcaatacattgtttttgactgaaatggtccgtggcttgatgctaactctcaagtacttctttgatagaaatgtcacaatttaact

SEQ ID NO: 7306 - protein, 95 aa, Zea mays
  misc_feature: Ceres CLONE 351277-F
  misc_feature (64)..(95): SWISSPROT Homolog: EC 1.6.5.3 NADH dehydrogenase (ubiquinone)
  misc_feature (69)..(95): SWISSPROT Homolog: EC 1.6.99.5 NADH dehydrogenase (quinone)
MASLLARQAAQALRARQTAQLGPAASAMQGHLRTYMNAGIPKRFKEDEEKEQLAKDLAKDWNAVFERSINTLFLTEMVRGLMLTLKYFFDRNVTI

SEQ ID NO: 7307 - DNA, 474 bp, Zea mays
  misc_feature: Ceres CLONE 351279-F
  misc_feature: Encodes the peptide sequence at SEQ ID NO. 7308
aaaaaacatcctgccgtttcccgttcacccagcgtgcgctccatcttggcgaggccgcgagggcgaccgctacagcagcagccgccgccgccgccgcagatccccaggccttcgttgaacccttcgccgtaacgagatcagatggctgggtatatgtcaagagggccccaaaatggttctgtgtatgtctgcaatctacctcctggaactgatgaaaatatgttggctgaatattttggcaccataggcttgctaaagaaggacaaaaggactgggcgtccaaaaatttggatatacagggacaaagttactaatgaaccaaagggtgatgcaacagtcacctatgaggatccacatgctgcttcagctgctgtggaatggttcgataacaaggatttccatgggagcactattcaggttcacatagctgagtcaaaaagcaaagatgcattcgataaccccacgagtttgaac

SEQ ID NO: 7308 - protein, 111 aa, Zea mays
  misc_feature: Ceres CLONE 351279-F
  misc_feature (14)..(93): Pfam Name: RRM_1 Pfam Description: RNA recognition motif. (a.k.a. RRM, RBD, or RNP domain)
MAGYMSRGPQNGSVYVCNLPPGTDENMLAEYFGTIGLLKKDKRTGRPKIWIYRDKVTNEPKGDATVTYEDPHAASAAVEWFDNKDFHGSTIQVHIAESKSKDAFDNPTSLN

SEQ ID NO: 7309 - DNA, 467 bp, Zea mays
  misc_feature: Ceres CLONE 351378-F
  misc_feature: Encodes the peptide sequence at SEQ ID NO. 7310
actgtccagtgtccttgttgtccaccactccctcgagtccgtgacgcgtcagcgtcaccgtccgtcgtcgcagacgagcccagtggcgactggcgcgattcgctttcgaaccgcagtcgcccctgctgtgttcccggttccctccctcctcctatagttggcttctcgccaccctctgccttcgaccagctttccccgttctcccctccccgttcccctctccaactccaatccatggcctccacggatcgctccgcgccggcggaggaccagcaacagccgcagcgcccgtccctcttctcgccgtaccagatgccccacttccgcctcgcgcaccgggtggtgctggcgccgatgaccaggtgccgggcgcccgatgcgctcccgggccccgcgctcgcggagtactacgcgcagcggtccacggaaggcggcttgctcatctccgagggcaccatcatctcgcc

SEQ ID NO: 7310 - protein, 77 aa, Zea mays
  misc_feature: Ceres CLONE 351378-F
  misc_feature: SWISSPROT Homolog: EC 1.3.1.42 12-oxophytodienoate reductase
MASTDRSAPAEDQQQPQRPSLFSPYQMPHFRLAHRVVLAPMTRCRAPDALPGPALAEYYAQRSTEGGLLISEGTIIS

SEQ ID NO: 7311 - DNA, 381 bp, Zea mays
  misc_feature: Ceres CLONE 351394-F
  misc_feature: Translation starting site: 59
attccatatttccatcctccattcacgcatcacaagctggaaggcactgtgggcaataatggctctgctcacgctccagcagccagcgatacccttcctcctgctcctcctcctgctccccgccgcgtccgctaggctgcccggtggccggacactggtcttcatcctggctgggcagtccaacatgagcggccgcggcggcgccaccaacggcacctgggacggcatcgtcccgccggagtgcgcgccctcggaccgcatcgtccgtctctcccccgcgcttcgctgggagcaggcgcgcgagccgctgcacgccggcgtcgacgtgggcaacgttctcggcgtcgggcccggcatgcccttcgcgcacgccgtgctcgc

SEQ ID NO: 7312 - DNA, 488 bp, Zea mays
  misc_feature: Ceres CLONE 351404-F
  misc_feature: Encodes the peptide sequence at SEQ ID NO. 7313
ttcaacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggaggcgtccctgtcgtgcgtccgctcgtggggcggcgcgctctcgtccatcacccacct

SEQ ID NO: 7313 - protein, 133 aa, Zea mays
  misc_feature: Ceres CLONE 351404-F
  misc_feature (10)..(133): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MVSSSMDTTSDKRASSMLAPNPGKATILALGHAFPQQLVMQDYVVDGFMKNTNCDDPELKEKLTRLCKTTTVRTRYVVMSDEILKNYPELAQEGLPTMNQRLDISNAAVTQMATEASLSCVRSWGGALSSITH

SEQ ID NO: 7314 - DNA, 394 bp, Zea mays
  misc_feature: Ceres CLONE 351449-F
  misc_feature: Encodes the peptide sequence at SEQ ID NO. 7315
agatcggacttggttcctacaactttttcggcctggccaaccgtgctgtgcaggagagcagtgcagaggagagcgaggaggcgtgcgattgcttgctttgcttccgagtttcgacacgcgtgcccaggaatcggtcggattccccaatcccgtcaccatggccgcgccgccttctccttcgtcccgctccccgtcgagcgaggttgccgtccacagattcagcggcaccttggatgtatcatcatcgccctcaaggaccgagttgttgagcatggtgaagaagcactcacatttgattgggtggacgattattggtgccgaggatgatgcatcagatgtgggaatggatgataaattctggcatgaaatgcttgacctattcttygtgcgtggc

SEQ ID NO: 7315 - protein, 79 aa, Zea mays
  misc_feature: Ceres CLONE 351449-F
MAAPPSPSSRSPSSEVAVHRFSGTLDVSSSPSRTELLSMVKKHSHLIGWTIIGAEDDASDVGMDDKFWHEMLDLFFVRG

SEQ ID NO: 7316 - DNA, 435 bp, Zea mays
  misc_feature: Ceres CLONE 351531-F
  misc_feature: Encodes the peptide sequence at SEQ ID NO. 7317
gcaggcgcagcaaggtgggagaagaaactggcttccaagatgggcgagcatggaggtggtggcaatgggaacccgaggtctctcgactggaagcgcgatttttgatcgcttcagggtgcattgtggatgctcctacctgaagctacactgtttccgtgagttcagaatgatctgacttaacttgccttgtgcgtgccctgcagctgctccttgttccgagttactttgtttcgaaacgatgccgcttatatatagcaagcaagcacttctctccactggccaatggtgaaaaactaagctagtgcttgctctgtggggatctttacaagttccgttgttatatcctttgttgctactcgttaagttcctacattatttgccatgccaagttcttttgctcgctagcttcctgtgaagactgtaccatgagttgta

SEQ ID NO: 7317 - protein, 41 aa, Zea mays
  misc_feature: Ceres CLONE 351531-F
MEVVAMGTRGLSTGSAIFDRFRVHCGCSYLKLHCFREFRMI

SEQ ID NO: 7318 - DNA, 426 bp, Zea mays
  misc_feature: Ceres CLONE 351537-F
  misc_feature: Encodes the peptide sequence at SEQ ID NO. 7319
gaaaaaagaaaaaggaaattttcttgggcgttcttcggcttcattgtcacaaggttcgagttcgtcaccgtctagtacgactgtgcgagggaggaagaggcgaggagaagatgcagatcttcgtgaagaccctgacggggaagaccatcaccctcgaggtggagagcagcgacaccgtcgacaacgtcaaggccaaaatccaggacaaggaagggattcccccagatcaacagcgactgatattcgctggcaagcagctggaggatggacgcacgctggctgactacaacatccaaaaggagtcaactcttcatttggtcctcaggcttaggggtggaaccatgatcaaggtcaaaactctcactgggaaagagatcgagatcgacattgaacccactgactcgattgacaggatcaaggagcgtg

SEQ ID NO: 7319 - protein, 105 aa, Zea mays
  misc_feature: Ceres CLONE 351537-F
  misc_feature (6)..(74): Pfam Name: ubiquitin Pfam Description: Ubiquitin family
  misc_feature: SWISSPROT Homolog: EC 3.1.2.15 Ubiquitin thiolesterase
MQIFVKTLTGKTITLEVESSDTVDNVKAKIQDKEGIPPDQQRLIFAGKQLEDGRTLADYNIQKESTLHLVLRLRGGTMIKVKTLTGKEIEIDIEPTDSIDRIKER

SEQ ID NO: 7320 - DNA, 523 bp, Zea mays
  misc_feature: Ceres CLONE 351549-F
  misc_feature: Encodes the peptide sequence at SEQ ID NO. 7321
caatctctctcttctcctcgcctcgccttggtgttcacgccgtcgctagcgcctgccgcggcgaagcttctgtcctccccggcgccgggctcgggtcgtcgtcggccaggaagatggctggcggcttcagggtactgcatctggtcaggccttttctggctttcttgccagaggtgcagagcgcggataggaagataccgttcagagaaaaagttatatacactgttatttccctcttcattttcctggtctgcagccagctcccactctatggcattcattcaacaactggagctgatcctttctactggatgcgtgttatcctcgcatcaaaccgtggcactgtgatggagttgggtattactccaattgtgacatctgggatggtaatgcaacttcttgttggatcgaagatcattgaagttgacaacagtgtgagagaggatcgtgctctgctgaatggtgcacaaaagttcgcttggtatcctgattgctattggggaagctgtggcatatggtcctg

SEQ ID NO: 7321 - protein, 136 aa, Zea mays
  misc_feature: Ceres CLONE 351549-F
MAGGFRVLHLVRPFLAFLPEVQSADRKIPFREKVIYTVISLFIFLVCSQLPLYGIHSTTGADPFYWMRVILASNRGTVMELGITPIVTSGMVMQLLVGSKIIEVDNSVREDRALLNGAQKFAWYPDCYWGSCGIWS

SEQ ID NO: 7322 - DNA, 165 bp, Zea mays
  misc_feature: Ceres CLONE 351559-F
actgcttccaaccctcccgcctcttcctaatccgcctcctcccgctcagtcgccgccgtggaggaaggagcaactcgatcgccagtcatgacccggggagagaaccaggagtcgcagaccgggaacgtctccgccgcatctgcggctgcgccgggaccgaagccg

SEQ ID NO: 7323 - DNA, 464 bp, Zea mays
  misc_feature: Ceres CLONE 351562-F
  misc_feature: Encodes the peptide sequence at SEQ ID NO. 7324
atcgcagaaattctccgcaacttcacagcgtatcatcgttttccatcgctcctactcctatcatccagaaaatctgagcggtattgatggcgcccaaggcggagaagaagccggcggcgaagaaggtggcggaggaggagccctcggagaaggcggctccggcggagaaggcccccgcggggaagaaggccaaggcggagaagcggctacctgcgggcaagtccgccggcaaggagggcggcgacaagaaggggaggaagaaggcgaagaagagcgtggagacctacaagatctacatcttcaaggtctccgttctcccccaattcgccttcacctcgccgcttcctccttgaccgccaccgttgacgtcgtcttccggcgaggtagctcgccggaagactcacctggacttttccgacgcaccctccacacactctttaaccctccggaatggccgcctgctt

SEQ ID NO: 7324 - protein, 88 aa, Zea mays
  misc_feature: Ceres CLONE 351562-F
MAPKAEKKPAAKKVAEEEPSEKAAPAEKAPAGKKAKAEKRLPAGKSAGKEGGDKKGRKKAKKSVETYKIYIFKVSVLPQFAFTSPLPP

SEQ ID NO: 7325 - DNA, 425 bp, Zea mays
  misc_feature: Ceres CLONE 351576-F
  misc_feature: Translation starting site: 92
atcgaacaccaatggcattcttgcattgaaggaaccttccctccacctccaccgcccgagagcgagcggccggacggggttttggttgggcatggctgccccggcgatgctccaagtggtgatcctcgccgcggtcctccttctcccgttcctcagcgtgccgggcgccgaggcacagaccaagaagttctgcctcacgcagttcgccatcgctagccaggcctgcgccatcctgccacccaccagtcctgagcaccaccaccatcatcacgatgacgaggacaatgacgaggacaacgacgaagatgaggacgaagacgaggacaacgatgaagatgaagacgaggacaatgacgacgatagcggcggtgtacaagctgtcaatagcggcagcatgtgagctgcagtggccaaaggacaggata

SEQ ID NO: 7326 - DNA, 436 bp, Zea mays
  misc_feature: Ceres CLONE 351580-F
  misc_feature: Encodes the peptide sequence at SEQ ID NO. 7327
  misc_feature (420)..(420): n is a, c, t, g, unknown, or other
acatcgcctccaccgctctctcttcctctgctcttctctgcctgcctgagctcaccgcacctcgcctcctcaccgcgtttcctccgttaatccggtagaaaatggccgatgccgaggatatccagcccctcgtctgcgacaacggaactggcatggtcaaggctgggttcgctggcgacgacgccccgagggccgtcttccccagcatcgtggggcgcccgcgccacactggtgtcatggtcgggatggggcagaaggacgcctacgtcggtgacgaggcgcagtccaagaggggtatcctgaccctcaagtaccccatcgagcacgggatcgtcagcaactgggacgacatggagaagawctggcatcacaccttctacaacgagctccgcgtggctcccgaggagcaccccgtcctcntcaccgaggcgcccct

SEQ ID NO: 7327 - protein, 111 aa, Zea mays
  misc_feature: Ceres CLONE 351580-F
  misc_feature (4)..(111): Pfam Name: Actin Pfam Description: Actin
  misc_feature: SWISSPROT Homolog: EC 2.7.10.2 Non-specific protein-tyrosine kinase
  misc_feature (87)..(87): Xaa is any aa, unknown, or other
  misc_feature (107)..(107): Xaa is any aa, unknown, or other
MADAEDIQPLVCDNGTGMVKAGFAGDDAPRAVFPSIVGRPRHTGVMVGMGQKDAYVGDEAQSKRGILTLKYPIEHGIVSNWDDMEKXWHHTFYNELRVAPEEHPVLXTEAP

SEQ ID NO: 7328 - DNA, 432 bp, Zea mays
  misc_feature: Ceres CLONE 351587-F
  misc_feature: Encodes the peptide sequence at SEQ ID NO. 7329
acatatgactgtgacctgacgccgaccagattgacctgtgccctgttgagtgtgaaggaggcgcacgcgcttgagctgaagaaactgccgcgctgatctagctcgccgggatgggcgcctcggggcctgcggctccgccggcaacgcatcgccgccgctgcatccagctgctgctgctgctggccctggccgtcgcgccgcttggcagccgtgggcttcgcgtccgtgccgcgggggcggacacgggagggctgagccgggacgcgttcccgaaggggttcgtcttcgggacggcgacgtccgcgtaccaggtcgagggcgcggcgacgtccggcggccgcgggccctgcatctgggatcccttcgtccacacccccggaaagattgctgaagacgccaacgcagatgttacaacagatgaatatcatcgct

SEQ ID NO: 7329 - protein, 107 aa, Zea mays
  misc_feature: Ceres CLONE 351587-F
  misc_feature: SWISSPROT Homolog: EC 3.2.1.21 Beta-glucosidase
MGASGPAAPPATHRRRCIQLLLLLALAVAPLGSRGLRVRAAGADTGGLSRDAFPKGFVFGTATSAYQVEGAATSGGRGPCIWDPFVHTPGKIAEDANADVTTDEYHR

SEQ ID NO: 7330 - DNA, 626 bp, Zea mays
  misc_feature: Ceres CLONE 351621-R
caattgggtaccgggccccccctcgaggtcgacggtatcgataagcttttttttttttttttttgaaaagaaaaaggcattgagtacatgtgttggatggagatgaaagcagacagaactgcatcatagaatagttcattcatgtagcaacgataacgggggatattcactactgactactctccctcttccctctagcttgaaacaagtgacatttctaacaagacgctcacatctgccatccatttacagagatgggagagtggcctctgccatctacatgtcgtcatccaactcgttcttctcatcctcgtcttcctggtcaccatcgtcatcctcgtcctcgtgaagagccttgcactttctgagcttctttgctggctgatccacctcctggtcatctgtcttggctttcttagtggcaacattgttctcaccactgccctcgccattctcggcctcagccttgagctccgcggccttttcaatgtaaggcttcttctcctcgtctgtcatggacttccacctctcccctccttcctttgcaaccttcaatcaacagaaaaaaaaaagattagcagaagaaattgggtgggatgaagcaaaagatggaatggaatggaatg

SEQ ID NO: 7331 - DNA, 493 bp, Zea mays
  misc_feature: Ceres CLONE 351641-F
  misc_feature: Encodes the peptide sequence at SEQ ID NO. 7332
aagtttgccgctctgtgagcctgctgccgtcttcttccgccgccgccgccgtcgtcgtcttcgtccgtagatcagagagcggggaggaagaaaaagcgatcgatggcgtccaactacgtggacacgccgggcgaggagggacggttccacggccctcacagccacagcaccagcacgaccccgacgggcggcgcggcggcggcggcggcatcgccgcgcaacttccggcgcagcttctcctccgcgtcctccgcgggccacagccacggcggcggcggcggcggggccaagtgcgtgtgcgcgcccgcgacccacgccgggtcgttcaagtgccggctccaccgcaccaactcccagggccacggccacggccacccgcacccgtccccgccggcctcccccgccgcgccggcgcagggcgtctcgtcttccgcttctcccgcaccgtcgaggccctgtgagtgtccgaggccaaagacgggcgaggcgtggg

SEQ ID NO: 7332 - protein, 130 aa, Zea mays
  misc_feature: Ceres CLONE 351641-F
MASNYVDTPGEEGRFHGPHSHSTSTTPTGGAAAAAASPRNFRRSFSSASSAGHSHGGGGGGAKCVCAPATHAGSFKCRLHRTNSQGHGHGHPHPSPPASPAAPAQGVSSSASPAPSRPCECPRPKTGEAW

SEQ ID NO: 7333 - DNA, 483 bp, Zea mays
  misc_feature: Ceres CLONE 351664-F
  misc_feature: Encodes the peptide sequence at SEQ ID NO. 7334
caggcagtttctacttcttcagagttcggggaggcgaggcgtggagggattgggaattttttgggaggggaggacgcgtgagcgggaggaaagtgaagagagagtagcttccgatctcgattaccccggtctccgtatcgggaatccaattcggttccatccaacgcctgagatcggattccaacccccatttcggaccgatcgctttccgcagaccgatcggctttggggaaatttttttccgagcgatttttctggaggctcagatcgggtcggtctgagtttagttgatcgcggagcgatgctaatcgaggagcttccgggcgatccgggtggaggacgaggtgagggcggggaggatgagctgctgctgccgcgtcgcgaggatggcgacgccgcggagggcgagagtggagtggtgatgcgggtggccgtcgacgcgaagcgcgcagcggtgggtgtaggcgctcggatgcttttcta

SEQ ID NO: 7334 - protein, 60 aa, Zea mays
  misc_feature: Ceres CLONE 351664-F
MLIEELPGDPGGGRGEGGEDELLLPRREDGDAAEGESGVVMRVAVDAKRAAVGVGARMLF

SEQ ID NO: 7335 - DNA, 486 bp, Zea mays
  misc_feature: Ceres CLONE 351689-F
  misc_feature: Encodes the peptide sequence at SEQ ID NO. 7336
atcgaacaccaatggcattcttgcattgaaggaaccttccctccacctccaccgcccgagagcgagcggccggacggggttttggttgggcatggctgccccggcgatgctccaagtggtgatcctcgccgcggtcctccttctcccgttcctcagcgtgccgggcgccgaggcacagaccaagaagttctgcctcacgcagttcgccatcgctagccaggcctgcgccatcctgccacccaccagtcctgagcaccaccaccatcatcacgatgacgaggacaatgacgaggacaacgacgaagatgaggacgaagacgaggacaacgatgaagatgaagacgaggacaatgggaaggttaaggccggtggcgcctacacaatgaacactgctagtgcggtcactgtgagaagcacaatccggcgcctgcgggagcagaccgaagcatgattgcgggcagcttgaaaaggagtacctggattttg

SEQ ID NO: 7336 - protein, 119 aa, Zea mays
  misc_feature: Ceres CLONE 351689-F
MAAPAMLQVVILAAVLLLPFLSVPGAEAQTKKFCLTQFAIASQACAILPPTSPEHHHHHHDDEDNDEDNDEDEDEDEDNDEDEDEDNGKVKAGGAYTMNTASAVTVRSTIRRLREQTEA

SEQ ID NO: 7337 - DNA, 435 bp, Zea mays
  misc_feature: Ceres CLONE 351706-F
  misc_feature: Encodes the peptide sequence at SEQ ID NO. 7338
gcactcaagccctgcccatcagcacaaccaccaccaccgcctggccgtcgtcacacgctcgcctccttccatggcgcccaggaacgctctccccgccgccagcgccgtggccaacggcatggtgatggagccgaggttccgcggcgtccggaagcgcccgtggggcaggttcgcggcggagatccgggacccggccaggaaggcgcgcgtgtggctcggcaccttcgacaccgccgaggccgcggcgcgcgcctacgacgccgccgcgctccacttccgcgggcccaaggccaagaccaacttccccgtcgcgtccccgcgcttccgccgccgccgcccaagaagccggccaccgtgaccgtgagccccagcagcagcagcaccgtggagtcctcctcctcctcctcccgggactcgcccgccacgccgcccagg

SEQ ID NO: 7338 - protein, 95 aa, Zea mays
  misc_feature: Ceres CLONE 351706-F
  misc_feature (21)..(72): Pfam Name: AP2 Pfam Description: AP2 domain
  misc_feature: The sequence is a functional homolog of SEQ ID NO 1419 in the 11/479,226 US patent application
  misc_feature: The sequence is a functional homolog of SEQ ID NO 668 in the 10/412,699 US patent application
  misc_feature: The sequence is a functional homolog of SEQ ID NO 2220 in the 10/374,780 US patent application
  misc_feature: The sequence is a functional homolog of SEQ ID NO 500 in the 10/225,066 US patent application
  misc_feature: The sequence is a functional homolog of SEQ ID NO 22 in the 10/903,236 US patent application
  misc_feature: The sequence is a functional homolog of SEQ ID NO 2215 in the 10/666,642 US patent application
  misc_feature: The sequence is a functional homolog of SEQ ID NO 82 in the 10/714,887 US patent application
  misc_feature: The sequence is a functional homolog of SEQ ID NO 82 in the 11/435,388 US patent application
  misc_feature: The sequence is a functional homolog of SEQ ID NO 1435 in the 11/479,226 US patent application
  misc_feature: The sequence is a functional homolog of SEQ ID NO 2504 in the 10/374,780 US patent application
  misc_feature: The sequence is a functional homolog of SEQ ID NO 618 in the 10/225,066 US patent application
  misc_feature: The sequence is a functional homolog of SEQ ID NO 674 in the 10/412,699 US patent application
  misc_feature: The sequence is a functional homolog of SEQ ID NO 1769 in the 10/374,780 US patent application
  misc_feature: The sequence is a functional homolog of SEQ ID NO 2217 in the 10/666,642 US patent application
  misc_feature: The sequence is a functional homolog of SEQ ID NO 24 in the 10/903,236 US patent application
  misc_feature: The sequence is a functional homolog of SEQ ID NO 84 in the 10/714,887 US patent application
  misc_feature: The sequence is a functional homolog of SEQ ID NO 84 in the 11/435,388 US patent application
  misc_feature: The sequence is a functional homolog of SEQ ID NO 1883 in the 10/374,780 US patent application
  misc_feature: The sequence is a functional homolog of SEQ ID NO 2224 in the 10/374,780 US patent application
  misc_feature: The sequence is a functional homolog of SEQ ID NO 502 in the 10/225,066 US patent application
  misc_feature: The sequence is a functional homolog of SEQ ID NO 24 in the 10/225,066 US patent application
  misc_feature: The sequence is a functional homolog of SEQ ID NO 36 in the 11/375,241 US patent application
  misc_feature: The sequence is a functional homolog of SEQ ID NO 440 in the 10/374,780 US patent application
  misc_feature: The sequence is a functional homolog of SEQ ID NO 1754 in the 10/374,780 US patent application
  misc_feature: The sequence is a functional homolog of SEQ ID NO 503 in the 10/374,780 US patent application
  misc_feature: The sequence is a functional homolog of SEQ ID NO 1884 in the 10/374,780 US patent application
  misc_feature: The sequence is a functional homolog of SEQ ID NO 1001 in the 10/412,699 US patent application
  misc_feature: The sequence is a functional homolog of SEQ ID NO 502 in the 10/374,780 US patent application
MAPRNALPAASAVANGMVMEPRFRGVRKRPWGRFAAEIRDPARKARVWLGTFDTAEAAARAYDAAALHFRGPKAKTNFPVASPRFRRRRPRSRPP

SEQ ID NO: 7339 - DNA, 444 bp, Zea mays
  misc_feature: Ceres CLONE 351730-F
  misc_feature: Encodes the peptide sequence at SEQ ID NO. 7340
aaatctcgttgcccgttgtgctctctctctctattcgttccccgcctcaccccgagccagccgtctcgctagggtttcgccgccgccgccgccgccgccgccgctatgcctcgccgcagctcaggaaggtctgccccacgcccagctacccgtgctgctccagtgaggaacccgccacagccagcacgccaggctcctcctccagctcctgttcgagatggtggtggctccatgtttggaggaattgggtccaccattgctcaaggtatggcgtttggcacgggtagtgccatggcacacagggctgttgatgctgtattaggtccccggaccattcagcatgagactgttgcctcagaagctgctgctgctgctacggcggtggcggcggcggtggtggtggcggctgctacaactgcggccaggccggccacatggcaggga

SEQ ID NO: 7340 - protein, 113 aa, Zea mays
  misc_feature: Ceres CLONE 351730-F
MPRRSSGRSAPRPATRAAPVRNPPQPARQAPPPAPVRDGGGSMFGGIGSTIAQGMAFGTGSAMAHRAVDAVLGPRTIQHETVASEAAAAATAVAAAVVVAAATTAARPATWQG

SEQ ID NO: 7341 - DNA, 473 bp, Zea mays
  misc_feature: Ceres CLONE 351792-F
  misc_feature: Encodes the peptide sequence at SEQ ID NO. 7342
aaaaattcgaccccatccacttctcagttctcacctcaatctcgcgagaagcgaagccggaggaggagggtgcgaggagatcgcgagcagccggagccggagccggaggcctagaagatgaagacgttcgacccgtggccggtattcttccgccgggagtggaagcgcaattggcccttcctcacggggttcgccatcaccggcttcatcatcactaagatgacggccaacttcaccgaggaggacctcaagaactccaagttcgttcaggagcacaagaagcgctgaccaaccaggtgttgtccgaattgcctgtctggacagccagttatgttatgatgtttgaatgaaaaattagcttctttttcttcatctaaatgcgtgcagcctatgctccatttgtaatgtaataagaggcatctgacttgatccaaaagctaccagcttctgattatgagtgatacttcaaagtt

SEQ ID NO: 7342 - protein, 56 aa, Zea mays; identical to SEQ ID NO: 5462
  misc_feature: Ceres CLONE 351792-F

SEQ ID NO: 7343 - DNA, 1054 bp, Zea mays
  misc_feature: Ceres CLONE 351811
  misc_feature: Encodes the peptide sequence at SEQ ID NO. 7344
aatcatcactgccatctctctctgactctgtgtccgtctctaaactctagtctgtgcgaatctgctgccagcagcgaggaacagaacagtagccaatttgccatctcacagttgcgttcctccgattccccgtcccccgatggacctgtctcccagctcgtcggcgccatccgcgccgccggtgccgtgcgagtggtccggcgccgggctcggctccgcggcgtgcggcctcgcctgcagggtgctctgcgccgtcgccacctgcgtcttcgcggccgtggggtcgctggtcggggcggtgacggggtccatggtggggctggcgaccgagagcgggatgctgcgcggcgccggcatcggggccatctccggcgccgtcttctccatcgaggtcgccgagtcgtcccgcgacctctggcactcgggcgactccggcgtctggaccctcctctacatggtggacatcatctccagtctcttgagcggcaggctggtccgggagaaggtggggccggctgttcagagcgccgtgcagagccagatcagcgccatcagctcgccgttcgaggagacgagcgacctgttcgagaccggcagcgtgaggggcctccccgaggccgcggtgcgccggctgccggtgacggtggtcgcggaggacggcgccgtggacgcggcgggccaggcgctgtgctgctcggtgtgcctgcaggacttccgggtgggcgaccgcgcgcggaggctgcccggttgccgccacctgttccacgtgccctgcatcgactgctggctcctcaggcacggctcctgcccgactgtgccggcgagacatctgaaactcggtcgtctgctctgtgaaccgccacccacgtcgccggaaacgtggtgtagtgttgctgctttggacgagatggtcagttagttgagtagggttcctactttttaggacggcaccctgatgcccgtaagggaaatggtgcgctctgacgctctgttaactaaaaaagaagaagagagaaaacagcccctcagcttcaaagcaaaaaaaaaaaaaaaa

SEQ ID NO: 7344 - protein, 259 aa, Zea mays
  misc_feature: Ceres CLONE 351811
  misc_feature: The sequence is a functional homolog of SEQ ID NO 216 in the 10/225,068 US patent application
  misc_feature: The sequence is a functional homolog of SEQ ID NO 2322 in the 10/374,780 US patent application
  misc_feature: The sequence is a functional homolog of SEQ ID NO 242 in the 10/412,699 US patent application
  misc_feature: The sequence is a functional homolog of SEQ ID NO 515 in the 11/479,226 US patent application
MDLSPSSSAPSAPPVPCEWSGAGLGSAACGLACRVLCAVATCVFAAVGSLVGAVTGSMVGLATESGMLRGAGIGAISGAVFSIEVAESSRDLWHSGDSGVWTLLYMVDIISSLLSGRLVREKVGPAVQSAVQSQISAISSPFEETSDLFETGSVRGLPEAAVRRLPVTVVAEDGAVDAAGQALCCSVCLQDFRVGDRARRLPGCRHLFHVPCIDCWLLRHGSCPTVPARHLKLGRLLCEPPPTSPETWCSVAALDEMVS

SEQ ID NO: 7345 - DNA, 423 bp, Zea mays
  misc_feature: Ceres CLONE 351897-F
  misc_feature: Encodes the peptide sequence at SEQ ID NO. 7346
  misc_feature (411)..(411): n is a, c, t, g, unknown, or other
aaaaagcgcagagcgcatcagcgcagagcaggacagccatggcgacggcggcggcgcagtcccattcgccatcaatggacgcgcgccggtgggacgagtcatcgtaccgccgcggcatcctccgtgcccgcgacctctcgtcccgcaccctcttccgtgccgtcttctttgaccacagcgacgacccggataccgacatcctactcgccgccgcctccagcgacggttccctcgcttccttctccctttcatcctgcatctccgcatgttccactacctcccaggtggagaccgccgccactctggtcgaccctgtctgcatcgtgcaagcgcacagcggacctgcctacgacgtcaggttctaccccgatcaacagcagccgctgctcttcagctgcggggacgatggcngcatcaagggtt

SEQ ID NO: 7346 - protein, 128 aa, Zea mays
  misc_feature: Ceres CLONE 351897-F
  misc_feature (125)..(125): Xaa is any aa, unknown, or other
MATAAAQSHSPSMDARRWDESSYRRGILRARDLSSRTLFRAVFFDHSDDPDTDILLAAASSDGSLASFSLSSCISACSTTSQVETAATLVDPVCIVQAHSGPAYDVRFYPDQQQPLLFSCGDDGXIKG

SEQ ID NO: 7347 - DNA, 488 bp, Zea mays
  misc_feature: Ceres CLONE 351900-F
  misc_feature: Encodes the peptide sequence at SEQ ID NO. 7348
aatcccatatcgccaagtccccttcgtcgtccccttccctcgcctcgcgttaggtagcctgcttccgacccgcacatctccctccggttctcgccatgggcgccggcgccaacaaccacgaggagtcgagccccctcatcccagctgcggttgccgcccccgcggacgagaagcccccgcaggctccggcgccggaggccgccaattactatgccgacggggtcccggtcgtgatgggcgagcccgtgtcggcccacgccttcggcggcgtcccgcgggagagctggaactccgggatcctctcctgcctcggccgcaacgacgagttctgcagcagcgacgtcgaagtgtgtcttcttggaacggtagcaccatgtgtgctctatggtagcaatgttgagaggcttgctgctggacaaggcacatttgcaaacagctgtttgccttacactgggctgtatttgcttgggaactctctctttgggtgg

SEQ ID NO: 7348 - protein, 131 aa, Zea mays
  misc_feature: Ceres CLONE 351900-F
MGAGANNHEESSPLIPAAVAAPADEKPPQAPAPEAANYYADGVPVVMGEPVSAHAFGGVPRESWNSGILSCLGRNDEFCSSDVEVCLLGTVAPCVLYGSNVERLAAGQGTFANSCLPYTGLYLLGNSLFGW

SEQ ID NO: 7349 - DNA, 370 bp, Zea mays
  misc_feature: Ceres CLONE 351984-F
  misc_feature: Encodes the peptide sequence at SEQ ID NO. 7350
acactcacacgcacacgtaaagctcgatcgctctctgtgctccctcctcctgcctcctgcacacgcatacactcagagagcatagtagcagtataggatgatgatgaacaccaacgcgatgtcgccgacagcaagtaccgacgccgacttctcgttcggccccttgcagccctacgtcggcttcgacgtcgccggcatgggcatgcccagcgtcgtcgtcgagcggtcgtcgtcgctactgcagcacaacaccagcagcagcagccacaacaacaacctagggctatacgacagtttcgacttcgcggccgccgcagggttaccgttccaagaatctggtctcctgccccctgcgagcctgccgctggcg

SEQ ID NO: 7350 - protein, 91 aa, Zea mays
  misc_feature: Ceres CLONE 351984-F
MMMNTNAMSPTASTDADFSFGPLQPYVGFDVAGMGMPSVVVERSSSLLQHNTSSSSHNNNLGLYDSFDFAAAAGLPFQESGLLPPASLPLA

SEQ ID NO: 7351 - DNA, 464 bp, Zea mays
  misc_feature: Ceres CLONE 352011-F
  misc_feature: Encodes the peptide sequence at SEQ ID NO. 7352
gcgcttttactacaccacgcttacggatgtatccgtctccccctccccacctattttatggtgtgagcgtcagccgtcagcactcaccaagatccaacagacacttcttcaatccactagactagctaagcgcgccatggcaaagttcgctcttggtcaccaccgcgaggcctccgacgccggctgcgtccgtgccgtccttgccgagttcatcctcaccttcctcttcgtcttcgccggcgttggctccgccatggcaacagggaagctggccggcggcggcggggacacggtggtgggcctgacggcggtggcgctggcgcacacgctggtggtggccgtcatggtgtcagcggggctgcacgtctccggcggccacatcaacccggccgtgacgctgggcctcgccgccacgggccgcatcacgctgttccgctccgcgctctacgtggccgcacagctgc

SEQ ID NO: 7352 - protein, 109 aa, Zea mays
  misc_feature: Ceres CLONE 352011-F
  misc_feature (11)..(109): Pfam Name: MIP Pfam Description: Major intrinsic protein
MAKFALGHHREASDAGCVRAVLAEFILTFLFVFAGVGSAMATGKLAGGGGDTVVGLTAVALAHTLVVAVMVSAGLHVSGGHINPAVTLGLAATGRITLFRSALYVAAQL

SEQ ID NO: 7353 - DNA, 497 bp, Zea mays
  misc_feature: Ceres CLONE 352026-F
  misc_feature: Encodes the peptide sequence at SEQ ID NO. 7354
acaagcagcatccgcacactcccaattcccctcgagcgccgcagcgagcccaagaagccgaccgccgagccccctctccagtccagtccgcggtctcggtttcttgcttacccggcgcccaatcttcagggagctccttctcgtcgtctgtctccatggccgcctcgaccaagaccgtcgccgtcctcctcgccgcggtgctcctcgcgctggtcgcgtccgcggcagccagcaggaagctggaggaggaggacgcactcctgggaagcctggccccagcccccgcgccggccgttggcggttccgcggggctgcctggcgccaggccgggggcgtgggccgtcgccgccctggtctctctcgtcgccttcctcgtgaactgagggtgtgggcatcgtgctgcgcagcgcgggagatgggagggacgaatcctgcgatctggatcgctgggagaggagagggggatatttatgttcgttctgttttgttctagggtg

SEQ ID NO: 7354 - protein, 75 aa, Zea mays; identical to SEQ ID NO: 6082
  misc_feature: Ceres CLONE 352026-F

SEQ ID NO: 7355 - DNA, 481 bp, Zea mays
  misc_feature: Ceres CLONE 352077-F
  misc_feature: Encodes the peptide sequence at SEQ ID NO. 7356
aaaatcaccgtaccattatggctagttcgtggatggcggcgccacgacctctcctattgccgctgctgttcgccatgctagcggtggtcgccgatgtcgccaacgccggccacgccaagcccctgacgcctggcgggcgcgtggtacacgacaaccacggcaagttcacggccgggccgtggaaacctgcccacgcgaccttctacggcgggcgggacgggtccggcaccacggcgggcgcgtgcgggtacaaggacacgcgcgagcaggggtacggcgtgcagacggtggctgtgagcacggtgttgtttggcgatggcgcggcctgcggcgggtgctacgaggtgcggtgcgtggacagccccagcgggtgcaagcccgacgcggcggcgctggtggtgacggcgaccgacctgtgcccgcccaaggacaagtggtgcaagccgccgcaggagcacttcgacctcagcatgcccgcgtt

SEQ ID NO: 7356 - protein, 149 aa, Zea mays
  misc_feature: Ceres CLONE 352077-F
  misc_feature (85)..(149): Pfam Name: DPBB_1 Pfam Description: Rare lipoprotein A (RlpA)-like double-psi beta-barrel
  misc_feature: SWISSPROT Homolog: EC 3.2.1.4 Cellulase
MAAPRPLLLPLLFAMLAVVADVANAGHAKPLTPGGRVVHDNHGKFTAGPWKPAHATFYGGRDGSGTTAGACGYKDTREQGYGVQTVAVSTVLFGDGAACGGCYEVRCVDSPSGCKPDAAALVVTATDLCPPKDKWCKPPQEHFDLSMPA

SEQ ID NO: 7357 - DNA, 494 bp, Zea mays
  misc_feature: Ceres CLONE 352078-F
  misc_feature: Encodes the peptide sequence at SEQ ID NO. 7358
aaaccctaacactcatcacgccgccactgatctgctctgttgctggtgactaggagcagtagcgagagggattctggatggccaagtcgaagaaccacacggcgcataaccagtcgttcaaggcgcacaagaacggcatcaagaagcccaagcgccaccgcagacctccaccaaggggatggacccgaagtttctgaggaacttgaggtactcaaggaagggcaacaagaagagtggcgaggctgagtccgaggagtaagatgatggtgattgagtttgtggcgacaaatgcatctcttgtatcgctaagagtcttagctgtgaacttagttctcacttctgtgtgactgtgatcaaaggacttgtgtatgatcaaaggagatccatcagttggtaccgaagtgtattttatgtcttgttggttacctggaatttaattaaaaccatcacttgtatccttttgagaattgggcaattgatgtgtcgttttctgt

SEQ ID NO: 7358 - protein, 39 aa, Zea mays
  misc_feature: Ceres CLONE 352078-F
  misc_feature (3)..(40): Pfam Name: Ribosomal_L29e Pfam Description: Ribosomal L29e protein family
MAKSKNHTAHNQSFKAHKNGIKKPKRHRRPPPRGWTRSF

SEQ ID NO: 7359 - DNA, 172 bp, Zea mays
  misc_feature: Ceres CLONE 352083-F
ctccgtgcatgcaccgttgccgatcgtcgtcctcctccccactccccatcaggccaagccacaaggtccagcaatggcgaggtctccggcttctcgcgctgctgctggctgtcgctctggatatgcggcgcggccctagtagcgcgtgccgacccgatgrcycgagaggttc

SEQ ID NO: 7360 - DNA, 482 bp, Zea mays
  misc_feature: Ceres CLONE 352124-F
aactgcataaccatttcgaggcctattttgagaagcccacggactgaagattacgtctccttgtcacggcccaaatagagcgtacaagaactcatcagaatctccccgccgccaccctctgttccggctctgtggagcgccgccccttctccgacgtggcgcctcagtatttgttagggttttctccgggattgaaggcactgctgcaggctgaaacgtttctcgcttgattggcggaagaagggattccagcgatctgtttgctgctagctgcgagagttcaatatgtctcggaccttcaaatcgacgacgggtctctctcggcggtttctgaatctgatcgcggccaaccactcccctggcgtcaagtcgctgcaccgcatcggcctgggtcgcatctttaactcaacgccagggccaataccaaacggagatcgattggagtccgcagcaggacaagaagactacatggtgcggccccg

SEQ ID NO: 7361 - DNA, 405 bp, Zea mays
  misc_feature: Ceres CLONE 352143-F
  misc_feature: Encodes the peptide sequence at SEQ ID NO. 7362
aaattttagtgcttcagccgcgcagctgggccaagagatattttccccttcagccccattcgcaaccgttgtggccgcgtcgatccccatcgcctctccccatcccctctcctgtctgaaaaccagcacgccacgtcccaccgccaaccaccgcgctccggctctccccaattctaagcgagacggggcacaggaagaggagagcctaaaaccctaaccccccgaatcggatccggccgccggagcgcggaacctcaycccggccgccatggagatgggagggatgagcgacgctgagcggctgttcttcttcgagatggcctgcaagaactccgaggtcgcgtacgagcagaaccccaacgackccgacaacctgacgcggtggggcggcgcgcygctggagct

SEQ ID NO: 7362 - protein, 45 aa, Zea mays
  misc_feature: Ceres CLONE 352143-F
  misc_feature (33)..(33): Xaa is any aa, unknown, or other
  misc_feature (43)..(43): Xaa is any aa, unknown, or other
MEMGGMSDAERLFFFEMACKNSEVAYEQNPNDXDNLTRWGGAXLE

SEQ ID NO: 7363 - DNA, 511 bp, Zea mays
  misc_feature: Ceres CLONE 352188-F
  misc_feature: Encodes the peptide sequence at SEQ ID NO. 7364
caagaccaagatagaccacccaagcattgaagccgtagccgccgccgcggacgagacaggttgaggcggggcggcaatggccgccggggaccttgaggtgctcaccgcgctcgacaccgcgaagacgcaatggtaccacttcaccgccatcgtggtcgccggcatggggttcttcaccgacgcctacgacctcttctgcatctccctcgtgactaagctcctcggccgcatctactacaccgtggaggggtccgcgacgcccggcaccctcccgccgcacgtgtccgcgtccgtcaacggcgtggccttcgtgggcacgctgtcagggcagctcttcttcggctggctgggcgacaagctcgggcgcaagaaggtctatggcatgacgctcatgctcatggtcctctgttccgtcgcgtcgggcctctcgttcggccacacccccggcgtccgtcatggcgacgctgtgcttcttccgcttctggctcgggttcggcatcggcggcgacta

SEQ ID NO: 7364 - protein, 145 aa, Zea mays
  misc_feature: Ceres CLONE 352188-F
  misc_feature: Functional homolog of the protein sequence given in SEQ ID NO 96866
  misc_feature: Useful for making plants with modulated carbohydrate content
MAAGDLEVLTALDTAKTQWYHFTAIVVAGMGFFTDAYDLFCISLVTKLLGRIYYTVEGSATPGTLPPHVSASVNGVAFVGTLSGQLFFGWLGDKLGRKKVYGMTLMLMVLCSVASGLSFGHTPGVRHGDAVLLPLLARVRHRRRL

SEQ ID NO: 7365 - DNA, 475 bp, Zea mays
  misc_feature: Ceres CLONE 352233-F
  misc_feature: Encodes the peptide sequence at SEQ ID NO. 7366
ctagcattcaaccacgccgagctcgccggaacaagcccaacccgagcccaatcccgctcgggccccagccgatccgacggctcctcaccagcacaatccggggtaccccgcggatgctagcctgatcgggtccccacggtcgatgggttcgcccgggtccgccaatggcagacgcggcgactatgtgaggatcccggaggaggcggaggtggcgtccaagggggagggagatgccgcggcggccgtcaaggcggccgcggcggcggagtgccctagggtgctgcggtgcagcgcgatccggtggtgggccaaggtcgccgtgctcgggatcrgtccttgctggggccggagctgccgcggtcgtcttcctcggcccgctccttatcaagaaggtttagaatattaggtcagatcagacgcttatatgtataataagtcaatagcacgtgcaaggagcagctgtaagattgttgta

SEQ ID NO: 7366 - protein, 87 aa, Zea mays
  misc_feature: Ceres CLONE 352233-F
  misc_feature (64)..(64): Xaa is any aa, unknown, or other
MGSPGSANGRRGDYVRIPEEAEVASKGEGDAAAAVKAAAAAECPRVLRCSAIRWWAKVAVLGIXPCWGRSCRGRLPRPAPYQEGLEY

SEQ ID NO: 7367 - DNA, 449 bp, Zea mays
  misc_feature: Ceres CLONE 352272-F
  misc_feature: Encodes the peptide sequence at SEQ ID NO. 7368
acgctctaccgcatagtatctactctcgtgccttcatttcggtgcagcctacatgttcgggcggctcaaacttgcagccacgctacccgagcgcctcctgtcctgtcacgcggcgtcctcggctcgccgctcaccccaccctctcctccggtccggccacttctcaccgcctcttgccggacgcccaaaaaaatcgaagccgaaggagccgctcccatggccgctgccctctgcccgcgcctgcgcggcttcatggcctcctctcgcccgctcctggccttgcgccccgtagcgctgcgcctacccatgcgccgcgccgtcccggccatgcccctcgccgcccgcgcacgccgcggcttaggttcctccaccgccaacgcccagctccgacgaagacttcgccacggcttctgacctccggttcgaatcgccactcgaggtagtcaaat

SEQ ID NO: 7368 - protein, 65 aa, Zea mays
  misc_feature: Ceres CLONE 352272-F
MAAALCPRLRGFMASSRPLLALRPVALRLPMRRAVPAMPLAARARRGLGSSTANAQLRRRLRHGF

SEQ ID NO: 7369 - DNA, 474 bp, Zea mays
  misc_feature: Ceres CLONE 352278-F
  misc_feature: Encodes the peptide sequence at SEQ ID NO. 7370
aaaaacatccatcgagctgcccgcgcgcggcagttaagctcacacatcagctagctcaccttggacggccgaccaggtacgttgcgagcgatggcgggatacaaagcgtcgggcggcacggcgctcggcgtcgtcctggctgttgccgcgctcctcgccgcggcggcgatggcggtggacgacgagcacatgtaccactggaagtgcttcaactcgtgcacggggaagtgccgcgacgaggacgcctttgacgacggccaccgttccggggattcgaacgtctcttccgtcgtctctggcggcaagtgcaacaacaggtgcctcagcgagtgcttcgaggacctgccggccatctgctaccaccagtgcgtcgtcagcaagtgcctctgcttcccaccctttagcaaagagaaaacgatgtgcatgaagagctgctgcaacaagtgcttccaccacggcccgccagcgcctggt

SEQ ID NO: 7370 - protein, 128 aa, Zea mays
  misc_feature: Ceres CLONE 352278-F
MAGYKASGGTALGVVLAVAALLAAAAMAVDDEHMYHWKCFNSCTGKCRDEDAFDDGHRSGDSNVSSVVSGGKCNNRCLSECFEDLPAICYHQCVVSKCLCFPPFSKEKTMCMKSCCNKCFHHGPPAPG

SEQ ID NO: 7371 - DNA, 462 bp, Zea mays
  misc_feature: Ceres CLONE 352284-F
  misc_feature: Encodes the peptide sequence at SEQ ID NO. 7372
gtctgcgactgcgagtgcgcatccttcgtccttccccttcccagccgcctctccccccctctcccggtcgcctctaacgtcgctggtgactcacgaagacctccatcgacggcggtgaaactggggccgacttctggagggtttgacttgttggatacagcgctggctcttccaatcgccgggtgctctctgccactctgtcttgcggagccctcaccgcggaaaccagttggtgcgcgtggccatggcggtggcgaaggtcaaatcggtcgccctctccgtcagtcacaagtgccggaacatcttggccgccggttgggaagcccacctcaacactgtcaaggctgacaacaagggaagcaagaatgagatttacacgtcgagggtgcactacatgatccataagggcacgccctacttgattgtccccgagaacgacatgcacaacattaacattataat

SEQ ID NO: 7372 - protein, 72 aa, Zea mays
  misc_feature: Ceres CLONE 352284-F
MAVAKVKSVALSVSHKCRNILAAGWEAHLNTVKADNKGSKNEIYTSRVHYMIHKGTPYLIVPENDMHNINII

SEQ ID NO: 7373 - DNA, 491 bp, Zea mays
  misc_feature: Ceres CLONE 352292-F
  misc_feature: Encodes the peptide sequence at SEQ ID NO. 7374
aagaaccaacgtgctcaatctccatctcgaccgtcgctcaccgggaagctacgctacgacgaagcatggcgtccgtcaccgcccgcgccccggtcgcggccctgcgcccgtcggcgtctctcaagtcgtcgtcgtcgtcggcggcggccttccttggccactctatccgcctcggccgcactgctaccgcgtcgccgacgaggcgcagcctaaaggcggaggccaagggcgagtggctcccgggccttccctcccccgcctacctcgacggcagcctgccgggtgacaatggcttcgacccgttgggcctggcggaggacccggagaacctgaggtggtacgtgcaggcggagctggtgaacgggcggtgggcgatgctgggcgtggccgggatgctgatcccggaggtgctgaccaaggccgggctgatcaacgcgcccgcagtggtacgacgccggcaagtcggagtacttcgcgtcgtcgtcgacgct

SEQ ID NO: 7374 - protein, 142 aa, Zea mays
  misc_feature: Ceres CLONE 352292-F
  misc_feature (62)..(142): Pfam Name: Chloroa_b-bind Pfam Description: Chlorophyll A-B binding protein
MASVTARAPVAALRPSASLKSSSSSAAAFLGHSIRLGRTATASPTRRSLKAEAKGEWLPGLPSPAYLDGSLPGDNGFDPLGLAEDPENLRWYVQAELVNGRWAMLGVAGMLIPEVLTKAGLINAPAVVRRRQVGVLRVVVDA

SEQ ID NO: 7375 - DNA, 467 bp, Zea mays
  misc_feature: Ceres CLONE 352350-F
  misc_feature: Encodes the peptide sequence at SEQ ID NO. 7376
aacaggatacctagccacgccctatataaatatatacagccacgttgaaccataccagcaattggcatccaagccatggcgtcgttcaagtgcacgtgcgtcttcttagtctcgcttatgctcgccctcaccgtcaataacgcccaggaagaagattcacagcggacgctcccgccgttcccctgcatcccaggccagccacgacccccgtggctcccaccctgcccgccagcgctagctgagtgctacacgtcggtgtcggggctgatgccgtgcgcggacttcctcacccacatcgggctgccaccggcaccacccacgagcgcctgctgcgacggtctcaggtcgctcgtcaccaacgcgcccatctgcatgtgccacgtcgtcaatggcgacatcaacaagctcctaccggcgcccatgatacccgtgcgcatggtggcgctccccccgcttgtgcgtcgtcc

SEQ ID NO: 7376 - protein, 130 aa, Zea mays
  misc_feature: Ceres CLONE 352350-F
MASFKCTCVFLVSLMLALTVNNAQEEDSQRTLPPFPCIPGQPRPPWLPPCPPALAECYTSVSGLMPCADFLTHIGLPPAPPTSACCDGLRSLVTNAPICMCHVVNGDINKLLPAPMIPVRMVALPPLVRR

SEQ ID NO: 7377 - DNA, 536 bp, Zea mays
  misc_feature: Ceres CLONE 352380-F
  misc_feature: Encodes the peptide sequence at SEQ ID NO. 7378
aacccataagaccatctcctgtcctctcccactccgccgccgctgcttaccgcctatctcgccaagcaccgccgcatcaccgaaggttcgcaaagatggcggtgccgctgctgacgcagaagatcgtgaagaagagggtcaagcagttcaagaggccccatcttgaccgctacaagtgccttaagccaagctggcgcaggcccaagggtatcgactcccgcgtgaggcgtaagttcaagggatgcaccttgatgcccaacattggatatggctccgacaagaagaccaggcactaccttcccaacaagttcaaaaagtttgttgttcacaatgtctccgagctggagctgctgctgatgcacaacaggacctactgcgctgagatcgcccacaacgtgtccacccgcaagcgcaaggagattgtcgagcgtgctgcgcaaatggacatcgtggtcaccaacaagcttgccaggctccgcagccaagaggacgagtgaaatgttgagtagttttgattgtgctctgctggtgttgaa

SEQ ID NO: 7378 - protein, 133 aa, Zea mays
  misc_feature: Ceres CLONE 352380-F
  misc_feature (14)..(123): Pfam Name: Ribosomal_L32e Pfam Description: Ribosomal protein L32
MAVPLLTQKIVKKRVKQFKRPHLDRYKCLKPSWRRPKGIDSRVRRKFKGCTLMPNIGYGSDKKTRHYLPNKFKKFVVHNVSELELLLMHNRTYCAEIAHNVSTRKRKEIVERAAQMDIVVTNKLARLRSQEDE

SEQ ID NO: 7379 - DNA, 438 bp, Zea mays
  misc_feature: Ceres CLONE 352381-F
  misc_feature: Encodes the peptide sequence at SEQ ID NO. 7380
aacaccgagaatcacaatacgaaacgaattaatccccaatcaacacagcaagtcagcaacaagcaaagcagcgatccgagagatggacgcgaggatgttcgggctggagaaccccctggtggcggcgctgcatcacctgctggacgtgcccgatggcgacgccggagcgggcggcgacaaggcgggcggcggcgccacgcgcacctacgtccgcgacgcgcgcgccatggcggccaccccggccgacgtcaaggagctcgcgggagcgtacgcgttcgtggtggacatgccggggctgagcacgggcgacatcagggtgcaggtggaggacgagcgggttcttgtgatcagcggcgagcggcgccgggaggagcgcgaggacgccaagtacctgcgcatggagcggcggatgggcaagttcatgcgcaagttcgtgct

SEQ ID NO: 7380 - protein, 118 aa, Zea mays
  misc_feature: Ceres CLONE 352381-F
  misc_feature (55)..(118): Pfam Name: HSP20 Pfam Description: Hsp20/alpha crystallin family
MDARMFGLENPLVAALHHLLDVPDGDAGAGGDKAGGGATRTYVRDARAMAATPADVKELAGAYAFVVDMPGLSTGDIRVQVEDERVLVISGERRREEREDAKYLRMERRMGKFMRKFV

SEQ ID NO: 7381 - DNA, 174 bp, Zea mays
  misc_feature: Ceres CLONE 352432-F
aaccatcacagtacgcacgcacgcacacaccagcccagcagcagaagcgcccctcggccctcgctcccacaacaagctcaagccagccttctctctctgctccaatggcgcgcttccagctcgcagccgtggccatggccatgctcttcgccgcggcggcggcgcwggccccga

SEQ ID NO: 7382 - DNA, 494 bp, Zea mays
  misc_feature: Ceres CLONE 352466-F
  misc_feature: Encodes the peptide sequence at SEQ ID NO. 7383
atttttttcgagcgcagaagcgagagagatccggagcagccgcagtcccaccgaccccgccgccggtcgccctccatctcctcgccgctgcctctcgtttctcttttcaataatcaagatgagccgtggtggtagtgccggtggtggtcaaagttctctgggttatctctttggaagcggtgagccccccaaaccagcagtggcaccagctgcaagtgctccacctgttgagaaaccatctgctgcaaagactgatgcggccaagcaggttgctgctggggttaccagccaaaccaataactaccacagggctgatggtcagaacactggcaacttccttacggaccgtccttcaaccaaggtccacgctgctcctggcggtggctcttccctgggctacctgttcggtggcaactgatgcccgtgctggtgcgctcaccaaagttatcctcccctgcctgctgcgtgctatgtctgaatcgtgaacaaccgtt

SEQ ID NO: 7383 - protein, 99 aa, Zea mays
  misc_feature: Ceres CLONE 352466-F
MSRGGSAGGGQSSLGYLFGSGEPPKPAVAPAASAPPVEKPSAAKTDAAKQVAAGVTSQTNNYHRADGQNTGNFLTDRPSTKVHAAPGGGSSLGYLFGGN

SEQ ID NO: 7384 - DNA, 438 bp, Zea mays
  misc_feature: Ceres CLONE 352486-F
  misc_feature: Encodes the peptide sequence at SEQ ID NO. 7385
aaaaaacgctacccgagcgcctcctgtcctgtcacgcggcgtcctcggctcgccgctcaccccaccctctcctccggtccggccacttctcaccgcctcttgccggacgcccaaaaaaatcgaagccgaaggagccgctcccatggccgctgccctctgcccgcgcctgcgcggcttcatggcctcctctcgcccgctcctggccttgcgccccgtagcgctgcgcctacccatgcgccgcgccgtcccggccatgcccctcgccgcccgcgcacgccgcggcttaggttcctccaccgccaacgcccagctcgacgaagacttcgccacggcttctgacctccggttcgaatcgccactcgaggtagtcaaataccccgatcccgtcctgcgcgcgcgcaacaaacgcatcaacacgttcggatgacaacctccgcg

SEQ ID NO: 7385 - protein, 94 aa, Zea mays
  misc_feature: Ceres CLONE 352486-F
  misc_feature: SWISSPROT Homolog: EC 3.5.1.88 Peptide deformylase
MAAALCPRLRGFMASSRPLLALRPVALRLPMRRAVPAMPLAARARRGLGSSTANAQLDEDFATASDLRFESPLEVVKYPDPVLRARNKRINTFG

SEQ ID NO: 7386 - DNA, 531 bp, Zea mays
  misc_feature: Ceres CLONE 352533-F
  misc_feature: Encodes the peptide sequence at SEQ ID NO. 7387
atctcacgccgcaacctccctcgagcccgagcaaacaagggcggacgcggagccggcggcggagcggagatggcggagaagaagcgaggcgccggcactcgcaaggatgaggtggtgacacgcgagtacaccatcaacctccacaaacgcctccacggatgcaccttcaagaagaaggcaccaaatgccatcaaggagatcaggaagttcgctcagaaggccatgggtactactgatgtccggattgacgtgaagctcaacaagcacatctggagcagcggtatccgcagtgtgccgaggcgtgtccgtgtcagaattgcccgcaaccggaacgatgaggaagacgccaaggaggaactctactccctggtcacagttgctgagatcccaccggagggtctcaaaggtttgggaactaaggttgttgaggatgaggattaagccctgtataccatgagagaaatttgagaatgttacttcagcttatggttatctactgccaatgactcatgtaatagaaggttcgagact

SEQ ID NO: 7387 - protein, 123 aa, Zea mays; identical to SEQ ID NO: 6159
  misc_feature: Ceres CLONE 352533-F
  misc_feature (11)..(105): Pfam Name: Ribosomal_L31e Pfam Description: Ribosomal protein L31e

SEQ ID NO: 7388 - DNA, 457 bp, Zea mays
  misc_feature: Ceres CLONE 352540-F
  misc_feature: Encodes the peptide sequence at SEQ ID NO. 7389
aatcttctcgcccagatccacaagtttcgtgggtagaggaggcactagatactgtgccagatcggggtctggtagtggcagttgggtgattacgacggagtgggatgggcctcctcgacaagctgtgggacgacaccgtcgcgggcccgcgcccggacaccggcctcggccgcctccgcaagcagcccgcgcgccccgccgccgttaagatcagtgatccggccggggacgctgcagcgctcgtgccgccctcgccggcttcgggtaacgaggagacgccggtgaaggtgacgcgcagcatcatgatcaagcgtcccgcggggtacccgtcttcgccgaggagcgcggcaagcacgccgccggcctctccactagggactaccccgcccatctcgccgtttgccggcgctggtggtcgcttcagaaggaaatcatcatccgacgcatatgagagggc

SEQ ID NO: 7389 - protein, 117 aa, Zea mays
  misc_feature: Ceres CLONE 352540-F
  misc_feature (7)..(117): Pfam Name: Auxin_repressed Pfam Description: Dormancy/auxin associated protein
MGLLDKLWDDTVAGPRPDTGLGRLRKQPARPAAVKISDPAGDAAALVPPSPASGNEETPVKVTRSIMIKRPAGYPSSPRSAASTPPASPLGTTPPISPFAGAGGRFRRKSSSDAYER

SEQ ID NO: 7390 - DNA, 384 bp, Zea mays
  misc_feature: Ceres CLONE 352591-F
  misc_feature: Encodes the peptide sequence at SEQ ID NO. 7391
aaaaaaaaacaacacaacgcttatattacttacaacaaaagataagcccacgaatcagtagatcgaggtcccgcccagtccagcagaagcgcacacggagatgtcccagctgagccctgctggccacatggctgcgacgctcctcctcatcctcctggcctccgcagcagcagcagcggtgtcagctgaccaacaggtctctgcctgccagaatgacatagacgcactgtggcgcagctgcaagcagttcgtccagaaggaggggcccaagatgcctccgtccgaggactgctgcaaaaccatcaaggccttagacgcgcacgcgtcctgcatctgcgactacgtcggctccccggacgccaggaataagctagacctggacaa

SEQ ID NO: 7391 - protein, 94 aa, Zea mays
  misc_feature: Ceres CLONE 352591-F
MSQLSPAGHMAATLLLILLASAAAAAVSADQQVSACQNDIDALWRSCKQFVQKEGPKMPPSEDCCKTIKALDAHASCICDYVGSPDARNKLDLD

SEQ ID NO: 7392 - DNA, 184 bp, Zea mays
  misc_feature: Ceres CLONE 352598-F
cagctaggagtgccgagtgcactctgtctctgcagtatccttcccggccgatctgcatttcagtcgttccacaccgtcgttggccggcccatagctctccccctcctggttagcgtagtgagtgcagcgacgagtgcaacggtgagagataccgagatggctgagggaaggggcagtgcaaggg

SEQ ID NO: 7393 - DNA, 471 bp, Zea mays
  misc_feature: Ceres CLONE 352608-F
  misc_feature: Encodes the peptide sequence at SEQ ID NO. 7394
acttcgcgggcacgcagagagccgcaagacgcacctcgctcgcaacttgttggactcgaaggggcaataggcagcaggcagggccccgaactgcgggaggagattcccaaggatcccgtcggcctggtagaggaagggacggggactggcgatggcggtggacggcggcggcggggtggactgggagagcctggcggaggccacctccggggcaatcggctcgctcgtcagcaccaccgtgctctacccgctcgacacctgcaagaccaagttccaggccgagctccagacgcaccagggcgcgcagaagtataggaacctttcagatgtcttttgggaagcgattcgtaaaaagcaatttttgtccctatatcaggcctgaacacgaagaacattcagtcttttgtctcctcgtttttttatttttatgggtatagctattttaaaagactctacttggagaagagtgga

SEQ ID NO: 7394 - protein, 76 aa, Zea mays
  misc_feature: Ceres CLONE 352608-F
MAVDGGGGVDWESLAEATSGAIGSLVSTTVLYPLDTCKTKFQAELQTHQGAQKYRNLSDVFWEAIRKKQFLSLYQA

SEQ ID NO: 7395 - DNA, 879 bp, Zea mays
  misc_feature: Ceres CLONE 352634-R
  misc_feature: Pfam Name: Asn_synthase Pfam Description: Asparagine synthase
  misc_feature: SWISSPROT Homolog: EC 6.3.5.4 Asparagine synthase (glutamine-hydrolyzing)
  misc_feature (794)..(794): n is a, c, t, g, unknown, or other
caaattggtgaccgggccccccctcgaggtcgacggtatcgataagcttttttttttttttttttgggtcttttcagtccataaaaattaaacagtactgcccagtgaaaacccaaacacgatgctgccaagtatgaagcacaagcatgtctccattgcttgattgatggaactaaaaacatgatcggaaggaaactgaaacaagcaatggacaacctttgctgtttcaagcattgctgggtgataaacataaggttagacagctgtggctgaagcaacgggtgtccctaggctttcgccaatagctggacgaaggcccttgtctgagacaggatcagcagaggcaggagttttccctgcagtgtcttcatacgcagcatcgtgaacacccaaagcagcacggccagaaggatcaaggttcttggaccaggatgcgtcccattcaacagctttggcagtgctgcaggccacactaggacctccaggaacagttgaccttgctgcaggcttgggaaagaatttctcgaatatcattctgtagtagtacccttcttttgttgtgggtgtgttctctgggtaaacaaagccagcattcatcatcatggaatcggagacatgttggctggcatggtccttcaatccatcgatccaactatacccaacaccatcactgaactgttccttttgcctgtagagaatgtgcttaaggaaatagggcctctcatcatcatcaaatgcattacggataacccattttctcaatccgaccgaggtcacgctttatcatcttccantccagatcaatgtccattgctacactgatgaaacttttgtccagaaaggaaacacaagctcaacaccccaggcaaaattgctttg

SEQ ID NO: 7396 - DNA, 487 bp, Zea mays
  misc_feature: Ceres CLONE 352663-F
  misc_feature: Translation starting site: 101
acaccaagaatcacacaacagcagctcaaaaaacccaacacasctcgaacagagcagagcaaagacccgggattcgccggcgcggtagcgagagcgagagatggacgggaggatgttcggtctcgagacccccctgatggtggcgctgcagcaccttctggacgtgcccgacggcgacgccggcgcgggcggcgacaaggcgagtggtgccgcggcgggcggcgggcccagcgcgcacctacgtccgcgacgcgcgcgccatggcggccaccssggccgacgtcaaggagctcccgggcgcgtacgcgtycgtggstggacatgccggggctgggcaccgggcgacatcagggtgcaggtggaggacgagcgsgtgctggtgatcagcggcgagcggcgccgggaggagcgcgagggacgccaagtacctgcgccgtggagcggcggatgggcaagttcatgcgcaagtkcgtgctgccggacaacg

SEQ ID NO: 7397 - DNA, 412 bp, Zea mays
  misc_feature: Ceres CLONE 352748-F
  misc_feature: Encodes the peptide sequence at SEQ ID NO. 7398
attcccttcgtgcttgtttgctctagggtttttgccacgccgccgccgctctgccccttccaccccaccgatataccaagatgacggcgcaggctgcggaggagctcgccgcccagatcgagcagcagaagctcgaggagcagaagaccgaggcagaagaggttgtsgtggaggaggatgacgaggatgatgaggatgacgatgatgatgacaaggatgatgatgaactggatggacaagaaggggatgggagtggcaagtcgaagcaaagcaggagtgagaagaagagccgcaaggccatgctgaagcttggcatgaagcccatcactgggtggccccgccagcaccgcgcggctccacctcgctgtctcctcgtcctccaccgcctgctcgatccgcttcccccgcggcg

SEQ ID NO: 7398 - protein, 110 aa, Zea mays
  misc_feature: Ceres CLONE 352748-F
MTAQAAEELAAQIEQQKLEEQKTEAEEVVVEEDDEDDEDDDDDDKDDDELDGQEGDGSGKSKQSRSEKKSRKAMLKLGMKPITGWPRQHRAAPPRCLLVLHRLLDPLPPR

SEQ ID NO: 7399 - DNA, 315 bp, Zea mays
  misc_feature: Ceres CLONE 352819-F
  misc_feature: Encodes the peptide sequence at SEQ ID NO. 7400
accttgttgcacataaaaattcccacgccccgcamccacccaacgacctccgcgtccgcccccaaaacccccgcaaaccctagccgccgccagcaaggaatggccgccctcctgcggctcgccgcagcccgatccgccctcccccggcgcgccctcgccccacaccggaggctcgcggcggcggcggcggcgcgatggaggagtggtggtccgactgggagcaggacggcgaggaggaggcgcgcgcctcggcgccggccgccggccttgaccccgccggcgggggccccgggggcgtgcagtgggttgtcatgg

SEQ ID NO: 7400 - protein, 40 aa, Zea mays
  misc_feature: Ceres CLONE 352819-F
MEEWWSDWEQDGEEEARASAPAAGLDPAGGGPGGVQWVVM

SEQ ID NO: 7401 - DNA, 446 bp, Zea mays
  misc_feature: Ceres CLONE 352841-F
  misc_feature: Encodes the peptide sequence at SEQ ID NO. 7402
attttcatcagcagcattacccatcgctcgccaacgtgcagactaaggaagcactgaccggccggtcatggcgaggatccacctctacgtcgtcgccgcggcctgcgccgtcgccctcgcggctcgccggcgacccggacatgctccaggacgtctgcgtggctgactacgcttccccggtcaagctgaacgggttcccgtgcaaggcgaacatctcggcggacgacttcttcttcgacgggctgaggagcccgggcaacaccaacaacccggcgggctccgcggtgacggcggccaacgtggacaagttcccgggggtgaacacgctgggcgtctccatggcgcgcatcgactacgcgccgggcggccagaacccgccgcacacgcacccgcgcgccaccgagatcatcttcgtcctcgagggcacgctcgaggtcggcttcctc

SEQ ID NO: 7402 - protein, 148 aa, Zea mays
  misc_feature: Ceres CLONE 352841-F
  misc_feature: SWISSPROT Homolog: EC 1.15.1.1 Superoxide dismutase
FHQQHYPSLANVQTKEALTGRSWRGSTSTSSPRPAPSPSRLAGDPDMLQDVCVADYASPVKLNGFPCKANISADDFFFDGLRSPGNTNNPAGSAVTAANVDKFPGVNTLGVSMARIDYAPGGQNPPHTHPRATEIIFVLEGTLEVGFL

SEQ ID NO: 7403 - DNA, 438 bp, Zea mays
  misc_feature: Ceres CLONE 352886-F
  misc_feature: Encodes the peptide sequence at SEQ ID NO. 7404
ccccatcgccgcctgctctctacctctgcactccaatcagatcatcagatagatcactggccccgtgctgattaccgcgcttcccatctgagcagccagcctcccaggctacagggagagacgcagaggagacagctgctgcctggctgagacgatggccggaggcggcgaccactcccagacgaacggaggccacgtcgaccagagggccttggaggagggcaggaaggaggagttcgctgaccagggctgcgccgccatggtcgtctccgtcccatttatccagaagatcatcgcggagatcttcggcacctacttcctgatgttcgcggggtgcggcgcggtgacgatcaacgcgagcaagaacgggcagatcacgttcccgggcgtggcgatcgtgtgggggctagcggtgatggtgatggtgtacgcgtgggg

SEQ ID NO: 7404 - protein, 94 aa, Zea mays
  misc_feature: Ceres CLONE 352886-F
MAGGGDHSQTNGGHVDQRALEEGRKEEFADQGCAAMVVSVPFIQKIIAEIFGTYFLMFAGCGAVTINASKNGQITFPGVAIVWGLAVMVMVYAW

SEQ ID NO: 7405 - DNA, 473 bp, Zea mays
  misc_feature: Ceres CLONE 352897-F
  misc_feature: Encodes the peptide sequence at SEQ ID NO. 7406
aagcccaacccaacccaacgacgcagctagcgcgcatctccgatctgcactacaccttcgtctccgaagaacgtcgatcgtactcgtacaccatgaaggcagtcgtcgcggcgacgatgcttctgctggtgctggtggccgcggcgacggtggcgagcgcagaccaccgtgatgacgacggccaccaccaccagcgccaccgcggccagagctggcaccgccacagcggcggcggccgagatggccgccggtcgacccctctggcggggctgacgcagtgcgtgacaagctgcgggtctggggtcacctcctgcatgctggactgctaccagccgctggtcgacctggaccccgtggagctgcccgtctgcctcctcaagtgcaccaacgacgccatggtctgcgccaccggctgccccgtcaccgggaacgtctagctagcttgctatagctaggcgttccgcgcggcgcgg

SEQ ID NO: 7406 - protein, 114 aa, Zea mays
  misc_feature: Ceres CLONE 352897-F
MKAVVAATMLLLVLVAAATVASADHRDDDGHHHQRHRGQSWHRHSGGGRDGRRSTPLAGLTQCVTSCGSGVTSCMLDCYQPLVDLDPVELPVCLLKCTNDAMVCATGCPVTGNV

SEQ ID NO: 7407 - DNA, 498 bp, Zea mays
  misc_feature: Ceres CLONE 352916-F
  misc_feature: Encodes the peptide sequence at SEQ ID NO. 7408
acgtcccggattccaagaacccaactcgttcaagtccagcggtgccgtccagactccagactccagactccagagagatagagcctagagcacagctagccccgccagccatggccgccgcggcgcgcgcgatcatctgcgagctggcgccgcagaaggtgtcgtcgacagcgccgaagaaacgtgacgccgggacgaaggtggtgctccagccccggctctgcacgctgcggtcgtacggcgccggcagcggcgttgtgacgcggaggattctggccggggaggaggacgggagcggggccgccgactcgggcggctcctcggcgtcaccgttcttcgcctcgctcgccaactacatcgagagctcccgcaagagccaggacttcgagaccatctccggccgcctcgccatggtggcgttcgcggcggcagtggccgtggagacgacgacgggcagctcgctgttcaagaagctggacacggtggagatcgaggagg

SEQ ID NO: 7408 - protein, 129 aa, Zea mays
  misc_feature: Ceres CLONE 352916-F
MAAAARAIICELAPQKVSSTAPKKRDAGTKVVLQPRLCTLRSYGAGSGVVTRRILAGEEDGSGAADSGGSSASPFFASLANYIESSRKSQDFETISGRLAMVAFAAAVAVETTTGSSLFKKLDTVEIEE

SEQ ID NO: 7409 - DNA, 501 bp, Zea mays
  misc_feature: Ceres CLONE 352940-F
  misc_feature: Encodes the peptide sequence at SEQ ID NO. 7410
ataaggtctctcctacgccgcggccacacagactccagtctcctctagccgtctcgcgcgcttcaccttccccaccccgccgccgccatcgcacgcccgcagccgcatccgctatgggtgcgtacaagtacgtctcggagctatggcggaggaagcagtccgatgtgatgcggttcgtgcagcgcgtgcgctgctgggagtacaggcagcagccggccatcgtccgcctcacaaggcccactcgccctgacaaggcgcgccgcctcggctacaaggccaagcagggttatgttgtttaccgtgtccgtgttaggcgtggtggcaggaagaggcctgtgcctaaaggtattgtctatggcaagccaaagcaccagggtatcacccagctcaagttccagaggaacaagaggtctgttgctgaggagagggctggacgaaagcttggtggactcagggttctcaactcctactgggtgaatgaggatagcacctacaagtact

SEQ ID NO: 7410 - protein, 129 aa, Zea mays
  misc_feature: Ceres CLONE 352940-F
  misc_feature (2)..(129): Pfam Name: Ribosomal_L15e Pfam Description: Ribosomal L15
MGAYKYVSELWRRKQSDVMRFVQRVRCWEYRQQPAIVRLTRPTRPDKARRLGYKAKQGYVVYRVRVRRGGRKRPVPKGIVYGKPKHQGITQLKFQRNKRSVAEERAGRKLGGLRVLNSYWVNEDSTYKY

SEQ ID NO: 7411 - DNA, 509 bp, Zea mays
  misc_feature: Ceres CLONE 352971-F
  misc_feature: Encodes the peptide sequence at SEQ ID NO. 7412
aaccactcgcattcgtcactcgtccctctcccctctctcccccaaggccccaacccacttgagcgagccctagagaaggcaaaagccatggcgtccttggttgttcgtgccgccggcgccgccgccgccgccgcccgtcttccctccctccgtcctcgccgcaacggcagcggggtgctctccggcttgagggtcggaacagggcactacggcgcgcggctcgcgcttgcttcgtccacagcttctcacaaagagttcaagatcgcctgccttactgtcgatgacagcagtttgggcccgggggatgaatatgagtctgacccccgcatgccaggcgaggatgagttcgaccatttctaccgtgttctcgccaagaagactgacaacctgctcagctgctacattccaatgccgcttgcactttctgaagaggagaaggccgtgcagaaggagttcaagctgatcgcgagcggatgcatcgacctcctggttggtgcgatgcgccgcac

SEQ ID NO: 7412 - protein, 140 aa, Zea mays
  misc_feature: Ceres CLONE 352971-F
MASLVVRAAGAAAAAARLPSLRPRRNGSGVLSGLRVGTGHYGARLALASSTASHKEFKIACLTVDDSSLGPGDEYESDPRMPGEDEFDHFYRVLAKKTDNLLSCYIPMPLALSEEEKAVQKEFKLIASGCIDLLVGAMRR

SEQ ID NO: 7413 - DNA, 397 bp, Zea mays
  misc_feature: Ceres CLONE 352974-F
  misc_feature: Encodes the peptide sequence at SEQ ID NO. 7414
cagtcgcctccttcctgcgccgccgccgccgccgccgcgccgctaccaccgcctcgcggccgcctgcggctccgcgtttccgcacggaagttggtgaaggtttcttgaggctgagaacatggtgctgaagacggaactttgccgcttcagcggccagaagatttatcctgggaaaggcattagatttatccgtgctgattctcaggtcttcctttttgccaactcgaaatgcaagcgctacttccacaaccgcctgaagcctgcaaagcttacctggacagcaatgtacaggaagcagcacaagaaggatatccatgctgaagcggtaaagaagaggcgccgcgccaccaagaagccatactccaggtcaattgtgggtgcttccttggaggcgggg

SEQ ID NO: 7414 - protein, 93 aa, Zea mays
  misc_feature: Ceres CLONE 352974-F
  misc_feature (3)..(73): Pfam Name: Ribosomal_L24e Pfam Description: Ribosomal protein L24e
MVLKTELCRFSGQKIYPGKGIRFIRADSQVFLFANSKCKRYFHNRLKPAKLTWTAMYRKQHKKDIHAEAVKKRRRATKKPYSRSIVGASLEAG

SEQ ID NO: 7415 - DNA, 473 bp, Zea mays
  misc_feature: Ceres CLONE 353030-F
  misc_feature: Encodes the peptide sequence at SEQ ID NO. 7416
aaatcacctcacaacaagctgccccgcagcaacgaacacgaaccttggcagaacgaagctgaagtagttcgttgtgaacccrgtatggcaaacgcgccgaggatcctggccctcggcctgctgctagcgctcctgtgcgctcccgccggcccggccgccgcgcagaactgcggctgctagcctaacttctgctgcagcaagttcggctactgcggcacgaccgacgactactgcggcgacgggtgccagtcgggcccgtgccgctcgggcggcggcggcggcggcggcggaggcggaggcagtggcggtgcgaacgtggctaacgtggtcagcgacgcgttcttcaacggcatcaagaaccaggccgggagcgggtgcgagggcaagaacttctacacccggagcgcgttcctgagcgccgtcaacaagtacccgggcttcgcccatggcgggacggaggtggagggcaagcg

SEQ ID NO: 7416 - protein, 31 aa, Zea mays
  misc_feature: Ceres CLONE 353030-F
MANAPRILALGLLLALLCAPAGPAAAQNCGC

SEQ ID NO: 7417 - DNA, 523 bp, Zea mays
  misc_feature: Ceres CLONE 353071-F
atctcttagagacgcaaggttctctgttctctcttccttttcaccattccagtcacgatttggagcgattcgttcgttcctggtattcttgtgttgatctagccagtggtgattggaagtgggagaaagtggagctgcgctcgtgagtttcttgtgccctgttgctgtgctcaagcacctgtgtggtgccgtgcatcctctctggttactatctaccgtggcctggtgcttgagtttcctactgcgcggtgttcctcttctcgggctagtgccgtggacgtctccctcggcctcagcagcgactctagtatctccgtcaacctcccgccatgcaggtccggacgtgggcggcggaattggttttctgggacagaaccttgtgttcgctgagctggtcttcccacgtagacaatctacgtgcttgatgtcggctgttcccgaggctgcatcagatgatgctgatgatgcagcgaaggccgacgcactagcggagaaggccaagtgggacgaaaccwttgaggca

SEQ ID NO: 7418 - DNA, 489 bp, Zea mays
  misc_feature: Ceres CLONE 353097-F
  misc_feature: Encodes the peptide sequence at SEQ ID NO. 7419
ccagcatctttattgtctgccgcaaagagggctgaaggagaagcgaggaaaggtgaggccgatagatagaggagctgcggcgccgccggcgagcgaagagtggaggatccgatccgaagcgagaggactgaatcctgcggccgggagggacgcgggaccacgacgagcgtcgtcgtcggtgccaagcaacggcagttgtccctgtccagagcacaggtaagatggttaacgcgatcaaggggctgttcatctcctgcgacgtacctatggcgcagttcatcgtcaacctgaacgcgtcgatgccgccgtcggagaggttcatcgtgcacatgctcgaccctaccaacatgttcgtgcagcctcacgtggcgcacatgatcaggagcaagatcggggagttcagggaccagaacagctacgagaagccgcagtagtggaggatcaaccgcgtcctaacactcctacctcgggacttgcctttcgttgcct

SEQ ID NO: 7419 - protein, 70 aa, Zea mays
  misc_feature: Ceres CLONE 353097-F
  misc_feature (1)..(70): Pfam Name: Tbf5 Pfam Description: Transcription factor TFIIH complex subunit Tfb5
MVNAIKGLFISCDVPMAQFIVNLNASMPPSERFIVHMLDPTNMFVQPHVAHMIRSKIGEFRDQNSYEKPQ

SEQ ID NO: 7420 - DNA, 520 bp, Zea mays
  misc_feature: Ceres CLONE 353115-F
  misc_feature: Encodes the peptide sequence at SEQ ID NO. 7421
accctagcgccgcaccctcccgcccaccgccgtcgccgcccaaccgcagtaaggaggaaggagcaggaagatgccggcggggcacgggctgcggtcgcggacccgcgacctgttcgcgcggcccttccgcaagaaggggtacatcccactcaccacgtacctgcgcacctacaagatcggcgactacgtcgacgtcaaggttaacggcgccgtgcacaagggcatgccgcacaagttctaccacggccgcaccgggagcgtctggaacgtcaccaagcgcgccatcggcgtcgagatcaacaagcaggttaatggccgcatcatcaggaagcggatccatgtccgcgtggagcatgtgcagccctcccgttgcacggaggagttccgcttgaggaaagccaagaatgaccagctcaaggcggatgccaaggcccgcggtgaggtgatcagcaccaagaggcagcctgtgggacccaaacctggcttcatggttgagggtgctacactccagacagtcact

SEQ ID NO: 7421 - protein, 150 aa, Zea mays
  misc_feature: Ceres CLONE 353115-F
  misc_feature (2)..(100): Pfam Name: Ribosomal_L21e Pfam Description: Ribosomal protein L21e
MPAGHGLRSRTRDLFARPFRKKGYIPLTTYLRTYKIGDYVDVKVNGAVHKGMPHKFYHGRTGSVWNVTKRAIGVEINKQVNGRIIRKRIHVRVEHVQPSRCTEEFRLRKAKNDQLKADAKARGEVISTKRQPVGPKPGFMVEGATLQTVT

SEQ ID NO: 7422 - DNA, 666 bp, Zea mays
  misc_feature: Ceres CLONE 353135-R
  misc_feature: Translation starting site: 446
  misc_feature (620)..(620): n is a, c, t, g, unknown, or other
caattgggtaccgggccccccctcgaggtcgacggtctcgataagcttttttttttttttttttagatctgtgtaatcgtttgtgtattaatatatagtactactatttagctgaaaaacatattttcccgcaaaggaagaccaattcatcataatgtttcctggtgttcaaacaaggcgatcctctggtatgtgacgaaggggtcctcgaactcccatggcttccgcgcagtaaccacgtcctccagctgccacatcggctccggccagtccatcatcggcggccaatcaagccactcgccgtcgacgctgctggtgccaccgctcgatgctgccgcggaggcggaagttggacgaggaggaggaagaagacgactcgggcgagtaaacagtgccgaagcaggccgcggcctgtgcactgaccacgtcgtcgcctggcaacacgatgtcaatgtcgtccaggaggagcgccatgggcacgtcgtcggtgcagaacgatgcatcatcgtatcctgacgtgatcgccgtgacgatctgcttctcctcccccgacgagccactggcttccttcaagaggaggaggaggagctggctgatggagtggcttgtgtgtcacaggntcgatgcccattttcttgagcttcttcttgatgtgcgtgttccagt

SEQ ID NO: 7423 - DNA, 509 bp, Zea mays
  misc_feature: Ceres CLONE 353142-F
  misc_feature: Encodes the peptide sequence at SEQ ID NO. 7424
  misc_feature (496)..(496): n is a, c, t, g, unknown, or other
gagggctttacactgaaccccagcgacccaggcgtcagcggcgtgatgcagttcctccgaggcagcggcggcgggggcgggggcggtgggttcccgggggtggcgtgggaggtgttgcggcggcacttctctaagaagcggtccgtggacgtgaggcggatcaaccccaaggtgcccaaggaggaggccgtcgccatttccggccgactcctccagatcctctccgaccatgggcccctcaccgtcggcaacacctggaaccacgccaaggatgctggcatcgctggtctgaacagcaagacgcacatgaagatcctgctgaaatggatgacggggagaaatgtcgtgaagctgacctgcgtgcacgtgggcaacgcgaagaagttcctctactccccgtccactgaaagcagcagcagcgccggcgcatcaccgtcatccacatcggcctcgcagtgacggtcagtcgccgttaagccttggtgtggttcttgangttgctttgtgga

SEQ ID NO: 7424 - protein, 137 aa, Zea mays
  misc_feature: Ceres CLONE 353142-F
MQFLRGSGGGGGGGGFPGVAWEVLRRHFSKKRSVDVRRINPKVPKEEAVAISGRLLQILSDHGPLTVGNTWNHAKDAGIAGLNSKTHMKILLKWMTGRNVVKLTCVHVGNAKKFLYSPSTESSSSAGASPSSTSASQ

SEQ ID NO: 7425 - DNA, 485 bp, Zea mays
  misc_feature: Ceres CLONE 353153-F
  misc_feature: Encodes the peptide sequence at SEQ ID NO. 7426
cccaaacacagacacacacacatccgtcaaagaaacaagtgcacacaaataaatacatcgctcactagattgccaagagcaatggcctctaggtcatccatcctgctcgtcatggtggcgctggctacgctattcgtggttggttcgtgcaccaccccgctcaccttccaggtcggcaagggctccaagcccggccacttggtcctcacccccaacgttgccaccatctctgacgtggagatcaaggagcacggtggcgacgacttctcctttacgctcaaggagggtccgactggcacttggacgcttgacaccaagaccccgctcaagtaccccctctgcatccgcttcgctgtcaagtccggtggctaccgcatcgccgacgacgtcatccccgccaatttcaaggccggcaccacctacaagaccaccctcagcatctgattagcctcttatgacgaataatatttcaagagagctcatcc

SEQ ID NO: 7426 - protein, 120 aa, Zea mays
  misc_feature: Ceres CLONE 353153-F
  misc_feature (27)..(105): Pfam Name: Pollen_allerg_1 Pfam Description: Pollen allergen
MASRSSILLVMVALATLFVVGSCTTPLTFQVGKGSKPGHLVLTPNVATISDVEIKEHGGDDFSFTLKEGPTGTWTLDTKTPLKYPLCIRFAVKSGGYRIADDVIPANFKAGTTYKTTLSI

SEQ ID NO: 7427 - DNA, 372 bp, Zea mays
  misc_feature: Ceres CLONE 353197-F
  misc_feature: Encodes the peptide sequence at SEQ ID NO. 7428
actcccacaccctccacgctcgagcgaagggaaccagcaatggcgcgtcgcgggccgtgagggacgggaacaagaatggctgccatggtgcgcgggcccgcgatggcctctgcggctgggccgggtgcgacgtcggcggctgcggcggccgcggcggcggaggagatgcggtggcggcagctagacagcggcgtgagcgcggtgtcgttcgggttcgtggccaccgccatactcgtgtccatgttcctcgccatggccatcctcgagcacttcctccgccccacgacgtcgacccacgcgccgccccggggccggggcgtcctccgccgcctccgcctcttcctcctcggccgcggtggcggcgcccccggc

SEQ ID NO: 7428 - protein, 99 aa, Zea mays
  misc_feature: Ceres CLONE 353197-F
MAAMVRGPAMASAAGPGATSAAAAAAAAEEMRWRQLDSGVSAVSFGFVATAILVSMFLAMAILEHFLRPTTSTHAPPRGRGVLRRLRLFLLGRGGGAPG

SEQ ID NO: 7429 - DNA, 446 bp, Zea mays
  misc_feature: Ceres CLONE 353204-F
  misc_feature: Encodes the peptide sequence at SEQ ID NO. 7430
accgagaatcacaatacgaaacgaattaatccccaatcaacacagcaagtcagcaacaagcaaagcagcgatccgagagatggacgcgaggatgttcgggctggagaaccccctggtggcggcgctgcatcacctgctggacgtgcccgatggcgacgccggagcgggcggcgacaaggcgggcggcggcgccacgcgcacctacgtccgcgacgcgcgcgccatggcggccaccccggccgacgtcaaggagctcgcgggagcgtacgcgttcgtggtggacatgccggggctgagcacgggcgacatcagggtgcaggtggaggacgagcgggttcttgtgatcagcggcgagcggcgccgggaggagcgcgaggacgccaagtacctgcgcatggagcggcggatgggcaagttcatgcgcaagttcgtgctgccggacaacg

SEQ ID NO: 7430 - protein, 122 aa, Zea mays
  misc_feature: Ceres CLONE 353204-F
  misc_feature (55)..(122): Pfam Name: HSP20 Pfam Description: Hsp20/alpha crystallin family
MDARMFGLENPLVAALHHLLDVPDGDAGAGGDKAGGGATRTYVRDARAMAATPADVKELAGAYAFVVDMPGLSTGDIRVQVEDERVLVISGERRREEREDAKYLRMERRMGKFMRKFVLPDN

SEQ ID NO: 7431 - DNA, 440 bp, Zea mays
  misc_feature: Ceres CLONE 353256-F
  misc_feature: SWISSPROT Homolog: EC 3.1.2.15 Ubiquitin thiolesterase
attcctcggagagggagaagccgccgccgcagcaatcacagcagcccggagaaagcccaggtccgacaagatgcagatctkkcgtgaagacgctgacagggaagaccatacaccctcgaggtcgagagcagcgacaccatcgacaatgtcaaggccaagatccaggacaaggaagggatcccgccggaccagcagcggctgatctttgccgggaagcagctggaggatggccgcacccttgcggactataacatccaaaaggagtctacgcttcacctcgtgcttaggctccgcggtggcatcattgagccctcgctgcaggcgctcgctcgcaagtwcaaccaggacaagatgatctgccgcaaatgctatgcacgaggtgaagcgtagactccttttggatgttcgcgttyaaggtgcggccatgctccagagcctac

SEQ ID NO: 7432 - DNA, 656 bp, Zea mays
  misc_feature: Ceres CLONE 353256-R
  misc_feature (372)..(372): n is a, c, t, g, unknown, or other
tcgaggtcgacggttccgataagcttttttttttttttttttcgagaaataaaaaaagaatattattatttactaggacaaataactattcttctcggaaactaacgcggcaaaaatatggtttcatccaccttgagagcaaaaggcctctttgacagttacttcggctccaagtgcatcttgctgctcaagccaagaagcaataacactgatctagcgagtcaccctaaaagctcaggtcaggcttgttaatcgatggagaagccatgcttgccatttcacccctcttgccattcagctcagcatggtttaccagtgactgcacccaagacacatctgggtcgtcttctgtatttccatgttgcacagggntgcctcaagcgcactaggttcgtcgtcgtccacaccccagtcgaccttactcttttggggaaccaatgtttgccccatgaaggcattagaatccgtgggcgatccccaaatgggacctggtgcctgttcaggggaaaaaacttgatcaacattttcccccggaagaaacagaggttccaaacccaaacgggaccttagggggaaaattttacttccctttttcccaaggggacccaagagaaattgccccccaaggggaaaaaggaaaatttgttggtgccagg

SEQ ID NO: 7433 - DNA, 725 bp, Zea mays
  misc_feature: Ceres CLONE 353266-R
  misc_feature (26)..(26): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (49)..(49): n is a, c, t, g, unknown, or other
  misc_feature (63)..(63): n is a, c, t, g, unknown, or other
gttatgtttttttttattgtttcatncaatactaaacacacatnnnntntccaattgggtacngggccccccctcgaggtcgacggtatcgataagcttttttttttttttttttacacaaatattcaatggaatataaactgaaggctacaaccgaaggctttctctcatttctcttcactgcaacaaatattcaatggaatataaactgaactcataaacttgctatagaaagagcaattcctggcgtcctggcgagagcaggggcgctggttcctggcgcggcgggtgtggggctcgggtggctgcgctgctcggcggccggttgcctggcagcggctggagaagaggaggggagagaagcgaggagagagagccgcttgggagagagaggtctctggcgtcctggcgagagcaggggcgctggttcctggcgcggcgggcgtggggctcgggtggctgcgctgctcagcggccggttgcctggcagcggctggagaacaagatgggagagaaacgaggggaaagagggagcgccgctccccaccgcgcgtcgtcgctcgcgcgctggaactggaactccgccgcacccgcgggattcgcctccgcaaactccctcaaaaaaccgcacccggtccttggggaacccggatcccgaacctcccccccttgcagggaacagggaaccttaggccaaaagttccctttcaggaggaaaacccccg

SEQ ID NO: 7434 - DNA, 533 bp, Zea mays
  misc_feature: Ceres CLONE 353302-F
  misc_feature: Encodes the peptide sequence at SEQ ID NO. 7435
aacatctcgccgtcatcacgtctctctttcaacttcgttcgcaagaagctcagaacagaagccatcaaaagcgaggctgcgagagcggagagagagagtgagggaggcgccgacgccgagtcctttcttcatcctgcatctgccgctgtttccgacaggatgtttctcacgaggacggagtacgaccgtggggtgaacaccttctctccggaggggcggctgttccaggtcgagtacgccatcgaggccatcaagttgggatccactgcgatcggtttgaagacaaaggatggtgttgtcctcgccgttgagaaacgtgtgacctcaccactgctggaaccaagcagtgtggaaaaaataatggaaattgatgagcacataggctgtgccatgagtggacttattgctgatgctagaacactagtggaacatgctcgtgttgaaactcagaatcataggttctcatacggagagcaatgactgtagaatcttcgacacaagctatctgtgacttagctctgcgttttggcgaa

SEQ ID NO: 7435 - protein, 106 aa, Zea mays
  misc_feature: Ceres CLONE 353302-F
  misc_feature: SWISSPROT Homolog: EC 3.4.25.1 Proteasome endopeptidase complex
MFLTRTEYDRGVNTFSPEGRLFQVEYAIEAIKLGSTAIGLKTKDGVVLAVEKRVTSPLLEPSSVEKIMEIDEHIGCAMSGLIADARTLVEHARVETQNHRFSYGEQ

SEQ ID NO: 7436 - DNA, 488 bp, Zea mays
  misc_feature: Ceres CLONE 353331-F
  misc_feature: Encodes the peptide sequence at SEQ ID NO. 7437
gcaccaaagccctagctcggctcacttgctggccgccttctcctccgcggctcttaacgccgcatccactcgccggttcttaacgccgcccgccgtctcctccgcgtctcttccctcccgccgctgccgccgcccacccaggaatcaggatgcgggtgaagaagcggtcgaaacaccgcaaagcggtcaagttctacgccacatgcttcggcttccgcgagccctataaggtcctcatcgacggcaccttcgtccaccacctcctcacccagcgcctcctcccggccgacgaggctctccgagacctcctctcggcctccaggacgccagccctcttcacctccaagtgcatcctcgcagagctcaggcgtctcggcaagtcacatgccgaatcatttgacgccgcgcagcttctcaccacaaccaagtgtgagcatgacaaggtggtcagtgcagttaactgtgtccaatcactgataggtgataaa

SEQ ID NO: 7437 - protein, 113 aa, Zea mays
  misc_feature: Ceres CLONE 353331-F
MRVKKRSKHRKAVKFYATCFGFREPYKVLIDGTFVHHLLTQRLLPADEALRDLLSASRTPALFTSKCILAELRRLGKSHAESFDAAQLLTTTKCEHDKVVSAVNCVQSLIGDK

SEQ ID NO: 7438 - DNA, 224 bp, Zea mays
  misc_feature: Ceres CLONE 353399-F
acgcaacctcccactgcattctcgaattacgattcccaatccagcaaaccctaccagccttttgcaaactcagagagggacccgatggcacccaaggcggagwwgaatgccggcggcgawtgawgcccgcagatggaggagcccgcggcyccggcggataatggcccccgctgggaagaagccgaaggcggagaagcggctcccggcgggaaaatccgccggca

SEQ ID NO: 7439 - DNA, 341 bp, Zea mays
  misc_feature: Ceres CLONE 353411-F
atcagtcatcacccaccgcctccgccgccgacaacagcgtagtgtagtgtagttccggagagggttggggagagtagcagctcaccgtgcagctgaagaagctcgctgccgccggcaagctgacgagggtgaagaactccttcaagctgccggccaccgacgccaagcccaaggccgccaagcccaaggcacccaaggccgcgcccaagcccaagccctcgccgaaggcgaaggccaagaccgctgcgaagcccaaggcggcgtcgcccaagcccaaggccaaggccaaggccaaggccaagcctgtcgctcctgccgccgcgtcgcccaagccccgcggg

SEQ ID NO: 7440 - DNA, 428 bp, Zea mays
  misc_feature: Ceres CLONE 353414-F
  misc_feature: Encodes the peptide sequence at SEQ ID NO. 7441
gttcaatctcgttgcccgttgtgctctctctctctattcgttccccgcctcaccccgagccagccgtctcgctagggtttcgccgccgccgccgccgccgcgcgctatgcctcgccgcagctcaggaaggtctgccccacgcccagctacccgtgctgctccagtgaggaacccgccacagccagcacgccaggctcctcctccagctcctgttcgagatggtggtggctccatgtttggaggaattgggtccaccattgctcaaggtatggcgttcgtgctctacgacacccgcgacaggacctacgtggcggcgcgcgacgccatcggcgtcaacccgctttacatcggctggggcagtgacggttccgtctggatcgcgtccgagatgaaggcgctgaacgaggactgcgtgcgcttcgagatct

SEQ ID NO: 7441 - protein, 107 aa, Zea mays
  misc_feature: Ceres CLONE 353414-F
  misc_feature: SWISSPROT Homolog: EC 6.3.5.4 Asparagine synthase (glutamine-hydrolyzing)
MPRRSSGRSAPRPATRAAPVRNPPQPARQAPPPAPVRDGGGSMFGGIGSTIAQGMAFVLYDTRDRTYVAARDAIGVNPLYIGWGSDGSVWIASEMKALNEDCVRFEI

SEQ ID NO: 7442 - DNA, 475 bp, Zea mays
  misc_feature: Ceres CLONE 353431-F
  misc_feature: Encodes the peptide sequence at SEQ ID NO. 7443
ttcaacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggcctgccgacgatgaatcagcgtctggacatctcgaacgcggcggtgacgcagatggcgacggaggcgtccctgtcgtgcgtccgctcgtggggcggcgcgctctcg

SEQ ID NO: 7443 - protein, 129 aa, Zea mays
  misc_feature: Ceres CLONE 353431-F
  misc_feature (10)..(129): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MVSSSMDTTSDKRASSMLAPNPGKATILALGHAFPQQLVMQDYVVDGFMKNTNCDDPELKEKLTRLCKTTTVRTRYVVMSDEILKNYPELAQEGPADDESASGHLERGGDADGDGGVPVVRPLVGRRAL

SEQ ID NO: 7444 - DNA, 288 bp, Zea mays
  misc_feature: Ceres CLONE 353441-F
  misc_feature: Encodes the peptide sequence at SEQ ID NO. 7445
ctttcctagggtttcgtcgcttccagcgccgccgcgcgtccgcctcgcccagcgcagcagccgccgcagcacatcgctatctcgatctcagccatggcggaggtggagcagcaacaggacacgccgaagctgttcaaccgctggaccttcgatgatgtccaggtgaacgacatctcgctgaacgactacctcgctgtgaacgcgacgaagcacgcgatgtacctgccgcacaccgcggggcgttactccaagaagcggttccgcaaggcgcagtgcccgatcgtcgag

SEQ ID NO: 7445 - protein, 65 aa, Zea mays
  misc_feature: Ceres CLONE 353441-F
MAEVEQQQDTPKLFNRWTFDDVQVNDISLNDYLAVNATKHAMYLPHTAGRYSKKRFRKAQCPIVE

SEQ ID NO: 7446 - DNA, 355 bp, Zea mays
  misc_feature: Ceres CLONE 353480-F
aaccaagctcgatccatctcactctccgctggtcgctcactcttgcagctccacccttcactcagtcttagtctcttattagctctaggctctagctagccgcgccactccttcgtgtagccatcagccttctcatcgccaccaatggccactgccgaggtccagaccccgaccgtcgtggcggccgagtaagcgcccgtggtggagaccccgccgccggccgtcgtgcccgaggagtctgcccccgccgaggccgaggccgaggccgaggctgctgctcctgctgatcccgaggagcttcccgcggccgagcagcaggcagccgccgaggcggaggccgcggctcctgctggtg

SEQ ID NO: 7447 - DNA, 423 bp, Zea mays
  misc_feature: Ceres CLONE 353489-F
  misc_feature: Encodes the peptide sequence at SEQ ID NO. 7448
aatggcattcttgcatttaaggaaccttccctccacctccaccgcccgagagcgagcggccggacggggttttggttgggcatggctgccccggcgatgctccaagtggtgatcctcgccgcggtcctccttctcccgttcctcagcgtgccgggcgccgaggcacagaccaagaagttctgcctcacgcagttcgccatcgctagccaggcctgcgccatcctgccacccaccagtcctgagcaccaccaccatcatcacgatgacgaggacaatgacgaggacaacgacgaagatgaggacgaagacgaggacaacgatgaagatgaagacgaggacaatgacgacgatagcggcggtgggtgctttctatgccgtgcctatttggctatttcggacgtgttggttcactgaatggaaaat

SEQ ID NO: 7448 - protein, 110 aa, Zea mays
  misc_feature: Ceres CLONE 353489-F
MAAPAMLQVVILAAVLLLPFLSVPGAEAQTKKFCLTQFAIASQACAILPPTSPEHHHHHHDDEDNDEDNDEDEDEDEDNDEDEDEDNDDDSGGGCFLCRAYLAISDVLVH

SEQ ID NO: 7449 - DNA, 490 bp, Zea mays
  misc_feature: Ceres CLONE 353522-F
  misc_feature: Encodes the peptide sequence at SEQ ID NO. 7450
acagattcaggaaaaaaaacatacatctttgatgagggataagtgtgtgagagaggaggtgggcggccaccaccacctcctccacgtatcagccgccggagcgcaggcgacgatgacgacggttccgtcgcttttgtgcagaggagatgaccgagccggcacctgcggcagcagcgggggagaagaaggccgtcgcggacacggctgcggctgtggtggcgaagggaaaagagaaggcggaggcagcgccaactctggcggccggcgccagggggaggttcgtggcctacccggcccgggtgacggagcacgcggacgtggtggcggacgccgcgcgcttcagggcggcgctcgaggggctgcacgcgcacatgaacacgaggctcaaggtgccaattattggagggaaagatttggatcttcatcagctatataaggaggtcacatcacggggtggtattgacaagttgaaggcagagaatagatggag

SEQ ID NO: 7450 - protein, 114 aa, Zea mays
  misc_feature: Ceres CLONE 353522-F
MTEPAPAAAAGEKKAVADTAAAVVAKGKEKAEAAPTLAAGARGRFVAYPARVTEHADVVADAARFRAALEGLHAHMNTRLKVPIIGGKDLDLHQLYKEVTSRGGIDKLKAENRW

SEQ ID NO: 7451 - DNA, 311 bp, Zea mays
  misc_feature: Ceres CLONE 353595-F
  misc_feature: Encodes the peptide sequence at SEQ ID NO. 7452
aacttccgtccgttcccccgaactctctctcctcctcgcggccacctcccatccccgttcttcccctccatctcatcaccgccgccagcgccaaaaccctacccacccaccgatggcctccccggcgccgggcctcccccgcggccgcggcggcgcactgccccccgccgcgcatcggggctcgcggggcctcgccaccatgggccagaacctggccctgaacatcgccgagaaagggttcccgatctccgtctacaaccgcaccgccgccaaggtggactccacgctgtcccgcgcgcgggacgagggct

SEQ ID NO: 7452 - protein, 66 aa, Zea mays
  misc_feature: Ceres CLONE 353595-F
  misc_feature: SWISSPROT Homolog: EC 1.1.1.44 Phosphogluconate dehydrogenase (decarboxylating)
MASPAPGLPRGRGGALPPAAHRGSRGLATMGQNLALNIAEKGFPISVYNRTAAKVDSTLSRARDEG

SEQ ID NO: 7453 - DNA, 538 bp, Zea mays
  misc_feature: Ceres CLONE 353670-F
  misc_feature: Encodes the peptide sequence at SEQ ID NO. 7454
acaaaccctaacactccaccgacgcccagatctgttccttctctcttccacgccgccgccgccgcgccgccctcgaattttcgaatcctcagcaacaatcggccggccgccatgagggagatcctccacatccagggcggccagtgtggcaaccagatcggtgccaagttctgggaagtggtgtgcgcggagcacggcatcgacgccaccggccgctacggcggcgactccgacctgcagctcgagcgcgtcaacgtctactacaacgaggcctcgtgcggccgcttcgtgccccgcgccgtgctcatggacctagagcccggcaccatggactccgtgcgctccggtccctacggccacatcttccgccccgacaacttcgtcttcggccagtccggggccgggaacaactgggccaagggccactacaccgagggagccgagctcatcgactccgtgctcgacgtggtgcgcaaggaggccgagaactgcgactgcctgcaaggcttccaggtctgcccactctctcggcggcggc

SEQ ID NO: 7454 - protein, 142 aa, Zea mays
  misc_feature: Ceres CLONE 353670-F
  misc_feature (45)..(142): Pfam Name: Tubulin Pfam Description: Tubulin/FtsZ family, GTPase domain
MREILHIQGGQCGNQIGAKFWEVVCAEHGIDATGRYGGDSDLQLERVNVYYNEASCGRFVPRAVLMDLEPGTMDSVRSGPYGHIFRPDNFVFGQSGAGNNWAKGHYTEGAELIDSVLDVVRKEAENCDCLQGFQVCPLSRRR

SEQ ID NO: 7455 - DNA, 447 bp, Zea mays
  misc_feature: Ceres CLONE 353705-F
  misc_feature: Encodes the peptide sequence at SEQ ID NO. 7456
acaggagcgagggggaaagtgggatggtagtgggggcatcatcggtgtccggcgccgcggcttccggaggtacctctggtacggctccgccgcggaaggggaagtcgtgcaagggctgcctttactactcgtcagtgctcaagtcccgcggctacaacccaatctgcgttgggatcccccgttccatcccccaagttcctaactacgtggtggatgagcctaaggaggacgcgacagcgcaggggcatgatctcaggcggttcaggtacgggtgcgcgggttactccatattcgtgaacagggacggccaaggtggtgagggcgagggcaagacgttgttgccgtattgcaggggcctcgagttattggtggacagcagattggtcgagagaaaaccatccgcagctgaacaagctccagcacatgttacaaaggatgcagcagcta

SEQ ID NO: 7456 - protein, 148 aa, Zea mays
  misc_feature: Ceres CLONE 353705-F
RSEGESGMVVGASSVSGAAASGGTSGTAPPRKGKSCKGCLYYSSVLKSRGYNPICVGIPRSIPQVPNYVVDEPKEDATAQGHDLRRFRYGCAGYSIFVNRDGQGGEGEGKTLLPYCRGLELLVDSRLVERKPSAAEQAPAHVTKDAAA

SEQ ID NO: 7457 - DNA, 484 bp, Zea mays
  misc_feature: Ceres CLONE 353764-F
  misc_feature: Encodes the peptide sequence at SEQ ID NO. 7458
ggaaaccccaaaccccaacgcggccgctgtgacgctgtccctggagatggcggcgtactgcatgggtgaagcgcaacgccgcatcggcgactacctctctcgggtgaccaacgccatctcctgctccgacgccgccgcgctcgcctcccttctttccgtctcctccgcgccggcctccaccccgctctccgacgcgctcgccgccatcccggacttcccgcgcctcgctggagatcgctaccccgaccttgccgacctcctcgttccgttgctccgagccatccacttccactccatccagcgcttcgccgacgcctactcctcgttcgagaaggcctccaacgcgttcctgcaggagtttaggaactgggagacgccgtgggcgatggaggcgatgcacactgtggcgctcgagatcaggctaatcgccgagaaggcagatagggagcttgcgacgaatggaagtacctgacaagcttcaggc

SEQ ID NO: 7458 - protein, 141 aa, Zea mays
  misc_feature: Ceres CLONE 353764-F
MAAYCMGEAQRRIGDYLSRVTNAISCSDAAALASLLSVSSAPASTPLSDALAAIPDFPRLAGDRYPDLADLLVPLLRAIHFHSIQRFADAYSSFEKASNAFLQEFRNWETPWAMEAMHTVALEIRLIAEKADRELATNGST

SEQ ID NO: 7459 - DNA, 474 bp, Zea mays
  misc_feature: Ceres CLONE 353776-F
  misc_feature: Encodes the peptide sequence at SEQ ID NO. 7460
aataattggcggccccggcttggccctcatcaaaccctcacagcgaaggacacaaaaacacaggtagggttaggcgacgcggcggcgagagcgcgagagtaggaggaggcgtcggccatgacggggaaggcgaagccgaagaagcacacggcgaaggagatcgccgcgaagatcgacgcggcgacgacgaaccggggcggcggcaaggtcgggcaggcggatcggctagggcaggacaagggcgggcacgcgaagctggcgtgcccgctctgccgcaccccggcgcccgacatcaagtccatgcagatccaccacgaggcgcgccatcccaagctccctttcgagccggagaagctcgtcaacctgcactcctccacccccgccgccgcgaggccaccacctccaagcccaagcccggggtccgcggcagctcaagaagtagctggctggcttgcctgcctgactgcctggggt

SEQ ID NO: 7460 - protein, 119 aa, Zea mays
  misc_feature: Ceres CLONE 353776-F
MTGKAKPKKHTAKEIAAKIDAATTNRGGGKVGQADRLGQDKGGHAKLACPLCRTPAPDIKSMQIHHEARHPKLPFEPEKLVNLHSSTPAAARPPPPSPSPGSAAAQEVAGWLACLTAWG

SEQ ID NO: 7461 - DNA, 342 bp, Zea mays
  misc_feature: Ceres CLONE 353779-F
  misc_feature: Encodes the peptide sequence at SEQ ID NO. 7462
gaaaaaacgagtctgcggcccgcagtgcgagtacaagtgagcggccagcagtgcgaggacaggcatggcggctgccggcggacgcgcggttgcggtggcagccatggtggcggtggcggcggcgctgcctctgctcgcgtgtggcggttacgcggagtgctacgactactgcttcaaggactgcatctccaaggacaagtccatgagagactactgcagctacgcctgcgacaagacctgcgcgcccgacgcccggcggcggcgccccgcggtcgtccccatgaactgccagctcgcctgcgtcagggagtcctgccaccgtcgccgcgcggctgatggcga

SEQ ID NO: 7462 - protein, 92 aa, Zea mays
  misc_feature: Ceres CLONE 353779-F
MAAAGGRAVAVAAMVAVAAALPLLACGGYAECYDYCFKDCISKDKSMRDYCSYACDKTCAPDARRRRPAVVPMNCQLACVRESCHRRRAADG

SEQ ID NO: 7463 - DNA, 1284 bp, Zea mays
  misc_feature: Ceres CLONE 353780
  misc_feature: Encodes the peptide sequence at SEQ ID NO. 7464
gacacatccccttggtgctacggccaccccgcgcgctgtacctggtcttggcttgccgtgtttatttttatatatatatgtaggcaccccccagctgccgctcaaagcgacaggtggagatcggagggaggaagaagaactgagctgcggatcgagggaagggaacaagcaagcagccagagccaggtcgtgggggagccggcggcagtgatcttcttgcgtcgaaggcgaggccggagcgtcggtttgagcgctcgtgcgatatgggggagcaggagaacaacaagatcggcggcagcggcaacgacaacgccatggcggtggacgaagcgggcgcgggcgcggccgcgaacaaggggaagagcctcggcgccgcggacccgcgcctgcaggccatttccgacgccatccgcgtcgtcccccacttccccaagccagggatcatgttcaacgacatcacggagctgctgctgcggccgggcgtgttcagggacgccgtggacatgttcgtcgagcgctaccgcggcatgagcatcgcggccgtcgcaggcattgaagctagaggattcatctttgggccagccattgcgctagccataggagcaaagttcataccactacgtaaacctaagaagcttccaggtgaggtattttctgaaagttatgtacttgagtatgggatggattgtttggagatgcatgttggagctattgaacccggggagcgcgtagtggttgtcgatgatttggttgcaactggtggaactctttctgctgcaataagacttctcgagcgcgcaggagctaacgtggttgagtgtgcatgcctcattgggcttcccaagtttaaggatttctataagctcaacgggaaaccggtttacatcctggtggagtcccgcaaataggacgcagtaaatggtcagacaaaaaagctttctagcttcccgtccaaagaagctcacaacttcactcatttgcacgcgcaagcaaggtggtatgggggcaccgagaaactccgcagtaatctgtgttgaggccacggccagatgatgctatgtatcttcatggagagggtgatggactgggtgaaacgtagtcactgtacctttgtagcacgtcatgtctagtgtttcttagtagccatggctgaagagagtttgtagctattcccggcttcctgcagccaggaacatcagtgttaggcagagaaggaaaaggatcttatgttgctgctcagttttctatccgaatcgtcttccttttttaaaaaaaaaaaaaaaa

SEQ ID NO: 7464 - protein, 214 aa, Zea mays
  misc_feature: Ceres CLONE 353780
  misc_feature (64)..(198): Pfam Name: Pribosyltran Pfam Description: Phosphoribosyl transferase domain
  misc_feature: SWISSPROT Homolog: EC 2.4.2.7 Adenine phosphoribosyltransferase
MGEQENNKIGGSGNDNAMAVDEAGAGAAANKGKSLGAADPRLQAISDAIRVVPHFPKPGIMFNDITELLLRPGVFRDAVDMFVERYRGMSIAAVAGIEARGFIFGPAIALAIGAKFIPLRKPKKLPGEVFSESYVLEYGMDCLEMHVGAIEPGERVVVVDDLVATGGTLSAAIRLLERAGANVVECACLIGLPKFKDFYKLNGKPVYILVESRK

SEQ ID NO: 7465 - DNA, 421 bp, Zea mays
  misc_feature: Ceres CLONE 353803-F
  misc_feature: Encodes the peptide sequence at SEQ ID NO. 7466
aggacagagacgccgaggctaggcagtccatctgttggggtggccagtggggatctcgccggccgggaggtctggggggcgggggctgccaaacttcgccatattggtgaatcactgaatccgcccctgccagcaaccgttctgacgtggcggggtggggcaggatccaaatggcggcggcaatagaggaactgcggctcctgggatccatccctgtactggaaggtccgggagaggtcgacggcgtggtgggtgaggaagggcgaccgcgaggcggcggcgacgacgaggagatcctgcgattcatggactcggtggacagctacctgctcctcatggactccctatcctcacacagcaagccagcagagcagaaagcagccgcagccccagcccccacaagacgaggcaacaatggcgc

SEQ ID NO: 7466 - protein, 83 aa, Zea mays
  misc_feature: Ceres CLONE 353803-F
MAAAIEELRLLGSIPVLEGPGEVDGVVGEEGRPRGGGDDEEILRFMDSVDSYLLLMDSLSSHSKPAEQKAAAAPAPTRRGNNG

SEQ ID NO: 7467 - DNA, 182 bp, Zea mays
  misc_feature: Ceres CLONE 353826-F
  misc_feature: Encodes the peptide sequence at SEQ ID NO. 7468
gtgttcgcgtggaactggtacagaacacttcgcttcctggaaggctggaacagaaagaaccctaaaccctagcaatggcggcggcgaacctgctgtcgcgctcccttctccccaccccaaacactatccgaacgagccaccccaccccgcggagcccagccgtcgtctccttcccccgccgc

SEQ ID NO: 7468 - protein, 36 aa, Zea mays
  misc_feature: Ceres CLONE 353826-F
MAAANLLSRSLLPTPNTIRTSHPTPRSPAVVSFPRR

SEQ ID NO: 7469 - DNA, 255 bp, Zea mays
  misc_feature: Ceres CLONE 353858-F
aaccgaaacgaacagcacaggccaccacgccttcccttcgcctcgtggctcggcgttccgtcccgtcccgtccatcctatactgcccccaaatccgscttgccccgcaaaccaagagctccagttcctcttcctcacgcctctctgccaatccctcctccggccctctctccaggctccagcgccttctccggcgacrccggsacygcccctagacgcggcccgaatctagggttcccctttcccgccgttggcg

SEQ ID NO: 7470 - DNA, 493 bp, Zea mays
  misc_feature: Ceres CLONE 353885-F
  misc_feature: Encodes the peptide sequence at SEQ ID NO. 7471
acactcctggggacgccgtacgtagccaacagagattccccccgcacgtacaccatgtggctagtgtcctccctccgtgccgctctgtgcctgttgctcgccgtcctcgccagccaccgccagcctgcggcggccgtcgtcacgctgtcgacgtcgtcgcggtggatcgtggacccggccgggcaccgggtgaagctggcctgcgtcaactggccgtcgcacctggagtccgtggtgaccgaggggctcggcaggcagcccgtgggcgccatctccgggatgatcgtctccatggggttcaactgcgtccgcctcacgtaccccatcgcgctggtgaccaacgcctctctgtcggtgctcaccgtgcgccagtccctcctggccaacggcctcgccgagacggtcggcggcgtcgaggtcaacaaccccagcttcctktgacctcacgctcatcgagtcgctcaaggctgtggtgaacgccctggggagaaga

SEQ ID NO: 7471 - protein, 128 aa, Zea mays
  misc_feature: Ceres CLONE 353885-F
MWLVSSLRAALCLLLAVLASHRQPAAAVVTLSTSSRWIVDPAGHRVKLACVNWPSHLESVVTEGLGRQPVGAISGMIVSMGFNCVRLTYPIALVTNASLSVLTVRQSLLANGLAETVGGVEVNNPSFL

SEQ ID NO: 7472 - DNA, 452 bp, Zea mays
  misc_feature: Ceres CLONE 354015-F
  misc_feature: Encodes the peptide sequence at SEQ ID NO. 7473
attttttttttgctttgcttcctcttctctccctcctccgcgcccgcctcctctcccctaacgcttagggttagccaggcagcgacctccctcgcgaatcctccatagccgccatggccacggcggttctcagatcccacgatgcgctcaacaaccgcctgcatctcgacgcgtacaccccgtccccggcgaagccgcgccggcgccgtagccccaagccggcggccgcgtcttcgccgcccgcaagggccgcggcgcccatagcctcgacgtcgccgccgaagcctgctgcggtgcagaagacggcgacgcccgttaagggtcctgcagcgtctggacgccgttcgccgccggccaggccggctgcttcggcgcggaagcagctgtcccccgttaaggagaatcccaagcggcggcttgtcatggaggaggtccggatcttgaagcgcggc

SEQ ID NO: 7473 - protein, 113 aa, Zea mays
  misc_feature: Ceres CLONE 354015-F
MATAVLRSHDALNNRLHLDAYTPSPAKPRRRRSPKPAAASSPPARAAAPIASTSPPKPAAVQKTATPVKGPAASGRRSPPARPAASARKQLSPVKENPKRRLVMEEVRILKRG

SEQ ID NO: 7474 - DNA, 664 bp, Zea mays
  misc_feature: Ceres CLONE 354043-R
  misc_feature (1)..(1): n is a, c, t, g, unknown, or other
ncgattgggtaccgggccccccctcgaggtcgacggtatcgatattttttttttttttttttactaacaccaatcgtaactcctctttggattgcatcaaggatcacaccacattcgtcttaataatctagtagtaatcatcatatcctatatgtttagggatagaaaacttattaaaccacatcgctaattaaccatgttcatattctggacatctcctgctgctggtggaggttgccctggtattttgggtccctgcggacgatgcgcttccagtaccagtgcctgtcaaagagcatccatatctcctcgatgggcacctgcttggtctccggcagcaggaggatgacgaagatggacatgacgacgatgagcgcggcgaagagcacgaagacgccccaccggaggtggcacagcgcggcgaggaagcactgcgctacggcagccgtccagaagaggttgacgcacaccaccacgctctgccccgccgaccgcatctccagcgggaacagctcgctcggcaccagccatccgaggggcccccaggaccatccgtaggccaccacgaagaggcagatggccaccaccagcaccgtgctcacgcccttgctcagctcctcgccttttccgaacttgagggcaaggatcacagccaccacgacca

SEQ ID NO: 7475 - DNA, 327 bp, Zea mays
  misc_feature: Ceres CLONE 354055-F
  misc_feature: Translation starting site: 130
aaaaaaagggagaatgctgcaactccgcgggtgacacgggcggcgactccgccaccaccacaacacccgccgcttcctccttcctccagcctcgccgtcgccagagcagacagccgggagtccgtgcagatgcgaggatggcggcagcggggccatggccgcgggacctcgcccccgcktcccctgcttggcttggccgccgcgcttggaaccagatccggtggcgcgcgtgctccgtgggatgtgggccacgccagckttggagctgcctctattcgtggggcgtggtgcgacatggakttggccgctgccggtggcccaggtcgg

SEQ ID NO: 7476 - DNA, 484 bp, Zea mays
  misc_feature: Ceres CLONE 354113-F
  misc_feature: Encodes the peptide sequence at SEQ ID NO. 7477
cgttttatagggggtgtggagtgaatgcacatgcggtacaagcagagttgatcgggattcctcgtctctggtctgtctgtgctccacctgctgctgctgccatggccatgggtagtctcgccttcgccacggcgctcgtcttcgtcttcgccatcgccgtgccggccgtcgcggccgccgcgcaggcccccgccccggcgcccaccagcgacgggacgtcgattgaccagggcatcgcgtacctgctgatgatcatggcgctggtgctcacctacctcatccaccctctggacgcctccgccccgtacaagctcttctgagcgagcagattttttctcctccattttttggtaggctttagtggtggtggtgtgggtgtgggtgagattcggtccctattcattgccatgaattacattcggtttcgcgcgcgtgtgtatattattactcctatatgtcttcaggttcatgctttgatgtccaa

SEQ ID NO: 7477 - protein, 72 aa, Zea mays
  misc_feature: Ceres CLONE 354113-F
  misc_feature (7)..(61): Pfam Name: DUF1070 Pfam Description: Protein of unknown function (DUF1070)
MAMGSLAFATALVFVFAIAVPAVAAAAQAPAPAPTSDGTSIDQGIAYLLMIMALVLTYLIHPLDASAPYKLF

SEQ ID NO: 7478 - DNA, 429 bp, Zea mays
  misc_feature: Ceres CLONE 354116-F
  misc_feature (293)..(293): n is a, c, t, g, unknown, or other
aaacgcaactgaaaaacctcgtctacattcgcatctaggcgcccctccacctcgttccgatccagctcgccggcgcccggcggccatgtcgcagcccacggcggcggtggccgcggaggcgcagccgcagggtcgcggcctcgcggggcgctagggcggcggtggcggccttgggcagagcatctctggcatcgtgcggatggcggtgttctggtabtcgcggccaagttcttcgggcccaagcgcccgcccgcggaccccgggattctcatgtccaacctcttccagaaggncgagccaatggatatgtggatgtatttatcagagagtgacaagttcaacgattttgctaatgaggacgcacttatttggcatgaggcaaacataccatatgcagtatggggaccttaccagtwctagaacacggtc

SEQ ID NO: 7479 - DNA, 773 bp, Zea mays
  misc_feature: Ceres CLONE 354135-R
  misc_feature (12)..(12): n is a, c, t, g, unknown, or other
  misc_feature (14)..(14): n is a, c, t, g, unknown, or other
  misc_feature (15)..(15): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (60)..(60): n is a, c, t, g, unknown, or other
  misc_feature (416)..(416): n is a, c, t, g, unknown, or other
  misc_feature (417)..(417): n is a, c, t, g, unknown, or other
  misc_feature (514)..(514): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (530)..(530): n is a, c, t, g, unknown, or other
  misc_feature (561)..(561): n is a, c, t, g, unknown, or other
  misc_feature (569)..(569): n is a, c, t, g, unknown, or other
  misc_feature (576)..(576): n is a, c, t, g, unknown, or other
  misc_feature (578)..(578): n is a, c, t, g, unknown, or other
  misc_feature (582)..(582): n is a, c, t, g, unknown, or other
  misc_feature (584)..(584): n is a, c, t, g, unknown, or other
  misc_feature (586)..(586): n is a, c, t, g, unknown, or other
  misc_feature (600)..(600): n is a, c, t, g, unknown, or other
  misc_feature (638)..(638): n is a, c, t, g, unknown, or other
  misc_feature (639)..(639): n is a, c, t, g, unknown, or other
  misc_feature (655)..(655): n is a, c, t, g, unknown, or other
  misc_feature (661)..(661): n is a, c, t, g, unknown, or other
tgtttggtgtgncnncnnncccccctctcatcccccccatgctatcttttatccnnntanccccattgggtaccgggccccccctcgaggtcgacggtatcgatattttttttttttttttttgtaacaaaggggaattcctcctcgattagtcatacagggttccaaaagattacaagcgtcaagcgagcaggtgagggaagataccgctaaaaaaaaaagcaggtagaacgctcctacgcccaggaggaataacccgtagtagtcagttcatattaaacaaattagtacaaacagaagaaccaaaatcttcatctagggtcccccttctcgccgggaaccaaggaaaaaaaggggtcttcatgccgaacatcaggggagggcggtgtctcatgtctttggggtcttgggctccnngggggggaggtatgttggagaggggtgggggggttagggtggctttttttgtttgggtggttgtttttttccccccggggacttatagggggggtgnttgggnnnaaannnantgggttatggagggggggttttggggcaagngggggggngcggggngngaancncnacaaccatgcggcnacagccgcattgagggggcgtaggcccctttcctgacnnccccccctgctggggnccctcnaacgcgtagagtgtttggtccgaggaagggcaggtaggagataactcatgtcactaccgacttcatttggcactattagtaagagcgtatcgggacagctagaaatgatgag

SEQ ID NO: 7480 - DNA, 356 bp, Zea mays
  misc_feature: Ceres CLONE 354144-F
tgaaggcactgtctctatttttgatgggtcagtagccaccctctgttggctaacgacatgtcccaaatagcctgttttctgttgggatatgctcttgactgcggctgcgcggccgtcggcgatggaggcatggcaccgcgggcaggagcagcaagcccggggcatcgtgttgtaggtgagggacgggaacctggagcgggcgctgtcggtcatggagctcaagatgcggtccgccgcatcttgagatcagatccgacaactcgccctcccgtctttccctctctctcctyccaccacacccggtcgtcgttgtcgcggcgtgagcgagcgagaggggaaaacccaaaaccctagca

SEQ ID NO: 7481 - DNA, 421 bp, Zea mays
  misc_feature: Ceres CLONE 354162-F
  misc_feature: Encodes the peptide sequence at SEQ ID NO. 7482
agtggtatttataggtcttagtgcccaggcaacaagagacacgaataaagcatcgatcacgacaagatggcgtgcacagacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcagcgtgcggcggcactgggaagcagacaatcctcatacccaagggcgacttccttgtcggacaactcaacttcacaggcccttgcaagggcgacgtgaccatccaggtggatggcaatctgctggcgaccacggacctaagccagtacaaggaacatg

SEQ ID NO: 7482 - protein, 118 aa, Zea mays
  misc_feature: Ceres CLONE 354162-F
  misc_feature: SWISSPROT Homolog: EC 3.2.1.67 Galacturan 1,4-alpha-galacturonidase
MACTDNAMRALFLLVLFCIVHGEKEESKGIDAKASGPGGSFDITKLGASGNGKTDSTKAVQEAWASACGGTGKQTILIPKGDFLVGQLNFTGPCKGDVTIQVDGNLLATTDLSQYKEH

SEQ ID NO: 7483 - DNA, 790 bp, Zea mays
  misc_feature: Ceres CLONE 354172-R
ccgattgggtaccgggccccccctcgaggtcgacggtatcgataagcttttttttttttttttttgtatataaaattaactcccaagtgacttcccaggaaactctgtttttttgcctatagtctaacaagttaacctgtgcctcactacacgggaacaccaagcaatatttcagcctttttattgcgagggcactctaagctacaacattctctatatctagaattgggttctgtggtgggaacgaatagcaggtaacagaataccaccatttgggctccttagggctcggtcgtttcaccattaatccatgtagattgggtggtattgagtcgatttaaatccatagcaaataaaaatctatcctaatccattccaatacactccaatccacatggaattggaataagcgaacaatgccttaggtggaaggagcctcagtttcttttttttctttccttttgttgaggcttagtacatctgttctaccatgagggccgagaacagatcagattttatcatgaaggttaacaaccaggtcatgtgcatcatctagcagcctccagacgtctagctgcccggccatgctattgcactctcgcagtatctcgtccatgctgctatacttctcaattatcagcttcctcctctgcaggacgcaggcggcgatggcgtagagcaacaggtcgtcagttggcggagcacgcagccttatccttccccaggtggacctcccgatcccggctcgtatggctgcctggtcagcccacataacctccccaggcacacg

SEQ ID NO: 7484 - DNA, 751 bp, Zea mays
  misc_feature: Ceres CLONE 354174-R
  misc_feature: SWISSPROT Homolog: EC 1.14.13.70 Sterol 14-demethylase
  misc_feature (1)..(1): n is a, c, t, g, unknown, or other
  misc_feature (50)..(50): n is a, c, t, g, unknown, or other
  misc_feature (57)..(57): n is a, c, t, g, unknown, or other
nttttttttttccccccccccgggccgccccaacaccaccacccacaggnggtgggnccgattgggtaccgggcccccctcgaggtcgacggtatcgataagcttttttttttttttttttacctgaacacctgagtttattcattaggttatttgttatgtttgtgtttacatccatctaagacaatgataaacatcaggatttgaacaaaagacccacaggcttatagatgctacaagttacagatttgacataggggaatgcttagccaggaagctgaacatgcagaagttgcagatcatggcggccccatagtgaagcaaatttcaaaatcctaaacaacagaaacacccctaacaaggctggcttgcgtacagcagaacttgcactgaacaaatgctgacaaacatgtgaaaacaattgaatcaacttggtgtaagcatctagagactgcggccacaatcttagatgcccccgggaagcttcggggtcttggggttaaccatcacctcgccctttatgccaaccaccatggggttccggtcgttctctgggaatggggataccaggtcgaacccccaagttcctcagtcaggtgcgtccacgattgcctctgatcttgtaggttagcggaaagggggtcagccggaggctgctcatgttgtggcctccccccctcaatggagaatttttttgaataagggcgcccttgcctactcttgtgtcccctctctccccctttgcgcgaga

SEQ ID NO: 7485 - DNA, 463 bp, Zea mays
  misc_feature: Ceres CLONE 354178-F
  misc_feature: Encodes the peptide sequence at SEQ ID NO. 7486
aaggcgcgcggtttccaggcggttcctcctccagagtccagactctagagaaagaaggcgcatcgtgagcgagagaaagagaggcaatggcgtcggcgacgttcctggaggtgctcctcgccatcttcctcccgccggtcggcgtcttccttcgctacggctgcggcgtggagttctggatcgacctcttgctgaccgtgctggggtacattccggggatcatctacgccgtgttcgtgctggtggcttaagttgtgcgaagacgaggacatgaagattctcgatctgtccagaagtacttagtgatgtgaggacttctcccagtcccagtgtgcatgtctgtctctgactatcggcggatgttgttaataaaacgtgtgtgggtgctgcaagcaaagttgtgtagttgggggcagaaatgtttatcacagcattattgttttttttgtttctttcttttacc

SEQ ID NO: 7486 - protein, 54 aa, Zea mays
  misc_feature: Ceres CLONE 354178-F
  misc_feature (4)..(54): Pfam Name: UPF0057 Pfam Description: Uncharacterized protein family UPF0057
MASATFLEVLLAIFLPPVGVFLRYGCGVEFWIDLLLTVLGYIPGIIYAVFVLVA

SEQ ID NO: 7487 - DNA, 511 bp, Zea mays
  misc_feature: Ceres CLONE 354222-F
  misc_feature: Translation starting site: 128
  misc_feature: SWISSPROT Homolog: EC 3.2.1.1 Alpha-amylase
gagcggccgcgctccaccccaaacccacctcgcctcctagtcccccccttcgccttctctcccgagtcccatcggagcccggagctctctcgcctcccgcgaggctgtgtggtgaggcgcggacgagatgaacgagcaggggctcggtggtctcggcgggggccgcggggccgtgcaggggcacgggcgggaggcgatggcgctcttgcagcaccagcagcttcaacagcaacggcggcagctggaggaggaggatgaggtgcggcgccagatgttcggcggggtggcggcgttcccggcagcgctgggccacggccagcaggtggactacggggaggacgccggcgggctcggggacagcgacgcgggcgggtcggagcccgagccaccaccggagcggacgcgcggggggtccggcggcggcggcaagcggagccgcgctgccgagatgcacaacctctccgagaagaggaggaggagcaagatcaacgagaagatgaaagcgctgcag

SEQ ID NO: 7488 - DNA, 485 bp, Zea mays
  misc_feature: Ceres CLONE 354229-F
  misc_feature: Encodes the peptide sequence at SEQ ID NO. 7489
aaaacacaagacctcctattcaccatgccgaccgaagagggttccgacggcggtggcggcgccggagccggagccggggagaagaagagctcgcaggcgcccgcaaagcctggagcgtgcggcgccgcaaagttcctcgcggggttgccgtcgcgcggcaacttctcttccggctccgccccctccaatctgggagggttcagggtttacgtctgcgagcacagcacagatcccccagaaggacaagttataaagacggattcaacgaatattttaatcaggcatctccagttgaacaagcagaagactgagggcaaagatgtggattccagaactgtcggcgaaaacaacagagggaaaagatctgctgccagaagtttggatgtcaacaattcagcaaagaaggctaacttgggtacttcatctggatcatcagcctatgaggaaatttctggcttttcacaacacacactgcagtcatttac

SEQ ID NO: 7489 - protein, 153 aa, Zea mays
  misc_feature: Ceres CLONE 354229-F
MPTEEGSDGGGGAGAGAGEKKSSQAPAKPGACGAAKFLAGLPSRGNFSSGSAPSNLGGFRVYVCEHSTDPPEGQVIKTDSTNILIRHLQLNKQKTEGKDVDSRTVGENNRGKRSAARSLDVNNSAKKANLGTSSGSSAYEEISGFSQHTLQSF

SEQ ID NO: 7490 - DNA, 481 bp, Zea mays
  misc_feature: Ceres CLONE 354242-F
  misc_feature: Encodes the peptide sequence at SEQ ID NO. 7491
aaaacctctcctggcacgagatcacgcttctcgtcggatcgaacagctagggtttccaagatgttcgggcgcgcgccgaagaagagcgacaacacacggtactacgagatcctcggggtctccaaggacgcgtcccaggatgacctcaagaaggcctaccgcaaggccgccatcaagaaccaccccgacaagggcggcgatcccgagaagttcaaggagctagctcaggcctatgaggtcctcagtgatcctgaaaagcgagagatttatgatcaatatggtgaggatgccctcaaggagggaatgggaggtggtggagggatgcacgatccctttgacatattccagtcattctttggtggtggaagcccttttggaggtggtggcagcagtaggggcagaaggcagcgaaggggagaggatgtggttcatcctctgaaggtttctctggaggatttgtacaatggcacatcgaagaagc

SEQ ID NO: 7491 - protein, 140 aa, Zea mays
  misc_feature: Ceres CLONE 354242-F
  misc_feature (13)..(71): Pfam Name: DnaJ Pfam Description: DnaJ domain
MFGRAPKKSDNTRYYEILGVSKDASQDDLKKAYRKAAIKNHPDKGGDPEKFKELAQAYEVLSDPEKREIYDQYGEDALKEGMGGGGGMHDPFDIFQSFFGGGSPFGGGGSSRGRRQRRGEDVVHPLKVSLEDLYNGTSKK

SEQ ID NO: 7492 - DNA, 268 bp, Zea mays
  misc_feature: Ceres CLONE 354272-F
  misc_feature: Encodes the peptide sequence at SEQ ID NO. 7493
ctccgtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcacc

SEQ ID NO: 7493 - protein, 55 aa, Zea mays
  misc_feature: Ceres CLONE 354272-F
  misc_feature: SWISSPROT Homolog: EC 5.2.1.8 Peptidylprolyl isomerase
MAASDVEYRCFVGGLAWATDDHSLHNAFSTYGEVLESKIILDRETQRSRGFGFVT

SEQ ID NO: 7494 - DNA, 382 bp, Zea mays
  misc_feature: Ceres CLONE 354309-F
  misc_feature: Encodes the peptide sequence at SEQ ID NO. 7495
atcgcctccaccgctctctcttcctctgctcttctctgcctgcctgagctcaccgcacctcgcctcctcaccgcgtttcctccgttaatccggtagaaaatggccgatgccgaggatatccagcccctcgtctgcgacaacggaactggcatggtcaaggctgggttcgctggcgacgacgccccgagggccgtcttccccagcatcgtggggcgcccgcgccacactggtgtcatggtcgggatggggcagaaggacgcctacgtcggtgacgaggcgcagtccaagaggggtatcctgaccctcaagtaccccatcgagcacgggatcgtcagcaactgggacgacatggagaagatctggcatcacaccttctacaacg

SEQ ID NO: 7495 - protein, 94 aa, Zea mays
  misc_feature: Ceres CLONE 354309-F
  misc_feature: SWISSPROT Homolog: EC 2.7.10.2 Non-specific protein-tyrosine kinase
MADAEDIQPLVCDNGTGMVKAGFAGDDAPRAVFPSIVGRPRHTGVMVGMGQKDAYVGDEAQSKRGILTLKYPIEHGIVSNWDDMEKIWHHTFYN

SEQ ID NO: 7496 - DNA, 457 bp, Zea mays
  misc_feature: Ceres CLONE 354321-F
  misc_feature: Encodes the peptide sequence at SEQ ID NO. 7497
aagacacacacgcgcgcgaacacgaacagggacacgagacagcggcggccatggcgagaggcggcggcgatcggagtcgggaggatgaccccttctccgacggcggcaccaccggaaccgactcggacgagtcctctccgcgtggggtgggggcccgcggccccggctccacctccaacccgatcctgacacgcctcgcggtgtcgcggaacccgagcccgctggctgcggccaccgcggccccaggggtctgcctcctccgcttcgcctgggagtccgccgcgggctccctcgtcggcgccgccgttggctacggtaaaggtttggttacgatgaaggggattaaaggctcatttgctgatgctgcgtcatctgctaagatatttgctgttcttgctggtgttcaaagtttagtagcctgctctttgagaaaactacgtggaatagatgatggaat

SEQ ID NO: 7497 - protein, 135 aa, Zea mays
  misc_feature: Ceres CLONE 354321-F
MARGGGDRSREDDPFSDGGTTGTDSDESSPRGVGARGPGSTSNPILTRLAVSRNPSPLAAATAAPGVCLLRFAWESAAGSLVGAAVGYGKGLVTMKGIKGSFADAASSAKIFAVLAGVQSLVACSLRKLRGIDDG

SEQ ID NO: 7498 - DNA, 370 bp, Zea mays
  misc_feature: Ceres CLONE 354350-F
  misc_feature: Encodes the peptide sequence at SEQ ID NO. 7499
aaagaaagaggggggggggatggactcaccccgctggggcgggcgggcggtggagggcgagtgaagacgaggtgcttgcctcgctcggctcacaccccttttcgtctcttctctgcctttcctccgcaatcacagagcgcaagaggagagagagagagtgagaggggagagagagggctagggttttgtgccccccacgcctcacgcatcgaatccgagccgggtcggggttgctgcgaatcgccggcggtgcttgggctgtgattccattgcaatggcatctgaaactgatgagaaagctaagatggaragtttgacatctgctgcagcctttgtggagggtggcattcaggatgcatgcaacatttgc

SEQ ID NO: 7499 - protein, 32 aa, Zea mays
  misc_feature: Ceres CLONE 354350-F
MASETDEKAKMESLTSAAAFVEGGIQDACNIC

SEQ ID NO: 7500 - DNA, 489 bp, Zea mays
  misc_feature: Ceres CLONE 354395-F
  misc_feature: Encodes the peptide sequence at SEQ ID NO. 7501
agataagatcgagcagcgagagacgggcaggggaggaaaaaaatctaaccctagcatccgcagcgctagggttcgggggttgcgatggcggcggcggcgaggcagcgggggacggtgaagtggttcaacgacaccaagggcttcgggttcatctcccccgaggacggcagcgaggatctcttcgtgcaccagtcgtcgatcaagtcggagggcttccgctcgctcgcggagggcgaggaggtggagttttccgtctcggagggtgacgacggccgcactaaggccgtcgacgtgaccggccccgacggatccttcgtcaggggcggcggaggcggaggaggcggcggcggcggcggctacggctcccgcggcggtggcggatctggcggcggcggtcgcagctacggtggtagctggggcggcggccggagatccggcggcgggggcggtcctggcgcgtgctacaagtgcggcgagcccggccacatg

SEQ ID NO: 7501 - protein, 135 aa, Zea mays
  misc_feature: Ceres CLONE 354395-F
  misc_feature (6)..(73): Pfam Name: CSD Pfam Description: 'Cold-shock' DNA-binding domain
MAAAARQRGTVKWFNDTKGFGFISPEDGSEDLFVHQSSIKSEGFRSLAEGEEVEFSVSEGDDGRTKAVDVTGPDGSFVRGGGGGGGGGGGGYGSRGGGGSGGGGRSYGGSWGGGRRSGGGGGPGACYKCGEPGHM

SEQ ID NO: 7502 - DNA, 476 bp, Zea mays
  misc_feature: Ceres CLONE 354402-F
  misc_feature: Encodes the peptide sequence at SEQ ID NO. 7503
agatataaagaagacgcccccgaatccgtctccgcctcctgtcgctcgctctccctgtctcccgcacgccgaccccagccgccgccgttcgccatgggtttcctcgacgcgctctaccgtgtggtgatgcgccgcaacgccgtctacgttaccttcgtcgtcgccggcgctttcgcgggcgagcgggcggtggactacggcgttcacaagatctgggagatgaacaacctcgggaaaaggtacgaagacatatcggttttggggcagaggccagctgaggaatgataaattttggtcaccagtttgcttcggtttgaccgtttcattttggcacagtaataaacgatgtaaacttacgctgctcctgtgacctccttctcattcgtttactctgaaaatgcttttgtggggatttcgtggtgcatgattgaaacctgttatatagaacatgcaaatactgaaatacctctggaaaa

SEQ ID NO: 7503 - protein, 63 aa, Zea mays
  misc_feature: Ceres CLONE 354402-F
  misc_feature (4)..(58): Pfam Name: UCR_UQCRX_QCR9 Pfam Description: Ubiquinol-cytochrome C reductase, UQCRX/QCR9 like
MGFLDALYRVVMRRNAVYVTFVVAGAFAGERAVDYGVHKIWEMNNLGKRYEDISVLGQRPAEE

SEQ ID NO: 7504 - DNA, 454 bp, Zea mays
  misc_feature: Ceres CLONE 354423-F
atttcccacccggagcgaggcaacattcatgaagcggagcagccgagcagaggcggcggcggcggagccagcgagggagcagccttgacgcagcagcatcacggtcacgggccgggcctcgtgcgctccgcccgttccgagtcgcatcgtatcgatacgcccgatgcgtcgtcacacttcacagctccgctcatgtccgcacccgagttattatatactactactacggcccgccaccttcgcttcgctagcggtccgcacccactcacccgttgcctccaaactcatttctcccgagcgccgccgcgagcctctgttccagcttcgttcatggcttcctcaccggatccgctctctcctttgcgaggcccgtcaaggcaatcagcattaagtctgtctctttctctggtctaaggaaggataatgtagccttccgcttgcagccagtgccaca

SEQ ID NO: 7505 - DNA, 381 bp, Zea mays
  misc_feature: Ceres CLONE 354427-F
  misc_feature: Encodes the peptide sequence at SEQ ID NO. 7506
  misc_feature (206)..(206): n is a, c, t, g, unknown, or other
gtaaccctaamcccacacccactcataaaacctccgcctccttgccttccttcctttcattcaatcctcggaacgagcgcgcgggcgaggaggacccccgacggaggatggcggcggcggctagggttttacgcgggtccctcttcctgatgtccccggcggcgggcgccaaggcgtcggcagccaagaaggcgggcgcggcggcngcggcggcggcggtggcaagaagaccgaggcggccactacgaagccgagactgccgaccgggatcacgaagccgatgccggtctccgatgagttcccgcaggttcgccggcggcgcgcccgaggtcgcacgctccgaggccatcaagctcatctgggcccacatcaaggcccacg

SEQ ID NO: 7506 - protein, 91 aa, Zea mays
  misc_feature: Ceres CLONE 354427-F
MAAAARVLRGSLFLMSPAAGAKASAAKKAGAAAAAAAVARRPRRPLRSRDCRPGSRSRCRSPMSSRRFAGGAPEVARSEAIKLIWAHIKAH

SEQ ID NO: 7507 - DNA, 474 bp, Zea mays
  misc_feature: Ceres CLONE 354472-F
  misc_feature: Encodes the peptide sequence at SEQ ID NO. 7508
agcagatgccatcatctccgccatcatcggtgatgtggtcagtagagcggtttctcttctcattgggcgtttcatcagtaacaaccaggagagcgctgaggacaagctgcaaaggatgaggcgtctggtcatcagaatccacagcgtggtagaggaagcaaaagggcggcagatctcaaaccacggcaccctccagtggctctccgatctcatcgacggcgactaccagggctgctatttgctcgactccgtcgggtgcggaggtgaattagctgacagagatgacgatggtaaggcaatcccccaagtttctaccttgtccttgtttaatccagcaaagcgcgtgagactcgcagcatcgtcccagcgccatgacgatacggacggtgttgatgagatcgagagggtgctccagaractgcaggtcatgtctggtgatctgagggagttcatccttctcttgcaaggctgcaa

SEQ ID NO: 7508 - protein, 157 aa, Zea mays
  misc_feature: Ceres CLONE 354472-F
  misc_feature (139)..(139): Xaa is any aa, unknown, or other
ADAIISAIIGDVVSRAVSLLIGRFISNNQESAEDKLQRMRRLVIRIHSVVEEAKGRQISNHGTLQWLSDLIDGDYQGCYLLDSVGCGGELADRDDDGKAIPQVSTLSLFNPAKRVRLAASSQRHDDTDGVDEIERVLQXLQVMSGDLREFILLLQGC

SEQ ID NO: 7509 - DNA, 466 bp, Zea mays
  misc_feature: Ceres CLONE 354485-F
  misc_feature: Encodes the peptide sequence at SEQ ID NO. 7510
aacaccgagaatcacaatacgaaacgaattaatccccaatcaacacagcaagtcagcaacaagcaaagcagcgatccgagagatggacgcgaggatgttcgggctggagaaccccctggtggcggcgctgcatcacctgctggacgtgcccgatggcgacgccggagcgggcggcgacaaggcgggcggcggcgccacgcgcacctacgtccgcgacgcgcgcgccatggcggccaccccggccgacgtcaaggagctcgcgggagcgtacgcgttcgtggtggacatgccggggctgagcacgggcgacatcagggtgcaggtggaggacgagcgggttcttgtgatcagcggcgagcggcgccgggaggagcgcgaggacgccaagtacctgcgcatggagcggcggatgggcaagttcatgcgcaagttcgtgctgccggacaacgccgacgtggacaaggtc

SEQ ID NO: 7510 - protein, 128 aa, Zea mays
  misc_feature: Ceres CLONE 354485-F
  misc_feature (55)..(128): Pfam Name: HSP20 Pfam Description: Hsp20/alpha crystallin family
MDARMFGLENPLVAALHHLLDVPDGDAGAGGDKAGGGATRTYVRDARAMAATPADVKELAGAYAFVVDMPGLSTGDIRVQVEDERVLVISGERRREEREDAKYLRMERRMGKFMRKFVLPDNADVDKV

SEQ ID NO: 7511 - DNA, 499 bp, Zea mays
  misc_feature: Ceres CLONE 354494-F
  misc_feature: Encodes the peptide sequence at SEQ ID NO. 7512
atacgggcccgtgtctcagcgcacacctcttcgtgctcgctcccatggaggccaccccgatctccatgaagccaccggcgccggcgccggcgccacccccggtcactctggagcccatagaattgtcaacgcatgccgtcggagtgaccgagctggagcgatccagcatgaaccagctcgcaatagcgccggaccccaagcggcagagggtggaggaggctgcggatggcaacgggtgcaagcattgcgcctgcaagaagtccagatgcttgaagctctattgcccatgttttgctggaggtggttattgttccgataagtgtggctgccaaccatttttcaacaaagaagccttttcagaaacagttcagactactcgcaaggtgttactttcaagacagaagcgcatgtcgatgaaaattaataggagacctgaggcaaatgctgaaccaatggaagatgttcaccattcttcttcgtcaactccaccaaggagagg

SEQ ID NO: 7512 - protein, 151 aa, Zea mays
  misc_feature: Ceres CLONE 354494-F
  misc_feature (63)..(104): Pfam Name: CXC Pfam Description: Tesmin/TSO1-like CXC domain
MEATPISMKPPAPAPAPPPVTLEPIELSTHAVGVTELERSSMNQLAIAPDPKRQRVEEAADGNGCKHCACKKSRCLKLYCPCFAGGGYCSDKCGCQPFFNKEAFSETVQTTRKVLLSRQKRMSMKINRRPEANAEPMEDVHHSSSSTPPRR

SEQ ID NO: 7513 - DNA, 456 bp, Zea mays
  misc_feature: Ceres CLONE 354554-F
  misc_feature: Encodes the peptide sequence at SEQ ID NO. 7514
gtgctttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcatcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggtggcggcggctacggcggtggcaacgtggcggcggctacggcaactccgacgggaact

SEQ ID NO: 7514 - protein, 119 aa, Zea mays
  misc_feature: Ceres CLONE 354554-F
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAASDVEYRCFVGGLAWATDDHSLHNAFSTYGEVLESKIILDRETQRSRGFGFITFSTEEAMRNAIEGMNGKELDGRNITVNEAQSRGGRGGGGGGYGGGGGGYGGGNVAAATATPTGT

SEQ ID NO: 7515 - DNA, 450 bp, Zea mays
  misc_feature: Ceres CLONE 354572-F
  misc_feature: Encodes the peptide sequence at SEQ ID NO. 7516
aaccaagctcgatccatctcactctccgctggtcgctcactcttgcagctccacccttcactcagtcttagtctcttattagctctaggctctagctagccgcgccactccttcgtgtagccatcagccttctcatcgccaccaatggccactgccgaggtccagaccccgaccgtcgtggcggccgaggaagcgcccgtggtggagaccccgccgccggccgtcgtgcccgaggagtctgcccccgccgaggccgaggccgaggccgaggctgctgctcctgctgatcccgaggagcttcccgcggccgagcagcaggcagccgccgaggcggaggccgcggctcctgctggtgccgaggagcccgtcgcggccgaaccggccgccgaggcggaggctgctgctcctgctggtcccgaggagactcctgcggtcgagcaggaggcwgcc

SEQ ID NO: 7516 - protein, 102 aa, Zea mays
  misc_feature: Ceres CLONE 354572-F
MATAEVQTPTVVAAEEAPVVETPPPAVVPEESAPAEAEAEAEAAAPADPEELPAAEQQAAAEAEAAAPAGAEEPVAAEPAAEAEAAAPAGPEETPAVEQEAA

SEQ ID NO: 7517 - DNA, 447 bp, Zea mays
  misc_feature: Ceres CLONE 354642-F
  misc_feature: Encodes the peptide sequence at SEQ ID NO. 7518
aatagcagcctcagattctgctcggctctcactcagacgccacctgttcttccttcctctcctctctgcaacgcgtcgggaagcagctgccagccatggcaatggcgtcgtcgtcgagcgggctgaggagctgcagcgcattgggcgtgcccagcctgctggcgccgtcgacgtcgtcgtcgtcccggtccggccgcctgccgttctgcgcccacgccaccacctccggccgcgtcaccatgtccgcggagtggatgcccgggcagccccgccccgcccacctcgacggctcctcgccaggtgacttcggcttcgaccccctgggcctggccacggtgccggagaacttcgagcggttcaaggagtcggaggtgtaccactgccggtgggccatgctggccgtgccgggggtgctggtgccggaggcgctggggctgggcaactggg

SEQ ID NO: 7518 - protein, 117 aa, Zea mays
  misc_feature: Ceres CLONE 354642-F
  misc_feature (58)..(117): Pfam Name: Chloroa_b-bind Pfam Description: Chlorophyll A-B binding protein
MAMASSSSGLRSCSALGVPSLLAPSTSSSSRSGRLPFCAHATTSGRVTMSAEWMPGQPRPAHLDGSSPGDFGFDPLGLATVPENFERFKESEVYHCRWAMLAVPGVLVPEALGLGNW

SEQ ID NO: 7519 - DNA, 482 bp, Zea mays
  misc_feature: Ceres CLONE 354676-F
  misc_feature: Translation starting site: 84
  misc_feature: SWISSPROT Homolog: EC 3.4.21.97 Assemblin
aaagacgccgtcgccgctcttgttgtttccgatcccaaaccccaaacacgctccaccggcacctccgctcccacaccacaccgatggcccgcacgaagcagacggcgcgcaagtccaccggaggcaaggcgccgcggaagcagctggcgaccaaggcagcgcgcaagtcggccccggcaaccggcggcgtgaagaagccgcaccgcttccgcccgggcaccgtggcgctccgcgagatccgcaagtaccagaagagcacggagctgctcatccgcaagctccccttccagcgcctggtccgcgagatcgcgcaggacttcaagaccgacctccgcttccagtcctccgccgtcgccgcgctgcaggaggccgcggaggcctaccctcgtcggcctcttcgaggacacaacctctgcgccatccacgccaagcgcgttcaccatcatgcccaaggacattcagctcgcccgccgcatccgcgg

SEQ ID NO: 7520 - DNA, 472 bp, Zea mays
  misc_feature: Ceres CLONE 354680-F
  misc_feature: Encodes the peptide sequence at SEQ ID NO. 7521
acggcataccacactagagccgccgccgccgccgtttcgcgcaccgtaccctagccctcgtcagcggcggcttcgagctcatccagccatgacgttcaagcggasgaatggcggacgcaacaagcacgggcgcggccacgtcaagtacatccgctgctccaactgcgccaagtgctgccccaaggataaggctatcaagcggttcttggtgaggaacatttttgagcaggctgccgtgagagatgtgcaggaggcctgtgtacatgatggatatgttctacccaaattgtatgcaaaggttcatcactgtgtctcatgtgcaatccatgcgcacattgtccgggtccgctctcgtgagaacaggaggaaccgtgagcccccgcagcgcttcagacgccgggatgatggccaaggcctggtcagggcccgccgcgcccaggcggtgcagctcctgcagctgcagctgctgctg

SEQ ID NO: 7521 - protein, 128 aa, Zea mays
  misc_feature: Ceres CLONE 354680-F
  misc_feature (1)..(114): Pfam Name: Ribosomal_S26e Pfam Description: Ribosomal protein S26e
  misc_feature (6)..(6): Xaa is any aa, unknown, or other
MTFKRXNGGRNKHGRGHVKYIRCSNCAKCCPKDKAIKRFLVRNIFEQAAVRDVQEACVHDGYVLPKLYAKVHHCVSCAIHAHIVRVRSRENRRNREPPQRFRRRDDGQGLVRARRAQAVQLLQLQLLL

SEQ ID NO: 7522 - DNA, 517 bp, Zea mays
  misc_feature: Ceres CLONE 354691-F
  misc_feature: Encodes the peptide sequence at SEQ ID NO. 7523
aacctctagcttattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggaggcgtccctgtcgtgcgtccgctcgtggggcggcgcgcctctcgtccatcacccacctcgtgtacgtcctcgtcgagcgaggcgcgctt

SEQ ID NO: 7523 - protein, 144 aa, Zea mays
  misc_feature: Ceres CLONE 354691-F
  misc_feature (10)..(138): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MVSSSMDTTSDKRASSMLAPNPGKATILALGHAFPQQLVMQDYVVDGFMKNTNCDDPELKEKLTRLCKTTTVRTRYVVMSDEILKNYPELAQEGLPTMNQRLDISNAAVTQMATEASLSCVRSWGGAPLVHHPPRVRPRRARRA

SEQ ID NO: 7524 - DNA, 781 bp, Zea mays
  misc_feature: Ceres CLONE 354725-R
tgcaatttttcactgaagtgcggcaaatccagatgacagatgaatatgaacatcaagcatggacgatcaaactcatccaccatcatacatatagcaagtcatcaccaagcactcaaaagtacttttagaggtcagggatgtccccaacatattgagttgccagcaaagtgtaaaatccccagtagcaagtagtagtagtagtatgccaatcaacatgcttcacttagggtcagtgaagaacttgttaactgcaggcatgatctcaggagtcttgtcgtgcacaaagcttcttaggccatgcatggcgtaacgcctcccctcctcatggttctcaagcacaccagctgccctccctgccttgtttaccctgacttccgggttgccggtgatgttccggaagagctgaaatccgcagatgccgacggccacgcccgttgccgcgaacagcgggtacacctcgggccggacccagcggctggccatctgagtcgtggtctcttcgcactgggacgcggcctcgacggcggagaagcacggggaaagtggacaggcgacggagtagcggttattggtcatcgcatacgcaggtgagtctctccttatacctccttttcctcggcgtcctctccccttggcgtgctacgccgcaaggcccctgtgtcgtggcccccacctcttcttccttgcgcgcggcaggcactcgggcactgatccccgacgagctcgtgccatggcggcctttgtgaacatttgcagggctgtgaagccaaacatcggatca

SEQ ID NO: 7525 - DNA, 506 bp, Zea mays
  misc_feature: Ceres CLONE 354733-F
  misc_feature: Encodes the peptide sequence at SEQ ID NO. 7526
tcgatcgcctcgctgtgttgcactgctaggtagccagctcgtttcctcccccaacccaaatgggcgactccaccgccaccaacccctcctcgccgaccgcagccatggatcccgactccgaggtcgtcttcgacttcccgccctacctctgccaatacaagagcggccgcatccaccgtcccggcggcgcccccaccgtcccagctggcacggacccagccaccggcgtcgtgtccaaggacatccgcgacggtcccgcctccgcgcgcgtctacctccctcccggcgccgccggcaagatcccggtggtcgtctacttccacggcggcgggttcgtggtcggctcgccagcgcggccgggcacgcacaactacctcaacgacctggtcgcccgctcgggcgccatcggcgtgtccgtctactaccgcctcgcgccggagcacaagctgcccgcggcgtacgacgacgcgtgggcggcgctgcggtgggcggcgacgctcggcggc

SEQ ID NO: 7526 - protein, 149 aa, Zea mays
  misc_feature: Ceres CLONE 354733-F
MGDSTATNPSSPTAAMDPDSEVVFDFPPYLCQYKSGRIHRPGGAPTVPAGTDPATGVVSKDIRDGPASARVYLPPGAAGKIPVVVYFHGGGFVVGSPARPGTHNYLNDLVARSGAIGVSVYYRLAPEHKLPAAYDDAWAALRWAATLGG

SEQ ID NO: 7527 - DNA, 462 bp, Zea mays
  misc_feature: Ceres CLONE 354810-F
  misc_feature: Encodes the peptide sequence at SEQ ID NO. 7528
gtgtgctaataaaaccccacacggaaaagatagagagaaacagattgcctagcttaaaccttgagtgttctcttcctctcaaacaatcaaaccaactaagccagctgcaatcttctctgtctaatcaacttcatcgttgtttcatacaggtaaccagtgccaaaatgattgctgggggaggctattttgatggttctcatgaccatattctcatggaaggatcaatgatccatgattcttcacaatcttccatctatgacaatacagatgttgaacagcagaacttcagatttgcgccctttatcatagaagatcactccaatccagccaaccttacctctgaggctgcaagggtgatagaccaaattcaacaccagctggggattgacatcgagcaggaccatagtgatcacatgatgcaagaagttcctccagcagaaactgaaaatttggttcctgctg

SEQ ID NO: 7528 - protein, 99 aa, Zea mays
  misc_feature: Ceres CLONE 354810-F
MIAGGGYFDGSHDHILMEGSMIHDSSQSSIYDNTDVEQQNFRFAPFIIEDHSNPANLTSEAARVIDQIQHQLGIDIEQDHSDHMMQEVPPAETENLVPA

SEQ ID NO: 7529 - DNA, 496 bp, Zea mays
  misc_feature: Ceres CLONE 354813-F
  misc_feature: Translation starting site: 31
aaatcaagaaaacagtcgtctccagtttccatgcagagcagaaaagatcagctagcgagagaagcaatggcgtcggctcctgcgttctgcgtcgcgctgctgctggcttccgtcgctgccgtccaagcggtgccgccccaggccggcacgtcgtccacctgcagcactgacctcctccgcctcctcccctgcctgcccttcatcgagggcaccgccaccgtgctgcggacacctgttgcgccaacctgggcagcatggtgcacgacgagccgcagtgcctctgccaggccctcagcaaccccagcacggcccccgtcgccgtcaacatgacgcgcgtgatggccatgcctcggctctgccgcctcgacctcccgcccgccaccggcgcctgcgcagttgccggtcttcttccccatggaccatcaccgccgctgccaccgccgccgccgccgccgcggcggcggtcactccacacgcaagcgccaactccagtgct

SEQ ID NO: 7530 - DNA, 506 bp, Zea mays
  misc_feature: Ceres CLONE 354835-F
  misc_feature: Encodes the peptide sequence at SEQ ID NO. 7531
tccactcgccctcccacacagaaaaccctagccgccgccaccgaagcggcctcccaggtaagcaggagcgtccaccccgccgccgtcatgaagcgcaatccccgcgtcacgagctcccgccggaagtgccgcaaggcgcactttacggccccgtcctccgtccgccgcgttctcatgtccgccgggctgtcgacggagctccgccacaagtacaacgtgcgctccatcccgatccgcaaggacgacgaggtgcaggtcgtgcgcggcacctacaagggccgcgaggggaaggtggtgcaggtctaccgccgcgtggtggtgatgttcgcgtggctgtccagccaggagcggcacgtgcgggcgtacgtggagctgtacgcggcgcacgggtgggcgtgcctcgtctgccactccgacttcctcaccctgtttttccctgagaaggctgccatgctcgccgacagggtgattggggagcttgtcaaggtgctgaagattacacctgt

SEQ ID NO: 7531 - protein, 139 aa, Zea mays
  misc_feature: Ceres CLONE 354835-F
  misc_feature (51)..(80): Pfam Name: KOW Pfam Description: KOW motif
MKRNPRVTSSRRKCRKAHFTAPSSVRRVLMSAGLSTELRHKYNVRSIPIRKDDEVQVVRGTYKGREGKVVQVYRRVVVMFAWLSSQERHVRAYVELYAAHGWACLVCHSDFLTLFFPEKAAMLADRVIGELVKVLKITP

SEQ ID NO: 7532 - DNA, 503 bp, Zea mays
  misc_feature: Ceres CLONE 354875-F
  misc_feature: Encodes the peptide sequence at SEQ ID NO. 7533
cagaggaggaggagcagggggaggacgaggctagggttgctcggcgatggcgtcggcggcgaagacccttgcacgggttggatcatccctcttcggccgcattctcgcgtctccgtcctcgtccataccccgcgccgggctgccgctagccaggctgcagccacacgtcccgccgccggcaccggcgggggtggacgcttacgaggcggagaccgtcgccaggctgagctcgctccccggcgagatatccttcccttgcggcctcccctcgctccgcttcttcatcgacgacgcaaatcgaccaagggtgggcgycaaggtgattgcccggagaatcgccaaaggcaggcacagaatctcagtttagctagatccggctcgtagcagccctggatgttttctgtaacacagattcgtatcgtgttctttctatggttagcactctgctgaaggtgagccccgcgcaagcagcagtccatgtatggatttttattgtgaaactt

SEQ ID NO: 7533 - protein, 106 aa, Zea mays
  misc_feature: Ceres CLONE 354875-F
  misc_feature (90)..(90): Xaa is any aa, unknown, or other
MASAAKTLARVGSSLFGRILASPSSSIPRAGLPLARLQPHVPPPAPAGVDAYEAETVARLSSLPGEISFPCGLPSLRFFIDDANRPRVGXKVIARRIAKGRHRISV

SEQ ID NO: 7534 - DNA, 417 bp, Zea mays
  misc_feature: Ceres CLONE 354878-F
  misc_feature: Encodes the peptide sequence at SEQ ID NO. 7535
aatctcgttgcccgttgtgctctctctctctattcgttccccgcctcaccccgagccagccgtctcgctagggtttcgccgccgccgccgccgccgccgccgctatgcctcgccgcagctcaggaaggtctgccccacgcccagctacccgtgctgctccagtgaggaacccgccacagccagcacgccaggctcctcctccagctcctgttcgagatggtggtggctccatgtttggaggaattgggtccaccattgctcaaggtatggcgtttggcacgggtagtgccatggcacacagggctgttgatgctgtattaggtccccggaccattcagcatgagactgttgcctcagaagctgctgctgctgcccctgcccctccagtgatgaatgctgacgcttgcagcagcggcc

SEQ ID NO: 7535 - protein, 104 aa, Zea mays
  misc_feature: Ceres CLONE 354878-F
MPRRSSGRSAPRPATRAAPVRNPPQPARQAPPPAPVRDGGGSMFGGIGSTIAQGMAFGTGSAMAHRAVDAVLGPRTIQHETVASEAAAAAPAPPVMNADACSSG

SEQ ID NO: 7536 - DNA, 403 bp, Zea mays
  misc_feature: Ceres CLONE 354881-F
aaacccaaacctgcatacaattctgaagaaattcagaaaatccagctaagccaagttagtccgcccgccagctatgcggacatggttgcgagcggcctcaacctcctcctcctgacctcctcctcctcctccataaaatgcggaagaatctcgaagagtcccagacgcatcaaaccgccctcctctgtccctccctctcccgtctgccccctcgcatccccaaattaagccccgcgcgcaaggcagcaaacgcgccgcgcaccggaaggccccggggagctgcacgaggtggccccattgcggcatggctgctacggcgccgccgctggcgtcgagttcccgctcattggcgttgccgtggcacgctcatcgtgacggtccttgtcgcggccgtgatgcgccg

SEQ ID NO: 7537 - DNA, 506 bp, Zea mays
  misc_feature: Ceres CLONE 354884-F
  misc_feature: Encodes the peptide sequence at SEQ ID NO. 7538
gccgtccgcgccgcccaccccctcgaccgcgtccctcgctgctttgccctctccaccctccgccatcaccgccgcggcgtccttctgtaccggatccgtcgcagccaccgctccgcagatccgctgggttgacgtccagagagctgctccggggatgtcgtcctccgtttccagcgtcgagggcgacgccgccggagagttcacggaggtcgtaatcgtgcgtcacggcgagacgtcatggaacgcctcgcgcatcatacagggacacttggatgcagagcttaatgatattggaaggcagcaagctgttgcggttgctcatcgtctttctaaagaagtgaaaccagttgccatatactcttctgatctgaagcgagcagcagagactgcgcaaacaatcgcaagaatttgcaatgtgccaaatgtcgtgttcgatccagcactgagagaaagacacattggagatctgcaaggcatgacgcttcaaagatgctgctacagagagg

SEQ ID NO: 7538 - protein, 117 aa, Zea mays
  misc_feature: Ceres CLONE 354884-F
  misc_feature (18)..(113): Pfam Name: PGAM Pfam Description: Phosphoglycerate mutase family
  misc_feature: SWISSPROT Homolog: EC 5.4.2.1 Phosphoglycerate mutase
MSSSVSSVEGDAAGEFTEVVIVRHGETSWNASRIIQGHLDAELNDIGRQQAVAVAHRLSKEVKPVAIYSSDLKRAAETAQTIARICNVPNVVFDPALRERHIGDLQGMTLQRCCYRE

SEQ ID NO: 7539 - DNA, 500 bp, Zea mays
  misc_feature: Ceres CLONE 354885-F
  misc_feature: Encodes the peptide sequence at SEQ ID NO. 7540
gaatcaattcccacagcaccaccaaaccaataggcaggcagcaaacacaatccaataggcaacacccgcggcgacgcaagagggagaagcgagcgtgcagcggtcctcctctcgatccacatggccatggcggcagcggacggcaagagccggaggttcgcgctggcctgcggggtgctgagccagtacgtcaaggccgagcagcagcagatggcggccccgcgcgccccggccaccacgaccctgagcctgatgcccggcgcggacgtcggcgccgacgagcagcaggagccggccgccgcgagggccgaggagatgcccgggcccgcccccgcccccgccgcggcgccgccgctcaccatcttctacggcggcagggtggtggtgttcgaggacttcccggcggagaaggcggccgaggtcatgcgcctcgcggccggcgccgacctgcccatcgcccggaaggcgtcgctgcagcggtttctggccaagcgcaagga

SEQ ID NO: 7540 - protein, 126 aa, Zea mays
  misc_feature: Ceres CLONE 354885-F
MAMAAADGKSRRFALACGVLSQYVKAEQQQMAAPRAPATTTLSLMPGADVGADEQQEPAAARAEEMPGPAPAPAAAPPLTIFYGGRVVVFEDFPAEKAAEVMRLAAGADLPIARKASLQRFLAKRK

SEQ ID NO: 7541 - DNA, 449 bp, Zea mays
  misc_feature: Ceres CLONE 354894-F
  misc_feature: Encodes the peptide sequence at SEQ ID NO. 7542
  misc_feature (435)..(435): n is a, c, t, g, unknown, or other
actggagccctataggctatagccatcaccacactcgcctccctctctccctcccacactccaccacccgcgccgccgcctcctactccgccccggcccctctgatccggaccgagcgccggccatggcgctcgccttcgacgagttcgggcgccccttcatcatcctgcgggagcaggagaagaagacgcgccttagggggctcgacgcgcagaaggccaacatcgcctcggccaaggccgtcgcgcggatcctccgcacgtcgcttggacccaagggcatggacaagatgctccagtcccccgacggcgacgtcatcatcacaaatgatggagcgaccatcctggagcagatggatgttgacaaccagatagcaaagctgatggtggagctgtcccgtagtcaagactatgaaatcggggattggtaccaccnggggtggtagtcat

SEQ ID NO: 7542 - protein, 106 aa, Zea mays
  misc_feature: Ceres CLONE 354894-F
  misc_feature (104)..(104): Xaa is any aa, unknown, or other
MALAFDEFGRPFIILREQEKKTRLRGLDAQKANIASAKAVARILRTSLGPKGMDKMLQSPDGDVIITNDGATILEQMDVDNQIAKLMVELSRSQDYEIGDWYHXGW

SEQ ID NO: 7543 - DNA, 444 bp, Zea mays
  misc_feature: Ceres CLONE 354903-F
  misc_feature: Encodes the peptide sequence at SEQ ID NO. 7544
aaaaacgaaccaagccgctaaaaccctagacccccagccgaatggtcgccgtcctcctccgcgcgccgccatgctgctccgccgccttctgcactccacacgccacttccggcacggcctccggaccgtaactccggccaacaccaccaccaccacttcctcctcctccaccccccttccatttcgctgcttcccggacctccccctctctcgcgtcctctccccgcggctcctctccacctccggccgcgacgacgaccgcaacaagccgtggagcttcgaggcggactcgggcgatccggaccccttcgccaatgaggacgccgcggccgctggcgctgccgaggggccgccggtaggacccacgcgcgccgccgacgagctctgggcgacggagttcggcggggaggacggcgagaacggcgacgtgttcgaggggatcta

SEQ ID NO: 7544 - protein, 124 aa, Zea mays
  misc_feature: Ceres CLONE 354903-F
MLLRRLLHSTRHFRHGLRTVTPANTTTTTSSSSTPLPFRCFPDLPLSRVLSPRLLSTSGRDDDRNKPWSFEADSGDPDPFANEDAAAAGAAEGPPVGPTRAADELWATEFGGEDGENGDVFEGI

SEQ ID NO: 7545 - DNA, 475 bp, Zea mays
  misc_feature: Ceres CLONE 354906-F
  misc_feature: Encodes the peptide sequence at SEQ ID NO. 7546
atcgaacaccaatggcattcttgcattgaaggaaccttccctccacctccaccgcccgagagcgagcggccggacggggttttggttgggcatggctgccccggcgatgctccaagtggtgatcctcgccgcggtcctccttctcccgttcctcagcgtgccgggcgccgaggcacagaccaagaagttctgcctcacgcagttcgccatcgctagccaggcctgcgccatcctgccacccaccagtcctgagcaccaccaccatcatcacgatgacgaggacaatgacgaggacaacgacgaagatgaggacgaagacgaggacaacgatgaagatgaagacgaggacaatgggaaggttaaggccggtggcgcctacacaatgaacactgctagtgcggtcactgtgagaagcacaatccggcgcctgcgggagcagaccgaagcatgattgcgggcagcttgaaaaggagta

SEQ ID NO: 7546 - protein, 119 aa, Zea mays; identical to SEQ ID NO: 7336
  misc_feature: Ceres CLONE 354906-F

SEQ ID NO: 7547 - DNA, 304 bp, Zea mays
  misc_feature: Ceres CLONE 354928-F
  misc_feature: Encodes the peptide sequence at SEQ ID NO. 7548
gcaccaaagccctagctcggctcacttgctggccgccttctcctccgcggctcttaacgccgcatccactcgccggttcttaacgccgcccgccgtctcctccgcgtctcttccctcccgccgctgccgccgcccacccaggaatcaggatgcgggtgaagaagcggtcgaaacaccgcaaagcggtcaagttctacgccacatgcttcggcttccgcgagccctataaggtcctcatcgacggcaccttcgtccaccacctcctcacccagcgcctcctcccggccgacgaggctctccgaga

SEQ ID NO: 7548 - protein, 51 aa, Zea mays
  misc_feature: Ceres CLONE 354928-F
MRVKKRSKHRKAVKFYATCFGFREPYKVLIDGTFVHHLLTQRLLPADEALR

SEQ ID NO: 7549 - DNA, 267 bp, Zea mays
  misc_feature: Ceres CLONE 354954-F
  misc_feature: Encodes the peptide sequence at SEQ ID NO. 7550
tcctcctcatccaggcagcacagctccctccccactcgaggctccgagctttattttttcttgttttgttttgttttcttggtaggagtaacaatagtttctggcagccttcttcctcctcgctctctacccgaggagagaggagaggagagaaatccggaggcaaagcttcagggtttgtataaagggattctagatctaatcgactaaccagagagaaaaaaaaacaaaaaataacgcgagaaagcatgagccacttcgccgccg

SEQ ID NO: 7550 - protein, 69 aa, Zea mays
  misc_feature: Ceres CLONE 354954-F
SSSSRQHSSLPTRGSELYFFLFCFVFLVGVTIVSGSLLPPRSLPEERGEERNPEAKLQGLYKGILDLID

SEQ ID NO: 7551 - DNA, 211 bp, Zea mays
  misc_feature: Ceres CLONE 354998-F
  misc_feature: Encodes the peptide sequence at SEQ ID NO. 7552
agtgaagaaggtggtggccggaccgtkgtggcatcgccaattcaactccgcatctgaatcggcactcggcagcgcgccagctscatagtgtaggaggagatggcgctcacaagaatcggtcttgctggccttgcggtcatggggcagaaccttgccctcaacattgcagagaaagggttccccatctctgtgttcaacaggacaacctcca

SEQ ID NO: 7552 - protein, 37 aa, Zea mays
  misc_feature: Ceres CLONE 354998-F
  misc_feature: SWISSPROT Homolog: EC 1.1.1.44 Phosphogluconate dehydrogenase (decarboxylating)
MALTRIGLAGLAVMGQNLALNIAEKGFPISVFNRTTS

SEQ ID NO: 7553 - DNA, 477 bp, Zea mays
  misc_feature: Ceres CLONE 355048-F
  misc_feature: Encodes the peptide sequence at SEQ ID NO. 7554
cttccggaagcacttcccgaaaaaaggaagacagagaaggaaacggcagtgaagtcgccggcgccgccgcgacaggaggaaggagggagtagcagcggcaggggaggtccggcgatctcggctgctgtggcgcggtaagggaggaagcggagccgcgacaggatgcactcgtttgggcaccgcgccaacgcggtggcaacgtttgcggtcaccatactggccgcgatgtgcttcgccgcctccttctccgacaattttaacaccctgacacccaccgcatccgtcaagatcttgaatataaactggttccagaaggaggccaacggcaatgacgaggtcagcatgacgctgaacatttcggctgacctttcatctcttttcacgtggaacacaaaacaggtatttgtttttgtggcagcagagtatgaagactcgacaaaatgctttaaatcaagtttccctttgggatggcattat

SEQ ID NO: 7554 - protein, 105 aa, Zea mays
  misc_feature: Ceres CLONE 355048-F
  misc_feature (1)..(104): Pfam Name: SPC22 Pfam Description: Signal peptidase subunit
MHSFGHRANAVATFAVTILAAMCFAASFSDNFNTLTPTASVKILNINWFQKEANGNDEVSMTLNISADLSSLFTWNTKQVFVFVAAEYEDSTKCFKSSFPLGWHY

SEQ ID NO: 7555 - DNA, 424 bp, Zea mays
  misc_feature: Ceres CLONE 355089-F
  misc_feature: Encodes the peptide sequence at SEQ ID NO. 7556
aagaaccaacgtgctcaatctccatctcgaccgtcgctcaccgggaagctacgctacgacgaagcatggcgtccgtcaccgcccgcgccccggtcgcggccctgcgcccgtcggcgtctctcaagtcgtcgtcgtcgtcggcggcggccttccttggccactctatccgcctcggccgcactgctaccgcgtcgccgacgaggcgcagcctaaaggcggaggccaagggcgagtggctcccgggccttccctcccccgcctacctcgacggcagcctgccgggtgacaatggcttcgacccgttgggcctggcggaggacccggagaacctgaggtggtacgtgcaggcggagctggtgaacgggcggtgggcgatgctgggcgtggccgggatgctgatcccggaggtgctgaccaaggccgg

SEQ ID NO: 7556 - protein, 119 aa, Zea mays
  misc_feature: Ceres CLONE 355089-F
  misc_feature (62)..(119): Pfam Name: Chloroa_b-bind Pfam Description: Chlorophyll A-B binding protein
MASVTARAPVAALRPSASLKSSSSSAAAFLGHSIRLGRTATASPTRRSLKAEAKGEWLPGLPSPAYLDGSLPGDNGFDPLGLAEDPENLRWYVQAELVNGRWAMLGVAGMLIPEVLTKA

SEQ ID NO: 7557 - DNA, 478 bp, Zea mays
  misc_feature: Ceres CLONE 355097-F
  misc_feature: Encodes the peptide sequence at SEQ ID NO. 7558
aattttttcgctcagacatacagaattacagagtcgaagtgcgctgtggactctcccctccccaactccggcgaagggagcagaaacgttggcgtgttggttgggtggcgtcggcatggacgaggcaacgaagaagaatgtggaggctacggtgctggagatcctccggggctccgatatggagtccgtgacggagtacaaggtccgcgccgctgccagcgaccgcctcggcatcgacctctccatacccgaccgcaagctcttcgtccgcggcgtcgttgaggaatacctactttcactctcctccaaggaggaggcgaaggcggaggaggagggcgtcactgggctcgacgcggtcgccggcttcagcgagatcgtgccggacaccgtcgtgttcgatgatttcgagaggttcgcacccacggcggccacagtgagctcgtcgctgctgcttgggatcactgggctccagacacta

SEQ ID NO: 7558 - protein, 121 aa, Zea mays
  misc_feature: Ceres CLONE 355097-F
  misc_feature (5)..(60): Pfam Name: DEK_C Pfam Description: DEK C terminal domain
MDEATKKNVEATVLEILRGSDMESVTEYKVRAAASDRLGIDLSIPDRKLFVRGVVEEYLLSLSSKEEAKAEEEGVTGLDAVAGFSEIVPDTVVFDDFERFAPTAATVSSSLLLGITGLQTL

SEQ ID NO: 7559 - DNA, 439 bp, Zea mays
  misc_feature: Ceres CLONE 355261-F
  misc_feature: Translation starting site: 94
  misc_feature: SWISSPROT Homolog: EC 1.1.1.195 Cinnamyl-alcohol dehydrogenase
agttgcccgttgtgctctctctctttattcgttccccgcctcaccccgagccagccgtctcgctagggtttctccgccgccgccgccgccgccatgcctcgccgcagctcaggaaggtctgccccacgcccagctccccgtgctgctccagtgaggaacccgccacagccagcacgccaggctcctcctccagctcctgttcgagatggtggtggctccatgtttggaggaattgggtccaccattgctcaaggtatggcgtttggcgcggccaagggcgtccgtggagaagcgggagcaggtggcggcgatggaagagcaaggcggccaggcggcgctcggatgggcggccagggacgactccggcgtcctctccccctacagcttctccagaagggtcctaaagacgacgatgtcacgatcaaggtgctctactgcg

SEQ ID NO: 7560 - DNA, 708 bp, Zea mays
  misc_feature: Ceres CLONE 355274-R
ccgattgggtaccgggccccccctcgaggtcgacggtatcgataagcttttttttttttttttttgatttttttttatttttttttttttttttttttttttttttagaaccaaagagaccgtctcaccaacatggaacatttcacttcttcagccaaatcgttacatatctctagggttacaaaaaactatgagggggaatgcaaccctttcaaaggggtggccccgattgaacaccccaaaatttaatatgaatgaacctaataacccctaaacaatccgagaggagagagagagaaacagaggcctgaaaaaaagtttaaaccaaaagaggtgtacaacaagaagccccccacacaatccagggctgaatctcccccgggcgaccttcctatacgtcatatttctttggctgaagccattgcactagagttcttgacagggaaccgaaccacgatttgttaggagggtatgtcctcttgccggatagatgcttccctccaagaacagtgtacttcgaactgttccctccctcgatcttgcttattttcccgtccctcaagtagtaccggaagccaaaccacttgattgattgggagaaatgccaccggattggggaaactggatagaggaagttgcctaccaacccagcgatgaacccaaacccccagttggatgaaacaagagaaactttcggtccctcaggaa

SEQ ID NO: 7561 - DNA, 211 bp, Zea mays
  misc_feature: Ceres CLONE 355283-F
  misc_feature: Encodes the peptide sequence at SEQ ID NO. 7562
aactgcttcttgcggtagcgactagcaatcgacccaacttcccacccgcccccgcgtccgcgagctcgccgaagctaaggcctaagggtacccgccctcggcgctatgtcgctgtcgccggcggacagcgcggcgtactggctgcggtggcaggtcctcgtctgcggcgcgctcatcgcgctccccgcggcggccgcggcggcgctactgc

SEQ ID NO: 7562 - protein, 35 aa, Zea mays
  misc_feature: Ceres CLONE 355283-F
MSLSPADSAAYWLRWQVLVCGALIALPAAAAAALL

SEQ ID NO: 7563 - DNA, 476 bp, Zea mays
  misc_feature: Ceres CLONE 355287-F
tttcttccgctaccaccttcatccatcctggcgtcggtgtcttgccctgccccagcgccgccgctccttcccccaccccgaagcgccgcctcttctgcctccgtcgacggtggtggtgctcctgatccccgccgttgaactggccataggagagcaaagaggaaggggaggcgcgagggcgccagtagatatattcatcttcatctcggcttgcgatatttttgaattttctattccgtattgaaggcgtcgatggccttgtccgccctaatcagcaccctcctcgccgccgccatctggtgcgccgcttacctcgccgctgccatctcctccgccttctgattcccactccccaaccctaacctcccccctgtagcacaccccacctctagctttgtaggtcctactatacttgcaacctctcccgctgactcgcttcgatctacccgcctcgcgtcaccatggggtacgcgcag

SEQ ID NO: 7564 - DNA, 373 bp, Zea mays
  misc_feature: Ceres CLONE 355304-F
  misc_feature: Encodes the peptide sequence at SEQ ID NO. 7565
acctaaactcccagccgtctcctccgcatgcgaaaaccctagcagctccgcagtccctctcctctcgagatattcgcagttgaccgggtcctcggagcacgatgaagtttgttgctgcctacttgcttgctgtcctcgctgggaacgccagcccctccgctgaggatttgactgccattctggagtcagttggctgtgaagttgacaatgaaaggatggaactcctgctgtcccaactgagcggtaaggacatcaccgagctcattgccgcgggcagggagaagtttgcttcagtcccatgtggtggcggtggtgtcgctgttgcggcagcttcacctgctgctggcggagctgctcctacagctgaggcaaa

SEQ ID NO: 7565 - protein, 90 aa, Zea mays
  misc_feature: Ceres CLONE 355304-F
  misc_feature (17)..(90): Pfam Name: Ribosomal_60s Pfam Description: 60s Acidic ribosomal protein
MKFVAAYLLAVLAGNASPSAEDLTAILESVGCEVDNERMELLLSQLSGKDITELIAAGREKFASVPCGGGGVAVAAASPAAGGAAPTAEA

SEQ ID NO: 7566 - DNA, 507 bp, Zea mays
  misc_feature: Ceres CLONE 355316-F
  misc_feature: Encodes the peptide sequence at SEQ ID NO. 7567
ctaccgcaggccgcagcccagcaccggccgctctacgccggcacgtcctcgtttctgtccgaggtcatcgcctccgcaacttcgtggccggtgaggtcgcaccaccatggcgtcgctcctagcccggcaggcagcgcaggcgctccgcgcgaggcaaacggcgcagctcgggccggccgcgtcggcgatgcaagggcacctccgtacctacatgaacgcggggattcccaagcggttcaaagaggatgaggagaaagaacagcttgcaaaagatctcgcaaaagattggaatgctgtgtttgaaaggagcatcaatacattgtttttgactgaaatggtccgtggcttgatgctaactctcaagtacttctttgatagaaatgtcacaattaactatccgtttgagaagggtcctctgagcccccgcttccgtggtgagcacgctctcagacgttatgaatctggggaagagcgctgcattgcttgtaaactatgcgaagctatatg

SEQ ID NO: 7567 - protein, 133 aa, Zea mays; identical to SEQ ID NO: 7262
  misc_feature: Ceres CLONE 355316-F
  misc_feature: SWISSPROT Homolog: EC 1.6.5.3 NADH dehydrogenase (ubiquinone)

SEQ ID NO: 7568 - DNA, 524 bp, Zea mays
  misc_feature: Ceres CLONE 355324-F
  misc_feature: Encodes the peptide sequence at SEQ ID NO. 7569
aggcgcaataaggtgacctgagtcctgagccgcctcgagccgctctcgggctctcggcttcgaatcccgacaacctccctccccgaagctgcttagccgccggctgggcctcagacctgcgtcaagcttccggcggcagcccttcgagcatcacaatggcgtccggcggagcggccatctcggcggggcctacaccaccgtcggcgacgacggcgtcgtcggttgagtggcaccagcggccgccgaacccgaagaatcccgtggtgttcttcgacgtgaccatcgggtccatcgccgccggccgcatcaagatggagctcttcgccgacatcgcccccaagaccgcggagaacttccggcagttctgcactggggagcatagaaaaaatgctttgccacaaggttataagggctgccaattccatagagtgatcaaagatttcatgattcagggtggtgacttcttgaagaatgatggtactggatgcacatcaatctacggtaccaaaatttgatgatgaaaa

SEQ ID NO: 7569 - protein, 119 aa, Zea mays
  misc_feature: Ceres CLONE 355324-F
  misc_feature (36)..(120): Pfam Name: Pro_isomerase Pfam Description: Cyclophilin type peptidyl-prolyl cis-trans isomerase/CLD
  misc_feature: SWISSPROT Homolog: EC 5.2.1.8 Peptidylprolyl isomerase
MASGGAAISAGPTPPSATTASSVEWHQRPPNPKNPVVFFDVTIGSIAAGRIKMELFADIAPKTAENFRQFCTGEHRKNALPQGYKGCQFHRVIKDFMIQGGDFLKNDGTGCTSIYGTKI

SEQ ID NO: 7570 - DNA, 508 bp, Zea mays
  misc_feature: Ceres CLONE 355360-F
  misc_feature: Encodes the peptide sequence at SEQ ID NO. 7571
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggaggcgtccctgtcgtgcgtccgctcgtggggcggcgcgctctcgtccatcacccacctcgtgtacgtctcgtcgagcgagg

SEQ ID NO: 7571 - protein, 141 aa, Zea mays; identical to SEQ ID NO: 445
  misc_feature: Ceres CLONE 355360-F
  misc_feature (10)..(141): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase

SEQ ID NO: 7572 - DNA, 495 bp, Zea mays
  misc_feature: Ceres CLONE 355398-F
  misc_feature: Encodes the peptide sequence at SEQ ID NO. 7573
gtcatgttctttggcaaacacacacacacacacatcgtttgctgttgcaacaaagctctacacgggaagacaggctgcttctttcttgcagtctctggtccagaagcctgaagaaatggcgtcacccaacgtcacattcctcgccttcttcgtggccctcgcactattggcgcttcacaccaccgacgcagcagcggcggcggcagaaaccttgcgccataggagcgacacatggtgcgtggccaagccgtcgacgcaggaggcggcgctgcggggcaacctggagttcgcctgctccgagagcgactgcggcgccatccagggcaccggcggctgcgcccagcccgacagcctgctgtcacgggcgtcggtggccatgaacgcctactaccaggcccgggggaggaactcgtggaactgcttcttcaacggcaccgggcctaatcaccatcactgaccccagtgagtgcttccttgcttgctgtgagtgtctca

SEQ ID NO: 7573 - protein, 113 aa, Zea mays
  misc_feature: Ceres CLONE 355398-F
  misc_feature (39)..(111): Pfam Name: X8 Pfam Description: X8 domain
  misc_feature: SWISSPROT Homolog: EC 3.2.1.39 Glucan endo-1,3-beta-D-glucosidase
MASPNVTFLAFFVALALLALHTTDAAAAAAETLRHRSDTWCVAKPSTQEAALRGNLEFACSESDCGAIQGTGGCAQPDSLLSRASVAMNAYYQARGRNSWNCFFNGTGPNHHH

SEQ ID NO: 7574 - DNA, 479 bp, Zea mays
  misc_feature: Ceres CLONE 355549-F
  misc_feature: Encodes the peptide sequence at SEQ ID NO. 7575
acaccgagaatcacaatacgaaacgaattaatccccaatcaacacagcaagtcagcaacaagcaaagcagcgatccgagagatggacgcgaggatgttcgggctggagaaccccctggtggcggcgctgcatcacctgctggacgtgcccgatggcgacgccggagcgggcggcgacaaggcgggcggcggcgccacgcgcacctacgtccgcgacgcgcgcgccatggcggccaccccggccgacgtcaaggagctcgcgggagcgtacgcgttcgtggtggacatgccggggctgagcacgggcgacatcagggtgcaggtggaggacgagcgggttcttgtgatcagcggcgagcggcgccgggaggagcgcgaggacgccaagtacctgcgcatggagcggcggatggggcaagttcatgcgcaagttcgtgctgccggacaacgccgacgtggacaaggtcgccgccgtgtgca

SEQ ID NO: 7575 - protein, 132 aa, Zea mays
  misc_feature: Ceres CLONE 355549-F
  misc_feature (55)..(129): Pfam Name: HSP20 Pfam Description: Hsp20/alpha crystallin family
MDARMFGLENPLVAALHHLLDVPDGDAGAGGDKAGGGATRTYVRDARAMAATPADVKELAGAYAFVVDMPGLSTGDIRVQVEDERVLVISGERRREEREDAKYLRMERRMGQVHAQVRAAGQRRRGQGRRRV

SEQ ID NO: 7576 - DNA, 525 bp, Zea mays
  misc_feature: Ceres CLONE 355567-F
  misc_feature: Encodes the peptide sequence at SEQ ID NO. 7577
acagcgagtaccgagtaggagcaaccgcttgcgtcagacgcacactgacggagagtgatcactgatttctggtcatggcaaccgtaactgaggaagttgctccggtcgtcaccgtctccgaggagccggcgccggaagcggcgaaggaggtggtggagaagccggaggaggggaagaagcccgacgaggagggtgacgagaggaagaaggccgaccccgccgccgagaaggagaagaaggcgaggaagccgcggagcaggaagcccaagtccgccgggctgcaccacccgccctatttcgagatgatcaaggaggcgatcctgtcgcaggacggcgggaaggtcggggcgagcccgtacgcgatcgccaagcacatgggggagaagcaccgggacgtgctcccgcccaattaccgcaaggtgctggcagtgcagctattagtctgtggctcagcggtatgtgtgttgtactggctattaatttgctatactagaatactggaatacaataggaagctactaacct

SEQ ID NO: 7577 - protein, 150 aa, Zea mays
  misc_feature: Ceres CLONE 355567-F
MATVTEEVAPVVTVSEEPAPEAAKEVVEKPEEGKKPDEEGDERKKADPAAEKEKKARKPRSRKPKSAGLHHPPYFEMIKEAILSQDGGKVGASPYAIAKHMGEKHRDVLPPNYRKVLAVQLLVCGSAVCVLYWLLICYTRILEYNRKLLT

SEQ ID NO: 7578 - DNA, 410 bp, Zea mays
  misc_feature: Ceres CLONE 355568-F
  misc_feature: Encodes the peptide sequence at SEQ ID NO. 7579
ctttttttcgtggcacgactgggcgaccgccgctgtacgccagctgctcagatctcgtcgggccccttcgccggcgaccatcacctgttagggcaatgatgggaggctggggggtttcggatgggtacgagggatcaaagaggacacgaatgatgatggaatcgaatccctacttcgcagtgaacgcagggagtccattggatgtctcaaagaggtctaggattttgaaccaggcccgccctattttggggccatgggcagcaacactggtggtgccagtggtggcttctaccagcccttcaacagcagcaacttagctggtgcaggggctagcactggcatccaaaactttccaggtggtacggctgcgaggtctcccttttgattgcaatgacattgatatctgcaag

SEQ ID NO: 7579 - protein, 73 aa, Zea mays
  misc_feature: Ceres CLONE 355568-F
MMGGWGVSDGYEGSKRTRMMMESNPYFAVNAGSPLDVSKRSRILNQARPILGPWAATLVVPVVASTSPSTAAT

SEQ ID NO: 7580 - DNA, 512 bp, Zea mays
  misc_feature: Ceres CLONE 355575-F
  misc_feature: Encodes the peptide sequence at SEQ ID NO. 7581
atccggtcccaaaagtagaaaagggcaagcgacgagcacagcacagcacgccttccgttttgggaaggcgaggagaggggaaccccggggagagttgggggatcggcggcggaggagatggaggagcgggagaagctcgtgtgcctggccaagcttgccgagcaggcggagcggtacgacgatatggtggaattcatgaagaatcttgctaggatggacgtggatatgagtgctgaagaaaggcatttgttctcagttggtttcaagaacactattggagcaaagagagcatcatggagaatcatttgttcacatgagcaaaaggtcgcagctgatcgtcagactggtgtgatgatagatgcctataagaagaaagtagaagaggaactaaggaaggtttgcaatgaagtattgtcagtcattgctattcactgccttcccttggccagtacgggtgaaaatatcgtattctttttataagatgaaaggtgactactaccgttacttggctg

SEQ ID NO: 7581 - protein, 120 aa, Zea mays
  misc_feature: Ceres CLONE 355575-F
MEEREKLVCLAKLAEQAERYDDMVEFMKNLARMDVDMSAEERHLFSVGFKNTIGAKRASWRIICSHEQKVAADRQTGVMIDAYKKKVEEELRKVCNEVLSVIAIHCLPLASTGENIVFFL

SEQ ID NO: 7582 - DNA, 507 bp, Zea mays
  misc_feature: Ceres CLONE 355599-F
  misc_feature: Encodes the peptide sequence at SEQ ID NO. 7583
actcagacaccagacgcagtcggctgccgcagactggtagtagccggcgcgccgtcaccgtatcctcagatcagcggcgagcagaaaccacaccactctactgacgcccgacgagcagtgtaacattttccttcagccatgggtaaggagaagactcacatcaacattgtggtcattggccatgtcgactctggcaagtcgaccaccactggccacctgatctacaagcttggaggtattgacaagcgagtgattgagaggttcgagaaagaggccgccgagatgaacaagcggtcattcaagtatgcgtgggtgcttgacaagctcaaggctgagcgtgagagaggtattacaattgatattgccctgtggaagttcgagaccaccaagtactactgcactgttattgatgccccgggacaccgtgacttcatcaagaatatgatcactggcacttcccaagctgactgtgctgttcttatcatttgactcaaccactggtggttt

SEQ ID NO: 7583 - protein, 116 aa, Zea mays
  misc_feature: Ceres CLONE 355599-F
  misc_feature (5)..(117): Pfam Name: GTP_EFTU Pfam Description: Elongation factor Tu GTP binding domain
  misc_feature: SWISSPROT Homolog: EC 2.7.7.4 Sulfate adenylyltransferase
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLII

SEQ ID NO: 7584 - DNA, 506 bp, Zea mays
  misc_feature: Ceres CLONE 355600-F
  misc_feature: Encodes the peptide sequence at SEQ ID NO. 7585
aatctataaacagagtgagagactggtagcagccgcatgtgctagagctagacagaagtcagtctccttcccctctctctagtgctcgccggctctttccgtcgccatggacgtcctcctctgctgctgcctgctgcttctcctggcctccgccgcgtccgccggcagcgagcggtgcgtgcggcaggggaaggcggcctactcttcctcgctctctccggcccctcacggtagcagcagcggagcgtgcgggtacggcgccatggccgccgagatcaatgggggcttcctcgccgccggcgggcccaggcagcaccgcgggggcctcggctgcggccgctgtttccagatgagatgccgagacgcaaagctgtgcagcggcgggggagtgcgggtggtgctgaccgacttccacaagagcaaccgtacggacttcctgctcgccgggccggcgttcgcgggcctggccaagcccgggatggcccaggagttgaacaggcgagacg

SEQ ID NO: 7585 - protein, 133 aa, Zea mays
  misc_feature: Ceres CLONE 355600-F
  misc_feature (62)..(133): Pfam Name: DPBB_1 Pfam Description: Rare lipoprotein A (RlpA)-like double-psi beta-barrel
MDVLLCCCLLLLLASAASAGSERCVRQGKAAYSSSLSPAPHGSSSGACGYGAMAAEINGGFLAAGGPRQHRGGLGCGRCFQMRCRDAKLCSGGGVRVVLTDFHKSNRTDFLLAGPAFAGLAKPGMAQELNRRD

SEQ ID NO: 7586 - DNA, 440 bp, Zea mays
  misc_feature: Ceres CLONE 355638-F
gggttgtctttctccggcagatctctaacgagtagatgttctctcttcttttcttttcttcttttttttgaaagcttccctgtaacctgaaatcggctttacttaaatttcgagccaacttaatcttcttctttgccaattcttttttaaagaagaaagttgagagatgcctgtagttttttttttgggtgtgtttgtgactccagagtctgaaatcacaaatcagagctgtatagggagcaggtgatgactgagtgactgacaaacgtggggaagatggagacaaagaaacgcaagcctgtggtctactaaagacgggggcwtcgccatcgagggcaaacggaggccacaggattagcagcttctccgaactcccctctcgtgctgctgcgtctcctcctcatcgtcctctccagtgtccagctcggccatggcgttca

SEQ ID NO: 7587 - DNA, 483 bp, Zea mays
  misc_feature: Ceres CLONE 355661-F
  misc_feature: Encodes the peptide sequence at SEQ ID NO. 7588
acacaaccaagctcgatccatctcactctccgctggtcgctcactcttgcagctccacccttcactcagtcttagtctcttattagctctaggctctagctagccgcgccactccttcgtgtagccatcagccttctcatcgccaccaatggccactgccgaggtccagaccccgaccgtcgtggcggccgaggaagcgcccgtggtggagaccccgccgccggccgtcgtgcccgaggagtctgcccccgccgaggccgaggccgaggccgaggctgctgctcctgctgatcccgaggagcttcccgcggccgagcagcaggcagccgccgaggcggaggccgcggctcctgctggtgccgaggagcccgtcgcggccgaaccggccgccgaggcggaggctgctgctcctgctggtcccgaggagactcctgcggtcgagcaggaggcagccgccgaggaggaggctgctgctgctcctcc

SEQ ID NO: 7588 - protein, 111 aa, Zea mays
  misc_feature: Ceres CLONE 355661-F
MATAEVQTPTVVAAEEAPVVETPPPAVVPEESAPAEAEAEAEAAAPADPEELPAAEQQAAAEAEAAAPAGAEEPVAAEPAAEAEAAAPAGPEETPAVEQEAAAEEEAAAAP

SEQ ID NO: 7589 - DNA, 497 bp, Zea mays
  misc_feature: Ceres CLONE 355720-F
  misc_feature: Encodes the peptide sequence at SEQ ID NO. 7590
atacatgcctgcaacaaagcctttgttgtgtttgtgcaacagcagcagcacagacatttagctccagagtcgggactactagtagccaagatcacacaatttccaagaccaacgcgcttccaaattcccagcttctgcgcagtgtgcatgctctgcccgcttctctgattctgatctgagtctgagggagcaagcgcgactgcsacttcacaccttcctccagcgcggcgaagatgtcggtggcggtgtgcygtggcccagctgttcyggcgttcgaggcgccctgctggctgcgccctgctgagccgtacaggcagccggaggcggtcgtcgacgtcgaccggcctgcgcaggcggacatatggaacgccatccaggccgacgtgggcaaggtgggcgccggcgccaagaaggcgtccaagccgtacgtgcgggaccattcgtgcgcggtcgtcgatcctgatgagcwgaagagcctcgaggtctgcacggagagc

SEQ ID NO: 7590 - protein, 88 aa, Zea mays
  misc_feature: Ceres CLONE 355720-F
  misc_feature (7)..(7): Xaa is any aa, unknown, or other
  misc_feature (12)..(12): Xaa is any aa, unknown, or other
  misc_feature (79)..(79): Xaa is any aa, unknown, or other
MSVAVCXGPAVXAFEAPCWLRPAEPYRQPEAVVDVDRPAQADIWNAIQADVGKVGAGAKKASKPYVRDHSCAVVDPDEXKSLEVCTES

SEQ ID NO: 7591 - DNA, 466 bp, Zea mays
  misc_feature: Ceres CLONE 355761-F
  misc_feature: Translation starting site: 94
  misc_feature: SWISSPROT Homolog: EC 3.4.21.97 Assemblin
aaaatctcccaaagacgccgtcgccgctcttgttgtttccgatcccaaaccccaaacacgctccaccggcacctccgctcccacaccacaccgatggcccgcacgaagcagacggcgcgcaagtccaccggaggcaaggcgccgcggaagcagctggcgaccaaggcagcgcgcaagtcggccccggcaaccggcggcgtgaagaagccgcaccgcttccgcccgggcaccgtggcgctccgcgagatccgcaagtaccagaagagcacggagctgctcatccgcaagctccccttccagcgcctggtccgcgagatcgcgcaggacttcaagaccgacctccgcttccagtcctccgccgtcgccgcgctgcaggaggccgcggaggcctacctcgtcggcctcttcgaggacaccaacctctgcgccatccacgccaagcgcgtcaccatcatgcccaaggaca

SEQ ID NO: 7592 - DNA, 454 bp, Zea mays
  misc_feature: Ceres CLONE 355766-F
  misc_feature: Encodes the peptide sequence at SEQ ID NO. 7593
aaaaaaaaatcactgccaaatcccccagaaaatcaactcctccccaattccacgctgccaccaactcgccgtcctccgcgccaagcaccaaagctccgatggcccgcacgaagcagacggtgcgcaagtcgacgggcggcaaggcgccccgcaagcagctggcgaccaaggcggcgcgcaagtctgcgccggccaccggcggcgtgaagaagccccaccgcttccgccccggcaccgtcgcgctccgggagatccgcaagtaccagaagagcacggagctgctcatccgcaagttgcccttccagcgcctcgtccgtgagatcgcgcaggacttcaagaccgatctccgcttccagtcctccgccgtcgcgcgctgcaggaggccgccgaggctaccttgtggggctctttgaggacactaacctctgtgccatccacgccaagcgcgtcacca

SEQ ID NO: 7593 - protein, 104 aa, Zea mays
  misc_feature: Ceres CLONE 355766-F
MARTKQTVRKSTGGKAPRKQLATKAARKSAPATGGVKKPHRFRPGTVALREIRKYQKSTELLIRKLPFQRLVREIAQDFKTDLRFQSSAVARCRRPPRLPCGAL

SEQ ID NO: 7594 - DNA, 442 bp, Zea mays
  misc_feature: Ceres CLONE 355781-F
  misc_feature: Encodes the peptide sequence at SEQ ID NO. 7595
acacaaccaagctcgatcgatctcactctcagctggtcgctcactcttgcagctccacccttaatcactcagtcttagggtcttagctctaggctctagctagccgcgccactccttcgtgtagccatcagccttctcatcgccaccaatggccactgccgaggtccagaccccgaccgtcgtggcggccgaggaagcgcccgtggtggagaccccgccgccggccgtcgtgcccgaggagtctgcccccgccgaggccgaggctgaggctgaggctgaggctgctgctcctgctgctcccgaggagcttccggcggccgagcagcaggcagccgccgagccggaggccgctgctcctgctggtgccgakgagcccgccgcggcgaaccggccgccgaggcggaggctgctgctcctgctggtcccgaggagactcccgcgg

SEQ ID NO: 7595 - protein, 98 aa, Zea mays
  misc_feature: Ceres CLONE 355781-F
  misc_feature (74)..(74): Xaa is any aa, unknown, or other
MATAEVQTPTVVAAEEAPVVETPPPAVVPEESAPAEAEAEAEAEAAAPAAPEELPAAEQQAAAEPEAAAPAGAXEPAAANRPPRRRLLLLLVPRRLPR

SEQ ID NO: 7596 - DNA, 375 bp, Zea mays
  misc_feature: Ceres CLONE 355788-F
  misc_feature: Encodes the peptide sequence at SEQ ID NO. 7597
attattcttccagcagtcgttcgcccaaatccattgctgctcctgcccccaacggcgcatgccctcacctcctcagccatggagctcacgagcatctccctctacgcaccccctccgcgcgtccctgctccctcgtcaccaggtgcacgcgcgcaacttcctgcgcgccgggatggccctccagccccagctcgcccctgccctcagccatggcgcctggccgccgccgcccctgctttccatggcggcacttcctgcttcctggtggtcggcgccctccccaacctctctgctggtggttgtctccatcccctccatggcgagcttgcccctgcattcctgctcgcccaagatccccttccctgttccagccac

SEQ ID NO: 7597 - protein, 55 aa, Zea mays
  misc_feature: Ceres CLONE 355788-F
MAPGRRRPCFPWRHFLLPGGRRPPQPLCWWLSPSPPWRACPCIPARPRSPSLFQP

SEQ ID NO: 7598 - DNA, 424 bp, Zea mays
  misc_feature: Ceres CLONE 355862-F
  misc_feature: Encodes the peptide sequence at SEQ ID NO. 7599
attcgcaccaccgccgcgccgcccaaaccctagccgccgccgccgtcgccgccatggtcgccgtgaaccgccctctcgtctccgtgaaggccctagagggagacatggtaaccgacgcccccggcatcgccttaccgcccgtcttcggggcgccgatccgccccgacgtggtcaggttcacccacaagctgctgtcctgcaacaagcgccagccctacgcagtctcccgccgcgccggccaccagacgtcggccgagtcctggggtaccggccgcgccgtgtctcgtatcccccgcgtccccggcggcggcacccaccgcgccggctagggagcgttcggcaacatgtgccgcggcgggcgcatgttcgcgcccaccaagatctggcgcaagtggcacckgccgcgtctacatcaacctccgcc

SEQ ID NO: 7599 - protein, 91 aa, Zea mays
  misc_feature: Ceres CLONE 355862-F
MVAVNRPLVSVKALEGDMVTDAPGIALPPVFGAPIRPDVVRFTHKLLSCNKRQPYAVSRRAGHQTSAESWGTGRAVSRIPRVPGGGTHRAG

SEQ ID NO: 7600 - DNA, 255 bp, Zea mays
  misc_feature: Ceres CLONE 355908-F
atctagtaatccgtccgcaaccgttctctgccttctccatcctaaaccctcctagtcctctccatccccatcccctccaatggcggcgactgcacgtccttcgccactctcgccgtcgcgcgctcggcggggcatcggtccctccttgcctccaaggccgccccctcgccgctcctctccctccgcggcgcccgcctcccctcgcagggcgtctccttatctgggggcctcgcggcgtcgccctctcatagccgc

SEQ ID NO: 7601 - DNA, 421 bp, Zea mays
  misc_feature: Ceres CLONE 355966-F
  misc_feature: Encodes the peptide sequence at SEQ ID NO. 7602
aaatctcgttgcccgttgtgctctctctctctattcgttccccgcctcaccccgagccagccgtctcgctagggtttcgccgccgccgccgccgccgccgccgctatgcctcgccgcagctcaggaaggtctgccccacgcccagctacccgtgctgctccagtgaggaacccgccacagccagcacgccaggctcctcctccagctcctgttcgagatggtggtggctccatgtttggaggaattgggtccaccattgctcaaggtatggcgtttggcacgggtagtgccatggcacacagggctgttgatgctgtattaggtccccggaccattcagcatgagactgttgcctcagaagctgctgctgctgctacggcggtggcggcggcggtggtggtggcggctgctacaactgcgg

SEQ ID NO: 7602 - protein, 105 aa, Zea mays
  misc_feature: Ceres CLONE 355966-F
MPRRSSGRSAPRPATRAAPVRNPPQPARQAPPPAPVRDGGGSMFGGIGSTIAQGMAFGTGSAMAHRAVDAVLGPRTIQHETVASEAAAAATAVAAAVVVAAATTA

SEQ ID NO: 7603 - DNA, 489 bp, Zea mays
  misc_feature: Ceres CLONE 355984-F
  misc_feature: Encodes the peptide sequence at SEQ ID NO. 7604
gtctcaatcccacgccacatcctcccctccttcctccttgggttcccagcccgtgcgcccgcctgtcgcagtcgcaccgcagccgccggccatggcctgcctcaccgacctcgtcaacctcaacctctcggacaccacagagaagatcatcgccgagtacatatggatcggtggatctggcatggatctcaggagcaaagccaggaccctcccgggcccggtgaccgatcccagcaagctgcccaagtggaactacgacggctccagcaccggccaggcccccggcgaggacagcgaggtcatcctgtacccgcaggccatcttcaaggacccattcaggaggggcaacaacatccttgtcatgtgcgattgctacaccccagctggcgagccaattcccaccaacaagaggtacagcgccgccaagatcttcagcagccttgaggtcgctgccgaggagccctggtatggtatcgagcaggagtacac

SEQ ID NO: 7604 - protein, 132 aa, Zea mays
  misc_feature: Ceres CLONE 355984-F
  misc_feature (17)..(97): Pfam Name: Gln-synt_N Pfam Description: Glutamine synthetase, beta-Grasp domain
  misc_feature: SWISSPROT Homolog: EC 6.3.1.2 Glutamate--ammonia ligase
MACLTDLVNLNLSDTTEKIIAEYIWIGGSGMDLRSKARTLPGPVTDPSKLPKWNYDGSSTGQAPGEDSEVILYPQAIFKDPFRRGNNILVMCDCYTPAGEPIPTNKRYSAAKIFSSLEVAAEEPWYGIEQEY

SEQ ID NO: 7605 - DNA, 648 bp, Zea mays
  misc_feature: Ceres CLONE 355998-R
cgattgggtaccgggccccccctcgaggtcgacggtatcgataagcttttttttttttttttttgttctctgaaacatcagactaccgagagttcctagcttcacattcttcttgggccaaaaagtcgaactcacttcaacagaaacattttctcctagaggctaagatgcctactatcggaactgccagaaaaacggaccctcgctataacctctaccaatctaccatcaccactaaaccactgcagaagtgaaacattccaaaccaaacgtcgtcagacaacagactaccactacaatccctatgtcatcatcgtcgctgtagaagtgaacgtgccagcaccagtcgtcatcagaaagcttgtcgcttcagcctgtccatcagaaggtgcgcaactgactcgtatccttgctcccttgcatatatatatggcaatcccagtcggtggtatcttccgcttcttcaagcagaaggagctgttgcatatccagaatttcttgatacccttctcctcaacgcagtgagggcacagccagttcttgttcttccgcacctcttccatctcttcgccgtacctaactttcaggcaaccacggcagagtatcccattagaagaatggcaagatgagcactccgtctttcctaag

SEQ ID NO: 7606 - DNA, 457 bp, Zea mays
  misc_feature: Ceres CLONE 356014-F
  misc_feature: Translation starting site: 113
  misc_feature: SWISSPROT Homolog: EC 5.2.1.8 Peptidylprolyl isomerase
gtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacggcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggctacggcggtggcggcggcggctacggtggcggcggcggctacggtggtggtggcggcggctacggcggtggc

SEQ ID NO: 7607 - DNA, 489 bp, Zea mays
  misc_feature: Ceres CLONE 356028-F
tttcttccgctaccaccttcatccatcctggcgtcggtgtcttgccctgccccagcgccgcygctccttcccccaccccgaagcgccgcctcttctgcctccgtcgacggtggtggtgctcctgatccccgccgttgaactggccataggagagcaaagaggaaggggaggccgcgagggcgcagtagatatattcatcttcatctcggcttgcgatatttttgaattttctattccgtattgaaggcgtcgatggccttgtccgccctaatcagcaccctcctcgccgccgccatctggtgcgccgcttacctcgccgctgcatctcctccgccttctgattcccactccccaaccctaacctcccccctgtagcacaccccacctctagctttgtaggtcctactatacttgcaacytctcccgctgactcgcttcgatctacccgccctcgcgtcaccatggggtacgcgcagctcgtcatcggcc

SEQ ID NO: 7608 - DNA, 1048 bp, Zea mays
  misc_feature: Ceres CLONE 356055
  misc_feature: Encodes the peptide sequence at SEQ ID NO. 7609
agtgctcacacacgcgccgaaacaccagttctctagagcagcgccgttcgtccattcgcccacgcacgccgcgtgatccgatcgcgtagggctagctccatcgatccgctaccgctacaatggcaatgtcgtacaccaccctccactacttcgccgtctcctgcgccctcctcgtggcatcggtgtcgtcgctgccgccgccggcggtgttccaagtcggcgacgagcgcgggtggacggtgccggcgaacggcaccgagacgtacaaccactgggccaagaggaaccggttccaggtcggcgacgtcctggacttcaagtacggcgccaacgactcggtgctgctggtggcgcacgacgactacaagcagtgcagcacggagacgccgctgggccggttcaccggcggcgacaccaagttcgggctcgaccgctacggccccgtctacttcgtcagcggcgtcgcaggccactgcgaggcgggacagcggatgatcgtgcgggtcatcaggcccggcgcctccgcaccgcgcggcgcctccgcaccgcgcggcgcccctgtggcgtcgccggcgacgccgccaaccgcgagtggcagtggcagatcaggcgcgcccagcccggccacctcgccggccggctcgggttccggctccggttccagttccacttctccgagcccgagcccgagcccgctgccgcaggccagcgatgcgtctaggcgcgtgctcgtgtcgtccgttgcagttgggcttgtgctcttggttgcctgtgccatcaccctgtcgtccgtggtggcttgattgaacttagaagtctgttttctgctttcatgtacttagagtgccgtcagtttaggaagtaatgttagcttgtcgagatctaggaggtatacgcgtgtcggttagcaatggttgggccactgggccgagtcgcatgcttgttatgttaaagacttggtaatttcaataaatggagatcaggtgttcttgccaaaaaaaaaaaaaaaaattatcaatttttatgagctataaaaaaaaaaaaaaaa

SEQ ID NO: 7609 - protein, 227 aa, Zea mays
  misc_feature: Ceres CLONE 356055
  misc_feature (39)..(123): Pfam Name: Cu_bind_like Pfam Description: Plastocyanin-like domain
MAMSYTTLHYFAVSCALLVASVSSLPPPAVFQVGDERGWTVPANGTETYNHWAKRNRFQVGDVLDFKYGANDSVLLVAHDDYKQCSTETPLGRFTGGDTKFGLDRYGPVYFVSGVAGHCEAGQRMIVRVIRPGASAPRGASAPRGAPVASPATPPTASGSGRSGAPSPATSPAGSGSGSGSSSTSPSPSPSPLPQASDASRRVLVSSVAVGLVLLVACAITLSSVVA

SEQ ID NO: 7610 - DNA, 466 bp, Zea mays
  misc_feature: Ceres CLONE 356083-F
  misc_feature: Encodes the peptide sequence at SEQ ID NO. 7611
gtcccataaataggccagcatttgcaatccaactttagctgccatctgtttctgaaccatggatccatttgttctctccatcctcttatgctcatcgatctttgttgtagtgtactggagaaggctgaacagcatgaggctaagacttccaccgggacctccaacatggccaattttcggcaatcttctccagttgagccctcttccccacaaagactttgcccaattttgcaccaaatatggccctctcgtctatcttcgcctgggaaccatcgatgccatcaccactgatgaccccgaagtgatccgtgaaatactcatccggcaagatgaggtctttgcttcgcggcctcggacactggctgccgtccatctcgcctatgggtgtggtgatgttggctctagctccactgggacccaactggaaaaggatgaggagagtttgcatggagcacttgctgacgac

SEQ ID NO: 7611 - protein, 136 aa, Zea mays
  misc_feature: Ceres CLONE 356083-F
  misc_feature: SWISSPROT Homolog: EC 1.14.13.21 Flavonoid 3'-monooxygenase
MDPFVLSILLCSSIFVVVYWRRLNSMRLRLPPGPPTWPIFGNLLQLSPLPHKDFAQFCTKYGPLVYLRLGTIDAITTDDPEVIREILIRQDEVFASRPRTLAAVHLAYGCGDVGSSSTGTQLEKDEESLHGALADD

SEQ ID NO: 7612 - DNA, 493 bp, Zea mays
  misc_feature: Ceres CLONE 356092-F
  misc_feature: Encodes the peptide sequence at SEQ ID NO. 7613
atcccatatcgccaagtccccttcgtcgtccccttccctcgcctcgcgttaggtagcctgcttccgacccgcacatctccctccggttctcgccatgggcgccggcgccaacaaccacgaggagtcgagccccctcatcccagctgcggttgccgcccccgcggacgagaagcccccgcaggctccggcgccggaggccgccaattactatgccgacggggtcccggtcgtgatgggcgagcccgtgtcggcccacgccttcggcggcgtcccgcgggagagctggaactccgggatcctctcctgcctcggccgcaacgacgagttctgcagcagcgacgtcgaagtgtgtcttcttggaacggtagcaccatgtgtgctctatggtagcaatgttgagaggcttgctgctggacaaggcacatttgcaaacagctgtttgccttacactgggctgtattttgcttgggaactctctctttgggtggaactg

SEQ ID NO: 7613 - protein, 133 aa, Zea mays
  misc_feature: Ceres CLONE 356092-F
MGAGANNHEESSPLIPAAVAAPADEKPPQAPAPEAANYYADGVPVVMGEPVSAHAFGGVPRESWNSGILSCLGRNDEFCSSDVEVCLLGTVAPCVLYGSNVERLAAGQGTFANSCLPYTGLYFAWELSLWVEL

SEQ ID NO: 7614 - DNA, 683 bp, Zea mays
  misc_feature: Ceres CLONE 356136
  misc_feature: Encodes the peptide sequence at SEQ ID NO. 7615
aaaaacctcctgcagtcgttttcacctcctccctctctcacggcggcttttctggcgacggcggcggcggcgacgacgagcagccacctggggaagagcaggtagcaggaaatggcggcgttcctgagtcagcaaatcagaacattcatccagatgaggactaacctgaaggtggtcgataactccggggccaagcgggtgatgtgcatccagtccctgagggggaagaaaggagcaaggctcggggacatgatcatcggatccgtaaaggaggcccagcctcgtggcaaggtcaagaaaggagacgtagtctacggcgtggtcgtccgtgccgccatgaagaaaggacgcagcgacggcagcgaggtccagttcgacgacaacgcggtggtcctcgtgaacaagaagggcgagctgattggcacccgcgtctttggccccgtcccccacgagctgaggaagaagaagcacctcaagatcctggccctggctgaacacattgtttgaggtgtgtcgcatagccaagtgtttgtgggaatgttttttttgtgtgttctctgtttgaataatgcattgtgaaacgatagcatggaccgtttgaactattttgatgacattgctcgtccatttggatggccaatacgtgtcgtgatcgattctggagtccaaaaaaaaaaaaaaaa

SEQ ID NO: 7615 - protein, 131 aa, Zea mays
  misc_feature: Ceres CLONE 356136
  misc_feature (13)..(131): Pfam Name: Ribosomal_L14 Pfam Description: Ribosomal protein L14p/L23e
MAAFLSQQIRTFIQMRTNLKVVDNSGAKRVMCIQSLRGKKGARLGDMIIGSVKEAQPRGKVKKGDVVYGVVVRAAMKKGRSDGSEVQFDDNAVVLVNKKGELIGTRVFGPVPHELRKKKHLKILALAEHIV

SEQ ID NO: 7616 - DNA, 482 bp, Zea mays
  misc_feature: Ceres CLONE 356149-F
  misc_feature: Encodes the peptide sequence at SEQ ID NO. 7617
atcaaacaaaagcgtcgttctctcttcctggtccaagtgatcttgccaagttacgagcagcaagcagagatcagatcatccatcggcaatgtcgaacatcgggcagtccttccaggccggcaaggcggaggcccagggcgagtaccaggcggagcacgcggcgcagtgcgtcaaggacaccgccggagccgcggccgacagcgcgcagctgcagcagcaccgcgccaccggcaccgttgagcaggtggcgcagacgggccagggcgtggcggcaggcgtcaaggacacggtggcgggcgcggcggttggcgtcaccaacacggtggcgggcgtggcggcgggcgtcacgaactggacctccgccaaccgccgctccgtcaacctcagggggtacacgccgtccttcgccgcgctggacgacaccgccgcggcggtcccggcgcccaggaaggtgcaggcggtgatggacgacgccgagctgc

SEQ ID NO: 7617 - protein, 131 aa, Zea mays
  misc_feature: Ceres CLONE 356149-F
MSNIGQSFQAGKAEAQGEYQAEHAAQCVKDTAGAAADSAQLQQHRATGTVEQVAQTGQGVAAGVKDTVAGAAVGVTNTVAGVAAGVTNWTSANRRSVNLRGYTPSFAALDDTAAAVPAPRKVQAVMDDAEL

SEQ ID NO: 7618 - DNA, 469 bp, Zea mays
  misc_feature: Ceres CLONE 356169-F
  misc_feature: Encodes the peptide sequence at SEQ ID NO. 7619
acggcataccacactagagccgccgccgccgcgtttcgcgcaccgtaccctagccctcgtcagcggcggcttcgagctsatccagccatgacgttcaagcggaggaatggcggacgcaacaagcacgggcgcggccacgtcaagtacatccgctgctccaactgcgccaagtgctgccccaaggataaggctatcaagcggttcttggtgaggaacattgttgagcaggctgccgtgagagatgtgcaggaggcctgtgtacatgatggatatgttctacccaaattgtatgcaaaggttcatcactgtgtctcatgtgcaatccatgcgcacattgtccgggtccgctctcgtgagaacaggaggaaccgtgagcccccgcagcgcttcagacgccgggatgatggcccaaggcctggtcagggcccgccgcgcccaggcggtgcagctcctgcagctgcagctgctg

SEQ ID NO: 7619 - protein, 127 aa, Zea mays
  misc_feature: Ceres CLONE 356169-F
  misc_feature (1)..(114): Pfam Name: Ribosomal_S26e Pfam Description: Ribosomal protein S26e
MTFKRRNGGRNKHGRGHVKYIRCSNCAKCCPKDKAIKRFLVRNIVEQAAVRDVQEACVHDGYVLPKLYAKVHHCVSCAIHAHIVRVRSRENRRNREPPQRFRRRDDGPRPGQGPPRPGGAAPAAAAA

SEQ ID NO: 7620 - DNA, 446 bp, Zea mays
  misc_feature: Ceres CLONE 356197-F
  misc_feature: Encodes the peptide sequence at SEQ ID NO. 7621
attcgctcccacggtccagactccacagtccacactccccgcatctggcgacattgtgtgctcggcagtctcggactcggagtgagagcgaccaacaagagggaggaaatgatggagaagcgacacggcggcggaggttgcaccctgctccacctcctcggcaccgccgccgccatggcgttcctgctgccgcggtccgccggagctgccaacgacgccaagtggcacgcccatgcccatccggtcgccggcgccggcctctcgccgctctcggcaccgccgcccaccgcgggagccgacgacgacttgctgccgccgccgagccgcgcgcccgtggagaaggccgccccgcacttcggcttccctctgcagccgggcgacgcgtccgcggcggccccgtccggaagcgaggggtacccgtttatcggcagcaacccgacggtgcc

SEQ ID NO: 7621 - protein, 111 aa, Zea mays
  misc_feature: Ceres CLONE 356197-F
MEKRHGGGGCTLLHLLGTAAAMAFLLPRSAGAANDAKWHAHAHPVAGAGLSPLSAPPPTAGADDDLLPPPSRAPVEKAAPHFGFPLQPGDASAAAPSGSEGYPFIGSNPTV

SEQ ID NO: 7622 - DNA, 500 bp, Zea mays
  misc_feature: Ceres CLONE 356224-F
  misc_feature: Encodes the peptide sequence at SEQ ID NO. 7623
agttcatccctcacctcatctaaccaagctcccgagagcagagagctgagagagggagagaaaaagtaatccgacggaaacgacaagggcgcggcgagggcggggacgggaaggccctgggcgcggaggcgccgagcacatggcatcgtcgagggtgataccgtcgtcctcgccgtcgcacacggcctcggatctcgcgcgcctagcgcaggccgccagcaggcccggcggcgggggcagcgggccgggctccatgaacgtcgaggagctcctccgcggcatctacagcgacatgcccaccccggcgccgcccgcgtcggaacccggacacccgatgcccccggccccggcgccggtgagcgccacgcgtaagacggcggaggaggtgtggaaggagatcactggcggaggtggcagtggggaagccgtggctcccgtggcggctcaggctgtcgctcccgatggtggcgctggcacaggcggcccggaggtgacgctgg

SEQ ID NO: 7623 - protein, 120 aa, Zea mays
  misc_feature: Ceres CLONE 356224-F
MASSRVIPSSSPSHTASDLARLAQAASRPGGGGSGPGSMNVEELLRGIYSDMPTPAPPASEPGHPMPPAPAPVSATRKTAEEVWKEITGGGGSGEAVAPVAAQAVAPDGGAGTGGPEVTL

SEQ ID NO: 7624 - DNA, 498 bp, Zea mays
  misc_feature: Ceres CLONE 356225-F
  misc_feature: Encodes the peptide sequence at SEQ ID NO. 7625
agggtgggcgaccagtctcctccgcacgcttcccaccgagctcacacactgcacactcccacactcccactcggccactcccacctgtaggttcacgggaggcgaggaccttgcccccctgcattcttcccgtatcgcggaccgatcctcgccgcgggaggcgagcggagcggggcgtttctgcgggggagaagcgcgtccctgcaatttctgagagaggggaggcggcgagtggaaaagagcagacgttgctatcctatcttgctgacacagcggcggtgtggcgaggcgcatggcgagggcgcgcggtggcgccgcgtggtgggtgctggcagcggcgtgggtgctgtgggcggcggcggctgcggcggargcagaggccaggtcgccgtcggcgaggagggtgcaccggcacctcaagcgcctcaacaagccggccgtcaagagcatcgagagtccagatggagacatcatcgactgcgtgcatatytccaccag

SEQ ID NO: 7625 - protein, 68 aa, Zea mays
  misc_feature: Ceres CLONE 356225-F
MARARGGAAWWVLAAAWVLWAAAAAAEAEARSPSARRVHRHLKRLNKPAVKSIESPDGDIIDCVHIST

SEQ ID NO: 7626 - DNA, 463 bp, Zea mays
  misc_feature: Ceres CLONE 356229-F
  misc_feature: Encodes the peptide sequence at SEQ ID NO. 7627
aaaaaatcgagctgcccgcgcgcggcagttaagctcacacatcagctagctcaccttggacggccgaccaggtacgttgcgagcgatggcgggatacaaagcgtcgggcggcacggcgctcggcgtcgtcctggctgttgccgcgctcctcgccgcggcggcgatggcggtggacgacgagcacatgtaccactggaagtgcttcaactcgtgcacggggaagtgccgcgacgaggacgcctttgacgacggccaccgttccggggattcgaacgtctcttccgtcgtctctggcggcaagtgcaacaacaggtgcctcagcgagtgcttcgaggacctgccggccatctgctaccaccagtgcgtcgtcagcaagtgcctctgcttcccaccctttagcaaagagaaaacgatgtgcatgaagagctgctgcaacaagtgcttccaccacggcccgccagcg

SEQ ID NO: 7627 - protein, 126 aa, Zea mays
  misc_feature: Ceres CLONE 356229-F
MAGYKASGGTALGVVLAVAALLAAAAMAVDDEHMYHWKCFNSCTGKCRDEDAFDDGHRSGDSNVSSVVSGGKCNNRCLSECFEDLPAICYHQCVVSKCLCFPPFSKEKTMCMKSCCNKCFHHGPPA

SEQ ID NO: 7628 - DNA, 479 bp, Zea mays
  misc_feature: Ceres CLONE 356276-F
ataccaccagggagtaaaggttaggatgttgttgtcgtgcttgaacctggaagcatgctccaccgggacctgggttcggtcgagcaacaactagtccgctaatgacgccagtcgccggctgctgttcggaggctagcaaaagggcgagagggtttgctagtacgtacagagcgtgcgcgagtaagtggctgggagcccgccgttgtcaagagagaagttgcgaggggcagaggatcatggcgctagaacttgtcgatgcgcagggagttcgccgaagggcgttaaagagcaccgaagccttggcgagtttcctccatactccgaaatttgtcgtcgtgccgttacagcgtgggtcgacgtcactgcggtctcgttgccggtcaagaacaggtaccgcaggatgaggcgcatggaggatgctgtggcgagttcgcgagaggtctaggtcgtcgtctcccagtcaactttgggttgctgga

SEQ ID NO: 7629 - DNA, 514 bp, Zea mays
  misc_feature: Ceres CLONE 356295-F
  misc_feature: Encodes the peptide sequence at SEQ ID NO. 7630
attccacctgcttggtccatcagcagcgagcgaacagggaaaaaggagaggccgagaagcgctttagcgataagactggtgcacccgtagcggcacggcatggcggccacggcgtactccgtggcgctcctcggcggcgcacgcctgccggccgccctcctccctcggcgcagcagcgtgtgccaccagcagcttcgcctccaagacgcgccgaggctctccctgcaccgtgccagggccgcttccgaggacacgtcggcctccggcggcgacgagctcatcgaagacctcaaggcaaagtgggacgccgttgaggacaagcccaccgtcctcctgtacggcggcggcgccgtcgtggcgctatggttgacgtccgttgttgtcggcgccatcaacgccgtgccgctgctccccaagatcctggagctcgtcggcctcggctacaccggctggttcgtgtaccgctacctcctcttcaagcaaagcaggaaagagctggtcgacgacattgaga

SEQ ID NO: 7630 - protein, 138 aa, Zea mays
  misc_feature: Ceres CLONE 356295-F
  misc_feature: SWISSPROT Homolog: EC 6.1.1.9 Valine--tRNA ligase
MAATAYSVALLGGARLPAALLPRRSSVCHQQLRLQDAPRLSLHRARAASEDTSASGGDELIEDLKAKWDAVEDKPTVLLYGGGAVVALWLTSVVVGAINAVPLLPKILELVGLGYTGWFVYRYLLFKQSRKELVDDIE

SEQ ID NO: 7631 - DNA, 502 bp, Zea mays
  misc_feature: Ceres CLONE 356345-F
  misc_feature: Encodes the peptide sequence at SEQ ID NO. 7632
gttccagcacgtactcaccgcaccccccgacggcccgacacgtccgtgctggcttgtacttgcacgccacaccaccacccagcccccaacgatgacggcggcggcggcaccggcaccggcggtcgctagcagggtgtgggagtgggagggsaaggtggcgtcggcggtggccgaggcgacggcggacgaggcgtgggcgctgctgtcggacttcctggcgttccaccggtggcacccgcgtgtggccgcgtgccgcctcgcgtccggcaccccgcgcgcgccgggctgcgtgcgctactgcgagggcaccgccgccgccgacggcgagccggcgcccgactgggcgcacgagacgctgctggagcacgacgcggagcgccgcttcttccgctacgagatgaacgacaacaacatgggcttcggcctcttcttcgccacgttccgcgtcgtcccggccgccgccgccggcgggtgcgagctgcgctgggagttcgagtgcgag

SEQ ID NO: 7632 - protein, 137 aa, Zea mays
  misc_feature: Ceres CLONE 356345-F
MTAAAAPAPAVASRVWEWEGKVASAVAEATADEAWALLSDFLAFHRWHPRVAACRLASGTPRAPGCVRYCEGTAAADGEPAPDWAHETLLEHDAERRFFRYEMNDNNMGFGLFFATFRVVPAAAAGGCELRWEFECE

SEQ ID NO: 7633 - DNA, 479 bp, Zea mays
  misc_feature: Ceres CLONE 356398-F
  misc_feature: Encodes the peptide sequence at SEQ ID NO. 7634
aaaaaattccccgcatgcagcatccatggctgactgcgcccgtgtgataggcatggagtctccggtgtccgaggcgtcagcagcggcggccaccggggagctggacgatgaactactactcatgagcctgtggggcgagtgccacctctctcagttcctgcagcgctctcaaggagaagacggccacctcttcccaacatgatgatcatcattccgatctgccgacatccccggccaagactactccggcgacggcacaagcagcagagccttcgcactgcgacgtggacctacgggccagttacaccggcggcgcccagcagcagcagcagcagcagcaccgaaccactcgtgccgccaacagctcgtcgaagcgctcggcgaccgaaccagaagagawwggwgctgwwkgcggcaagaggagccgcaaggcgccgggctccaccgcggtgtgcggcgtacccgttcgccgtggtgaa

SEQ ID NO: 7634 - protein, 58 aa, Zea mays
  misc_feature: Ceres CLONE 356398-F
MADCARVIGMESPVSEASAAAATGELDDELLLMSLWGECHLSQFLQRSQGEDGHLFPT

SEQ ID NO: 7635 - DNA, 507 bp, Zea mays
  misc_feature: Ceres CLONE 356425-F
  misc_feature: Encodes the peptide sequence at SEQ ID NO. 7636
gaaaaaatcagatccaagaagagggaagagcaccaaggaccttcggcgcccgttcaggatccacatcttcccgagcgagttcttggttgacctcttcccccttcggaccacctccaaggctcttggtgtagcttgccactctcaccaatcaagttttcatgtctgatctcgacattcagatcccaactgccttcgmtcccttcgctgaggccaatgctggggactctggtgcggcagcagggtcaaaggactacgttcacgtgcgcatccagcagcgtaatggtcgcaagagcctgactaccgtccagggattgaagaaggagttcagctacagcaagatcctcaaagatctcaagaaagagttctgctgcaatggtacagtggtccaggacccagaacttggacaggtcattcagctccagggtgatcagaggaagaacgtctcgaatttcctcgtccaggccggcattgtgaagaaggagcacatcaagatcatggtttctgagc

SEQ ID NO: 7636 - protein, 116 aa, Zea mays
  misc_feature: Ceres CLONE 356425-F
  misc_feature (27)..(108): Pfam Name: SUI1 Pfam Description: Translation initiation factor SUI1
  misc_feature (13)..(13): Xaa is any aa, unknown, or other
MSDLDIQIPTAFXPFAEANAGDSGAAAGSKDYVHVRIQQRNGRKSLTTVQGLKKEFSYSKILKDLKKEFCCNGTVVQDPELGQVIQLQGDQRKNVSNFLVQAGIVKKEHIKIMVSE

SEQ ID NO: 7637 - DNA, 454 bp, Zea mays
  misc_feature: Ceres CLONE 356435-F
  misc_feature: Encodes the peptide sequence at SEQ ID NO. 7638
aaacctctcctggcacgagatcacgcttctcgttggatcgaacagctagggtttccaagatgttcgggcgcgcgccgaagaagagcgacaacacacggtactacgagatcctcggggtctccaaggacgcgtcccaggatgacctcaagaaagcctaccgcaaggccgccatcaagaaccaccccgacaagggcggcgatcccgagaagttcaaggagctagctcaggcttatgaggtcctcagtgatcctgaaaagcgggagatttatgatcaatatggtgaggatgccctcaaggagggaatgggaggtggtggagggatgcacgatccctttgacatattccagtcattctttggtggtggaagcccttttggaggtggtggcagcagtaggggcagaaggcagcgaaggggagaggatgtggttcatcctctaaaggtttctctggagga

SEQ ID NO: 7638 - protein, 131 aa, Zea mays
  misc_feature: Ceres CLONE 356435-F
  misc_feature (13)..(71): Pfam Name: DnaJ Pfam Description: DnaJ domain
MFGRAPKKSDNTRYYEILGVSKDASQDDLKKAYRKAAIKNHPDKGGDPEKFKELAQAYEVLSDPEKREIYDQYGEDALKEGMGGGGGMHDPFDIFQSFFGGGSPFGGGGSSRGRRQRRGEDVVHPLKVSLE

SEQ ID NO: 7639 - DNA, 489 bp, Zea mays
  misc_feature: Ceres CLONE 356446-F
  misc_feature: Encodes the peptide sequence at SEQ ID NO. 7640
  misc_feature (400)..(400): n is a, c, t, g, unknown, or other
agggtaaaacagtacttgtcccgccccacgtcgcagcgccgtgtccctctcgccttcttccccaccccacccgggcacccacgcgctcttcagatcagatcggcaagtccaatcccgagcagaggtgcgactcgagcgctcgcgccggtgtccatttcaaagaggaagccgcggtagcactggtagcggcagcagtaaggggaagatgtcgtcggcgttcagcggcgatgagaccgcccctttcttcggcttccttggcgcctccgctgcgctcgtcttctcatgcatgggggcggcgtacgggacagccaagagtggcgttggcgtggcgtccatgggtgtcatgcgcccagagctcgtcatgaagtccatcgtgcccgtggtcatggctggtgtgccncggtatctacggcctcatcatcgcagtcatcatcagcactgggatcaaaccccaaggccaagccatactacctctttgacggctatgcc

SEQ ID NO: 7640 - protein, 94 aa, Zea mays
  misc_feature: Ceres CLONE 356446-F
  misc_feature: SWISSPROT Homolog: EC 3.6.3.14 H(+)-transporting two-sector ATPase
MSSAFSGDETAPFFGFLGASAALVFSCMGAAYGTAKSGVGVASMGVMRPELVMKSIVPVVMAGVPRYLRPHHRSHHQHWDQTPRPSHTTSLTAM

SEQ ID NO: 7641 - DNA, 510 bp, Zea mays
  misc_feature: Ceres CLONE 356450-F
  misc_feature: Encodes the peptide sequence at SEQ ID NO. 7642
atcaaacaaaagcgtcgttctctcttcctggtccaagtgatcttgccaagttacgagcagcaagcagagatcagatcatccatcggcaatgtcgaacatcgggcagtccttccaggccggcaaggcggaggcccagggcgagtaccaggcggagcacgcggcgcagtgcgtcaaggacaccgccggagccgcggccgacagcgcgcagctgcagcagcaccgcgccaccggcaccgttgagcaggtggcgcagacgggccagggcgtggcggcaggcgtcaaggacacggtggcgggcgcggcggttggcgtcaccaacacggtggcgggcgtggcggcgggcgtcacgaactggacctccgccaaccgccgctccgtcaacctcagggggtacacgccgtccttcgccgcgctggacgacaccgccgcggcggtccccggcgcccaggaaggtgcaggcggtgatggacgacgccgagctgcagcggaggaagcgcctggtcgtgtaca

SEQ ID NO: 7642 - protein, 140 aa, Zea mays
  misc_feature: Ceres CLONE 356450-F
MSNIGQSFQAGKAEAQGEYQAEHAAQCVKDTAGAAADSAQLQQHRATGTVEQVAQTGQGVAAGVKDTVAGAAVGVTNTVAGVAAGVTNWTSANRRSVNLRGYTPSFAALDDTAAAVPGAQEGAGGDGRRRAAAEEAPGRV

SEQ ID NO: 7643 - DNA, 395 bp, Zea mays
  misc_feature: Ceres CLONE 356509-F
  misc_feature: Encodes the peptide sequence at SEQ ID NO. 7644
accgcagccctagcgcrccgccaccttcaccttcccaggccgccgccgccgcgcctccattgctgctaaacccgcaaccatgggtcccgtgctgaagcgcccgaccccgggcacggtgcagtgcttcgggcgcaaaaagacggccgtggcgtggcttacacgaagccaggccgggggatgatcaaggtgaacggcgtcccgatcgagctgctccgtcccgagatgctgcggctcaaggccatggagcccgtgctgctggcggggcggtccaggttcaaggacatcgacatgcggatccgcgtgcgcggcggcgggaagacgtcgcagatctacgccatccgccaggccgtcgccaagggtctcgtggcctactaccagaagtacgtggacgaggc

SEQ ID NO: 7644 - protein, 72 aa, Zea mays
  misc_feature: Ceres CLONE 356509-F
  misc_feature (1)..(72): Pfam Name: Ribosomal_S9 Pfam Description: Ribosomal protein S9/S16
MIKVNGVPIELLRPEMLRLKAMEPVLLAGRSRFKDIDMRIRVRGGGKTSQIYAIRQAVAKGLVAYYQKYVDE

SEQ ID NO: 7645 - DNA, 369 bp, Zea mays
  misc_feature: Ceres CLONE 356511-F
  misc_feature: Translation starting site: 69
acacccacacagcaagccagcagagcagaaagcagccgcagccccagcccccacaagacgaggcaacaatggcgctagaagcagccaccgccccccgcgcactcctcgccgcgtgcctcgtcctgctggtcctcggcggcggcaccggcccgtcgtcggtgctgcgcggcgccggggcgcaggccggcgggcagtgcctgccgcagctgaaccgcctcctggcgtgccgcgcgtacctggtgcccggcgcgccggaccccagcgcggactgctgcagcgcgctgagcgccgtgtcgcacgagtgcgcctgcagcaccatgggcatcatcaacagcctgcccggccggtgccacctcgcccaagccaact

SEQ ID NO: 7646 - DNA, 125 bp, Zea mays
  misc_feature: Ceres CLONE 356522-F
atcacaaactcactacacgatcggctatagcgarctaacagcagctctgtcaagtactacacaggccatggccggagccctcgtcttcgtcgctgttctcctcgccgcaagcgtcggcaccacga

SEQ ID NO: 7647 - DNA, 393 bp, Zea mays
  misc_feature: Ceres CLONE 356558-F
  misc_feature: Encodes the peptide sequence at SEQ ID NO. 7648
atttcgggcaatacacacaggttgtctctttatggaatggagtccgttgtttgcactcattaccaagtgataataacggatctcattcagcctctctatagcataggaccaagatcatagtgccgtccctgccggcagagagcaagatggtctcacactcactctcagcatggctcatgtcctcggcgccgccgccggcgtggttcgccgccctggtcgccgtgggcatgtacacggcgctgcggtccgccgccaccttcctggcgtggctccaccgcgcgttcctgcggccaggccgggacctggcggggcggtacgggacgtgggcggtggtgaccggggccacggacggcatcgggcgcgcggtggcgctggagctggckcgcgcggggc

SEQ ID NO: 7648 - protein, 82 aa, Zea mays
  misc_feature: Ceres CLONE 356558-F
  misc_feature: SWISSPROT Homolog: EC 1.1.1.62 Estradiol 17-beta-dehydrogenase
MVSHSLSAWLMSSAPPPAWFAALVAVGMYTALRSAATFLAWLHRAFLRPGRDLAGRYGTWAVVTGATDGIGRAVALELARAG

SEQ ID NO: 7649 - DNA, 727 bp, Zea mays
  misc_feature: Ceres CLONE 356567-R
  misc_feature: Pfam Name: IBR Pfam Description: IBR domain
  misc_feature (642)..(642): n is a, c, t, g, unknown, or other
caattgggtaccgggccccccctcgaggtcgacggtatcgataagcttttttttttttttttttgatgatgaatatctgtagcggccagcagcccaagcacaggaggacatatcatatgtaatgtgagagcaccacataatataactgagtacatgacacacacacacatgcttcacaagattcaaatacaaaatacaatcacaccacgtcgagggttgcatagatttagctcgacgactgattggctgcccatcgttcataataatgtgtatatctctcaagtgagttctttgccatttctcttctcctttcagattcatcatacactccttcttgccttgctgactcatagcggttacaagcataaaatccaccagtcctctctccatgttctgaccatggaccaagacatagccagcagaactcaaatttgcatggtggagtgcatgtgatgtgcatgcatccctgatttttttcaataggccgcttgcatttgggacaaggctttgaattagccagtatccagttcatattctccgactccgcactgttcttgaggatccacttcgaaacagtggcacagtctactggacgatgagcttcctcggtgcaattccaacagaacccatatgaacagttgncattaacatcatagctgccactgcccatgacgaattccgctgcatattcgcatccaggcgcaggacaccattttgtctttctata

SEQ ID NO: 7650 - DNA, 275 bp, Zea mays
  misc_feature: Ceres CLONE 356609-F
ctccccactcttggtgctcttgcttgaatatagtccccctcctctctctctcacacacctgttcttcgatctcggcctagctagctaggccgagatcgaagaacaggtgtgtgtgagagagagagagaggtatgcatcactcatcactgtgctgagtaccgcgcgagaaatgaaggcgaggggtatatcatgggtagtgctagttttaggaagagaaataaagcaaaatatcggattaatatccacttttggttaaaaaaaaaaaaaaaaaaagc

SEQ ID NO: 7651 - DNA, 484 bp, Zea mays
  misc_feature: Ceres CLONE 356645-F
  misc_feature: Encodes the peptide sequence at SEQ ID NO. 7652
aacctctagctgattgatctctgtttaccactctttccttccctccttcaattctaaataccacaaatcaaagttgctttgcgatggtgagcatcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggaggcgtccctgtcgtgcgtccgctcgtggggcggcgcgctctcgttccatcacccacc

SEQ ID NO: 7652 - protein, 133 aa, Zea mays
  misc_feature: Ceres CLONE 356645-F
  misc_feature (10)..(133): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MVSISMDTTSDKRASSMLAPNPGKATILALGHAFPQQLVMQDYVVDGFMKNTNCDDPELKEKLTRLCKTTTVRTRYVVMSDEILKNYPELAQEGLPTMNQRLDISNAAVTQMATEASLSCVRSWGGALSFHHP

SEQ ID NO: 7653 - DNA, 478 bp, Zea mays
  misc_feature: Ceres CLONE 356653-F
  misc_feature: Encodes the peptide sequence at SEQ ID NO. 7654
ccgtgctttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcaaccgtggcggcggctacggcaactccgacgggaactggaggaactgagc

SEQ ID NO: 7654 - protein, 124 aa, Zea mays
  misc_feature: Ceres CLONE 356653-F
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGYGGGRGGGGYGGGNRGGGYGNSDGNWRN

SEQ ID NO: 7655 - DNA, 483 bp, Zea mays
  misc_feature: Ceres CLONE 356728-F
  misc_feature: Encodes the peptide sequence at SEQ ID NO. 7656
ggcataccacactagagccgccgccgccgccgtttcgcgcaccttaccctagccctcgtcagcggcggcttcgagctcatccagccatgacgttcaagcggaggaatggcggacgcaacaagcacgggcgcggccacgtcaagtacatccgctgctccaactgcgccaagtgctgccccaaggataaggctatcaagcggttcttggtgaggaacattgttgagcaggctgccgtgagagatgtgcaggaggcctgtgtacatgatggatatgttctacccaaattgtatgcaaaggttcatcactgtgtctcatgtgcaatccatgcgcacattgtccgggtccgctctcgtgagaacaggaggaaccgtgagcccccgcagcgcttcagacgccgggatgatggcccaaggcctggtcagggcccgccgcgcccaggcggtgcagctcctgcagctgcagctgctgctgctcctcgtacct

SEQ ID NO: 7656 - protein, 132 aa, Zea mays; identical to SEQ ID NO: 6773
  misc_feature: Ceres CLONE 356728-F
  misc_feature (1)..(114): Pfam Name: Ribosomal_S26e Pfam Description: Ribosomal protein S26e

SEQ ID NO: 7657 - DNA, 426 bp, Zea mays
  misc_feature: Ceres CLONE 356876-F
  misc_feature: Encodes the peptide sequence at SEQ ID NO. 7658
acccacgatcaaaaacgtacaaaaccatcgctaccccctcaccctcactctccctgctgcaacccaaccaagcccgcacgacacgacaccaagtcgaggagctcgagagggcaccaataatggccggcgtgaactccagcgtcgtcgggctcaagcccgccgcggcagtgccgcaggccgccgccgcctcatcgccggcgaagcgggtgcagctggccgcgcccgagggccgccgcgccgctctgctcggcctggcggccgtcttcgccgtcacggccaccaccgggtcggccaaggccacgatcttcgatgagtacctcgagaagagcaaggccaacaaggagctgaacgacaagaagaggctggccaccagtggagccaactttgcgcgcgcctacaccgtggagttcggcagctgccagttcc

SEQ ID NO: 7658 - protein, 102 aa, Zea mays
  misc_feature: Ceres CLONE 356876-F
  misc_feature (8)..(102): Pfam Name: PsaN Pfam Description: Photosystem I reaction centre subunit N (PSAN or PSI-N)
MAGVNSSVVGLKPAAAVPQAAAASSPAKRVQLAAPEGRRAALLGLAAVFAVTATTGSAKATIFDEYLEKSKANKELNDKKRLATSGANFARAYTVEFGSCQF

SEQ ID NO: 7659 - DNA, 502 bp, Zea mays
  misc_feature: Ceres CLONE 356878-F
  misc_feature: Encodes the peptide sequence at SEQ ID NO. 7660
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggaggcgtccctgtcgtgcgtccgctcgtggggcggcgcgctctcgtccatcacccacctcggtgtacgtctcgtcg

SEQ ID NO: 7660 - protein, 139 aa, Zea mays
  misc_feature: Ceres CLONE 356878-F
  misc_feature (10)..(138): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MVSSSMDTTSDKRASSMLAPNPGKATILALGHAFPQQLVMQDYVVDGFMKNTNCDDPELKEKLTRLCKTTTVRTRYVVMSDEILKNYPELAQEGLPTMNQRLDISNAAVTQMATEASLSCVRSWGGALSSITHLGVRLV

SEQ ID NO: 7661 - DNA, 421 bp, Zea mays
  misc_feature: Ceres CLONE 356984-F
  misc_feature: Encodes the peptide sequence at SEQ ID NO. 7662
acctccaagcacgcgcgcgccctgtgctccccctcagtcctcgctggtcctttctccatcacaaacgctagtcttttcctaaagctcggagaccgccggaagcgagcgatggcgtgcaagacgaagagcctgctgttggcgctcagcgtggcggcgctgctcgcggcgcggtcggagtcccacggcctgggggacttcacgagcgggagcgacgaggcgacgacgacgccggagatgcagaccttcttcaagccccaggccgccgcggcgctcccggaggccctcgacgcctccatgcccgccaagccggaggccacggcgctcccggccaccaccaccgccgccgccgcgacaacggccggcacggcgccgtcagccacgccgcgcaggtccgtgtccgtggccgccggcgtggcctgcg

SEQ ID NO: 7662 - protein, 104 aa, Zea mays
  misc_feature: Ceres CLONE 356984-F
MACKTKSLLLALSVAALLAARSESHGLGDFTSGSDEATTTPEMQTFFKPQAAAALPEALDASMPAKPEATALPATTTAAAATTAGTAPSATPRRSVSVAAGVAC

SEQ ID NO: 7663 - DNA, 296 bp, Zea mays
  misc_feature: Ceres CLONE 357006-F
  misc_feature: Encodes the peptide sequence at SEQ ID NO. 7664
aaaaatagaaaaaaaaaagaataagaagaaaggaatccctcctacgcggaagcgaagagattcgtcgcctcagccgcctctctgckgcagatctgcggcggagcctcgccggcggcttgcgccccgcggcgctgctgatccaagatgccttcgtgcgtgcagggatgctgctgctgctcgtccctgcgccttctcccccgcgacgacgcgctctcgtccccctccgcctgcgcgcaccgcctgaagccttggtcttggcgtgcccaatcccccacctcgtcctcctaacgcttgtc

SEQ ID NO: 7664 - protein, 80 aa, Zea mays
  misc_feature: Ceres CLONE 357006-F
  misc_feature (29)..(29): Xaa is any aa, unknown, or other
KIEKKKNKKKGIPPTRKRRDSSPQPPLCXRSAAEPRRRLAPRGAADPRCLRACRDAAAARPCAFSPATTRSRPPPPARTA

SEQ ID NO: 7665 - DNA, 470 bp, Zea mays
  misc_feature: Ceres CLONE 357042-F
  misc_feature: Encodes the peptide sequence at SEQ ID NO. 7666
aacatttcagttcagacagtccaagaacagcaccaagaaagactccttgccgctcttcttgcttggctactgactaggagagctccctgccgctggttgatcaacagagaggcaggcggacggcatggcgagctccatgccgctgtcctcgctgctgctgctgctgctctccgcagccagcttcggcggcggcgtaaggctcggcgatggtggctacgaggactggaggctcggcaccgctacctacgtcaaggagttccagtcacaccctctcaatgacggcggtggcgcctgcgggtacggcgacctggacatcttcaggtacgggcgctacacgacggggctgagcgcggcgctgttcgggcgcggcggcscctgcggcggctgctacgagctgcggtgcgtcaaccacatccagtggtgcctccggggcagccccacggtggtggtgacggcgacggacttctgcc

SEQ ID NO: 7666 - protein, 115 aa, Zea mays
  misc_feature: Ceres CLONE 357042-F
  misc_feature (84)..(84): Xaa is any aa, unknown, or other
MASSMPLSSLLLLLLSAASFGGGVRLGDGGYEDWRLGTATYVKEFQSHPLNDGGGACGYGDLDIFRYGRYTTGLSAALFGRGGXCGGCYELRCVNHIQWCLRGSPTVVVTATDFC

SEQ ID NO: 7667 - DNA, 494 bp, Zea mays
  misc_feature: Ceres CLONE 357085-F
  misc_feature: Encodes the peptide sequence at SEQ ID NO. 7668
cactcgcattcgtcactcgtccctctcccctctctcccccaaggccccaacccacttgagcgagccctagagaaggcaaaagccatggcgtccttggttgttcgtgccgccggcgccgccgccgccgccgcccgtcttccctccctccgtcctcgccgcaacggcagcggggtgctctccggcttgagggtcggaacagggcactacggcgcgcggctcgcgcttgcttcgtccacagcttctcacaaagagttcaagatcgcctgccttactgtcgatgacagcagtttgggcccgggggatgaatatgagtctgacccccgcatgccaggcgaggatgagttcgaccatttctaccgtgttctcgccaagaagactgacaacctgctcagctgctacattccaatgccgcttgcactttctgaagaggagaaggccgtgcagaaggagttcaagctgatcgckagcggatgcatcgacctcctggttggtgc

SEQ ID NO: 7668 - protein, 136 aa, Zea mays
  misc_feature: Ceres CLONE 357085-F
MASLVVRAAGAAAAAARLPSLRPRRNGSGVLSGLRVGTGHYGARLALASSTASHKEFKIACLTVDDSSLGPGDEYESDPRMPGEDEFDHFYRVLAKKTDNLLSCYIPMPLALSEEEKAVQKEFKLIASGCIDLLVG

SEQ ID NO: 7669 - DNA, 459 bp, Zea mays
  misc_feature: Ceres CLONE 357087-F
  misc_feature: Encodes the peptide sequence at SEQ ID NO. 7670
atccaggcacaccgcatcagtgtctggctcacctcacctgcagcaggtctcgtctcggtcatccagcgcattgctctcgatcgctgcagcgcatccagtccaaacacacaccggtcgaatcgagcaatggccgcggggctgcaggtgttcggacagccggcttccaccgacgtcgccagggtgctgacctgcctcttcgagaagaacctcgagttcgagctcgtccgcaccgacaccttcaagaagtcgcacaagctccccgagttcatcaagctgagggatcctaccgggcaggtgactttcaagcacggtgacaagacaatcgttgattccaggactatctgccggtacctgtgcacgcagttcccggacgacgggtacaagaagcatggtgctgtctggccggcggcgttgccgaccatcctttccacgagacgcacggcgacgtcgagccggcag

SEQ ID NO: 7670 - protein, 111 aa, Zea mays
  misc_feature: Ceres CLONE 357087-F
  misc_feature (3)..(78): Pfam Name: GST_N Pfam Description: Glutathione S-transferase, N-terminal domain
  misc_feature: SWISSPROT Homolog: EC 2.5.1.18 Glutathione transferase
MAAGLQVFGQPASTDVARVLTCLFEKNLEFELVRTDTFKKSHKLPEFIKLRDPTGQVTFKHGDKTIVDSRTICRYLCTQFPDDGYKKHGAVWPAALPTILSTRRTATSSRQ

SEQ ID NO: 7671 - DNA, 459 bp, Zea mays
  misc_feature: Ceres CLONE 357102-F
  misc_feature: Encodes the peptide sequence at SEQ ID NO. 7672
aggacccctggatctatatatgaaccagaggcgagaggggtggcgcagaatcaggtccgtctccaactcactagtactcagccgccgcaatcaggggggcaggtagctcgagcgcgcgctccacctgcgccgacgcgatgcgggccaagtggaagaagaagaggatgcggaggctcaagaggaagcgccggaaaatgaggcagagatctaagtaggcgcatcttgtgaccgaggatggcgagcttctcctgcaccatggctgtgacgcgttgggatgattgtctccctttgtagacgtgctttgctgtagacgtaggcgatgtaaaccgtcctttttgattaattctagtatgttctgagactgggtttatattgtaatttgaggataattatatgatgctctaagtttatggatattcctgtcactcgaatatgttagatgtcctttcttcagcgcta

SEQ ID NO: 7672 - protein, 65 aa, Zea mays
  misc_feature: Ceres CLONE 357102-F
RTPGSIYEPEARGVAQNQVRLQLTSTQPPQSGGQVARARAPPAPTRCGPSGRRRGCGGSRGSAGK

SEQ ID NO: 7673 - DNA, 463 bp, Zea mays
  misc_feature: Ceres CLONE 357144-F
  misc_feature: Encodes the peptide sequence at SEQ ID NO. 7674
acaaacctctcctggcacgagatcacgcttctcgttggatcgaacagctagggtttccaagatgttcgggcgcgcgccgaagaagagcgacaacacacggtactacgagatcctcggggtctccaaggacgcgtcccaggatgacctcaagaaagcctaccgcaaggccgccatcaagaaccaccccgacaagggcggcgatcccgagaagttcaaggagctagctcaggcttatgaggtcctcagtgatcctgaaaagcgggagatttatgatcaatatggtgaggatgccctcaaggagggaatgggaggtggtggagggatgcacgatccctttgacatattccagtcattctttggtggtggaagcccttttggaggtggtggcagcagtaggggcagaaggcagcgaaggggagaggatgtggttcatcctctaaaggtttctctggaggatttgtac

SEQ ID NO: 7674 - protein, 134 aa, Zea mays
  misc_feature: Ceres CLONE 357144-F
  misc_feature (13)..(71): Pfam Name: DnaJ Pfam Description: DnaJ domain
MFGRAPKKSDNTRYYEILGVSKDASQDDLKKAYRKAAIKNHPDKGGDPEKFKELAQAYEVLSDPEKREIYDQYGEDALKEGMGGGGGMHDPFDIFQSFFGGGSPFGGGGSSRGRRQRRGEDVVHPLKVSLEDLY

SEQ ID NO: 7675 - DNA, 519 bp, Zea mays
  misc_feature: Ceres CLONE 357195-F
  misc_feature: Encodes the peptide sequence at SEQ ID NO. 7676
aagaaaccgtcatctcattttccttttcacgcccactcactcacccgccgcccccgccgccgccatcccctccttgccgtctccgggcacggcctcgtcaatcctttgctcctcctccgccgcagccgctgccatggactccacgccggcgcccgaggcggctcccggagcctcctcttccgccaccgccgctgccgaggatctggcggggggcgtggcggcgatgaccctggatgagcggttcgctctgctgcgggggatcggggaggagtgcatccaggaggacgagctcaggcgcctgctcgagaacaagcccgtgcccatctgctacgacggcttcgagccctccggacgcatgcacatcgcccagggcattgtgaagaccatcaacgtcaacaagatggtcagggccgggtgcaaggtgaaaatctggattgccgactggttcgcgcagctcaacaacaagatgggaggcgacctcaagaaaatccagacagtcgggcgctacatgatcgagat

SEQ ID NO: 7676 - protein, 128 aa, Zea mays
  misc_feature: Ceres CLONE 357195-F
  misc_feature: SWISSPROT Homolog: EC 6.1.1.1
MDSTPAPEAAPGASSSATAAAEDLAGGVAAMTLDERFALLRGIGEECIQEDELRRLLENKPVPICYDGFEPSGRMHIAQGIVKTINVNKMVRAGCKVKIWIADWFAQLNNKMGGDLKKIQTVGRYMIE

SEQ ID NO: 7677 - DNA, 519 bp, Zea mays
  misc_feature: Ceres CLONE 357237-F
  misc_feature: Encodes the peptide sequence at SEQ ID NO. 7678
actactaccagcggtagtggccggcatcatccgtctcgtctcgtctcgcctctcctctccttttcccccctccctgcacagcgccgctcaccgtcaccggaccacagcagcgatcgatggctgaggtacacaacgagcggcccgtggggatggtgggcggcgtccgggacgcgccggtgggccgcgagaacgacctcgaggccatcgagctcgcgcgcttcgcggtcgccgagcacaacagcaagaccaacgcgatgctggaattcgagaggctggtgaaggtgaggcaccaggtcgtggccgggaccctgcaccacttcaccgtcgaggtgaaggaggccggcggcggcgaaaagaagctgtacgaggccaaggtgtgggagaaggcgtgggagaacttcaagcagctgcagagcttcgagctcgtcgtagacgccgcggtcgcctgaggcgcacaggcttttcgctggaggctggagcacaacaatgaaagaatttaactgtcatcccactgggaaa

SEQ ID NO: 7678 - protein, 110 aa, Zea mays
  misc_feature: Ceres CLONE 357237-F
  misc_feature (14)..(105): Pfam Name: Cystatin Pfam Description: Cystatin domain
MAEVHNERPVGMVGGVRDAPVGRENDLEAIELARFAVAEHNSKTNAMLEFERLVKVRHQVVAGTLHHFTVEVKEAGGGEKKLYEAKVWEKAWENFKQLQSFELVVDAAVA

SEQ ID NO: 7679 - DNA, 486 bp, Zea mays
  misc_feature: Ceres CLONE 357238-F
atctccccctatctctctcttctcgcgcatctcattctcacccgcctgatcgctcgccgcgccgaaatgcgaccgccgcatcacctccgcctccgcttgctcatcctcctcgtagccgcctgcctcccgccgccagccgcgtgccggcatatctacccgcccccgccgccgctggggcggcggcatcagcagcagaacggcagcgctcctggcgctgctcctgctatacctctgcgctgccatcgcggtgcgccggttccgctcccgcggcgcgtcgctggcgctggcgcgggagccggcggcgtcccgcgccgcggccttcctccgccgccacaggctccaccaccaccgcccggccttcacctacgagcagctgtgcgccgccaccgcgggcttcgacccggcgcgcaagctcggggacggcggcttcgggacggtgttcctcgcgcacctcccgcccgccggccgccccgccgctgtcaagcg

SEQ ID NO: 7680 - DNA, 506 bp, Zea mays
  misc_feature: Ceres CLONE 357308-F
  misc_feature: Encodes the peptide sequence at SEQ ID NO. 7681
aacctctagctgattgatctctggtttaccactctttccttccctccttcaattctaaataccacaaatcaaagttgctttgcgatggtgagcagcagcatggacacgacgagtgacaaacgtgcgtcatccatgctggctccyaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggaggcgtccctgtcgtgcgtccgctcgtggggcggcgcgctctcgtccatcacccacctcgtgtacgtctcgtcgagcga

SEQ ID NO: 7681 - protein, 140 aa, Zea mays; identical to SEQ ID NO: 5477
  misc_feature: Ceres CLONE 357308-F
  misc_feature (10)..(140): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase

SEQ ID NO: 7682 - DNA, 457 bp, Zea mays
  misc_feature: Ceres CLONE 357385-F
  misc_feature: Encodes the peptide sequence at SEQ ID NO. 7683
aaacgcaagaaacacgaaagcaagaaccggaaggaacagccacgccaatatacagagcgagcccagcacacagtttttttcataaggctggtctgcaattaggtgcctcgactgcttgctagccgccggattaatctttccctaccctaaggctcaggttttagtgggatatgatgaagctaaaaagtggacgacgaccgttctataaggatgttaagcctgtagactgccgttcaggctcaagtcttccacatttggctgctcaagcaaagtttgcagccatgaacatgcagaatgaagatgtcaagcctcgtcgaccagttcaagtcagacgaagtagatgggttcttggtgatgtaaccgaggtgttggatcataattcgtggaggcttgggaagattacagaagttctgaagaatgactattttgtcatcaggctagtgggttgcatccaacc

SEQ ID NO: 7683 - protein, 95 aa, Zea mays
  misc_feature: Ceres CLONE 357385-F
MMKLKSGRRPFYKDVKPVDCRSGSSLPHLAAQAKFAAMNMQNEDVKPRRPVQVRRSRWVLGDVTEVLDHNSWRLGKITEVLKNDYFVIRLVGCIQ

SEQ ID NO: 7684 - DNA, 243 bp, Zea mays
  misc_feature: Ceres CLONE 357404-F
gcaaatatgtgttcgtcctgctgtcgtgctacaagtcgcgctaggccgctgggccattgcacacacggcccaaaatagtcttgcaaagtccaaggaaacgacgggttcacagccgctgcgctcaattgaccctcccctcgccggcgtccggcgatcgccggcatccgagcgatggatcacccatccacgtgatggatccgacagctccttccccggccccccctgcgggcgatggggcacagc

SEQ ID NO: 7685 - DNA, 470 bp, Zea mays
  misc_feature: Ceres CLONE 357442-F
  misc_feature: Encodes the peptide sequence at SEQ ID NO. 7686
aattctactttcgggcaggtggatcgcaaaaaatggtgcgtccgcgactagtgctcttcggggactccatcaccgagcagtccttccgccccggtggctggggtgccgcactggctgatacctactcgcgcaaggctgatgtagttgtcagaggctatggtggatacaacacaagatgggctcttttcttagtacatcacatctttccgctggatggtttagcaccccctcttgcaaccactattttctttggagcaaatgacgcagccctgttaggaagaactggcgagcgacaacatgttccagtttcagaatataaaaataatctcaaaatgattgttaatcatttgaaggattgttctaattccatggttattgtgcttattacgccacctccaattgatgaagaaggaagagaaagattgcacggtcactttatggacagaatgcgaggaagctacctgaaagga

SEQ ID NO: 7686 - protein, 146 aa, Zea mays
  misc_feature: Ceres CLONE 357442-F
  misc_feature (6)..(139): Pfam Name: Lipase_GDSL Pfam Description: GDSL-like Lipase/Acylhydrolase
MVRPRLVLFGDSITEQSFRPGGWGAALADTYSRKADVVVRGYGGYNTRWALFLVHHIFPLDGLAPPLATTIFFGANDAALLGRTGERQHVPVSEYKNNLKMIVNHLKDCSNSMVIVLITPPPIDEEGRERLHGHFMDRMRGSYLKG

SEQ ID NO: 7687 - DNA, 452 bp, Zea mays
  misc_feature: Ceres CLONE 357464-F
  misc_feature: Encodes the peptide sequence at SEQ ID NO. 7688
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcagatggcgacggaggcgtccctgtcgtgcgtccgctc

SEQ ID NO: 7688 - protein, 122 aa, Zea mays
  misc_feature: Ceres CLONE 357464-F
  misc_feature (10)..(122): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MVSSSMDTTSDKRASSMLAPNPGKATILALGHAFPQQLVMQDYVVDGFMKNTNCDDPELKEKLTRLCKTTTVRTRYVVMSDEILKNYPELAQEGLPTMNQRLDISNAAVTQMATEASLSCVR

SEQ ID NO: 7689 - DNA, 368 bp, Zea mays
  misc_feature: Ceres CLONE 357493-F
  misc_feature: Encodes the peptide sequence at SEQ ID NO. 7690
  misc_feature (22)..(22): n is a, c, t, g, unknown, or other
ccaacgaccatcgagtgccatnggagtggctccattgcttggcaagctagctagtctcctgtcctgtcctgtccttccttggcaacaatatatagaatggtgggtagcagggagcagatcggtgcgacgacgcaggcgcccaacaaggtgtcgatgagccgccaggttttccatgtcctcctccttgccgccgtcgtccttttggcctcgctgctatccgcgaaggagaagctgctggggctgagcccggctgcggtggcggtggcctgctgggcgggtgcggtggcggcgtgggcgtacgcggtgtcccgcccgcgtcccgtgtactggtggacctgtccgggtacgtgggckggcttcgcacgagg

SEQ ID NO: 7690 - protein, 90 aa, Zea mays
  misc_feature: Ceres CLONE 357493-F
MVGSREQIGATTQAPNKVSMSRQVFHVLLLAAVVLLASLLSAKEKLLGLSPAAVAVACWAGAVAAWAYAVSRPRPVYWWTCPGTWAGFAR

SEQ ID NO: 7691 - DNA, 416 bp, Zea mays
  misc_feature: Ceres CLONE 357546-F
  misc_feature: Encodes the peptide sequence at SEQ ID NO. 7692
aacgatctagggtttccagctctacacgccgcacacataaatcccgagaccaaaccctcgcctccattcgtcccccgccgccgccgctcccagtctctacgcggaagcagcgcctcgcaccgctcctacccaatggcgccgacgtcgaagctgtcgatgggcatcaagcgtgcgtcgcggtcgcacgcgtaccaccgccgtgggctctgggccatcaaggccaagaacggcggcgtcttccccaaggccgagaaacccgccgccgccgcggaacccaagttctaccccgccgacgacgtcaagcctcgcgttccagcacccgcaagcctaatcccaccaagctcaggtcgagcatcacgcctgggacggtgctgatccctcctcgcggggcgcttcatggggaagagagtggtgtt

SEQ ID NO: 7692 - protein, 80 aa, Zea mays
  misc_feature: Ceres CLONE 357546-F
  misc_feature (1)..(49): Pfam Name: Ribosomal_L6e_N Pfam Description: Ribosomal protein L6, N-terminal domain
MAPTSKLSMGIKRASRSHAYHRRGLWAIKAKNGGVFPKAEKPAAAAEPKFYPADDVKPRVPAPASLIPPSSGRASRLGRC

SEQ ID NO: 7693 - DNA, 1673 bp, Zea mays
  misc_feature: Ceres CLONE 357667
  misc_feature: Encodes the peptide sequence at SEQ ID NO. 7694
atcagcttcttggtaactctcccgtagcttgcgttttgtagcctctatcttctcgctctcagcgacgaccggtttcttggtctcactcatgttcttctgttgattcgatagaattgatgtggtcggaagcgtcttcgttggcggtacataatgctgcttcttgtgttcctcggcggtggaaagcatctttgctggtggtacttgtggcctcttgttgtgcacctcggcaacggcggcagcaagcgtctttgctggtgcagcgggaagcatcttggcagacggtacgtgcaccttgtcgacggcagcgcgcgggagcgggatctgatcagcagagagattgtcgagtttcttcttcaccgctacagcagtggcgaaggaggcttcgacggctaccctccacccgcgcacgacgtcgcgcgcgaggctccggatccgggacgacccgtggctcccgagggcgccgacggtcctcgccagctcggtggacgccagcaggtcgtgcgggacgggcgcgaccagcagcgtcttgagggattcgaccatgacgtcgtcgagcacggcgcagagctgctcggccacgccgtcatccgtggcgccgcggagcagcacgacgatctcgccacgcacgtcacgatactcggcgcgcgggtagccgcatgcctcgatcacgccgtcgatcgcctcgaaagcgccgaagaatggcctccacctccgcaggggaagcccgctctgctcgtcggccatggtagctgcggcggaaggtggatgcgggcgggttgggtcggcggatgcgatgcgagcaagcgtggaacgggtgcgcgcagaactgcagactggattgggagactcggcgcgcctcatttatatatagaacaagccgacgggacggagtccgactcgagtttttctgcatgtaacgcttgcaactctggttcggcttcttggcaaatgaaccttcgtcagcacctgttcccgccgcatgctgttcgccggttcatcggcgccctgaaccagggcccgccgttgtgctacagctattcgatgaaatgcccaaaagcaaattttgcagagaagcaaacatcaagttcagtgatacttgttctacgaatctcgtcagttcactggccaaaatatgtggctagttaatttgccagctagatctcgtcctccgtatgtttgtgttgggcgtgggtgcctttgctggctcactgtgatccgccatgcatggcattggtgctcggtcccgttgcgccggcgactgctctgtctctcttcctcctccccgttgagttgtcgtgtctatgtcctcagtggtcgtgcgttcaaattttgcagagaagtaaacatcaagttcagtgatacttgttctgcgaatctcgtcagttcactgatataagcaccacctcgacagcaatggaattgatactctactttgggcaatctatatttgtaattacaaatatacaggaagcacaaaaagaatatgggccaccttcagcgtagagactgtcaacaactcagacttggaatacatcaactcagacttggaatacatcaactccaagtaagagacttgtgtaacctccaaaggggattgatggaatcaccatgcatggttgaagactgacttggagcagcgcagctgtctttgtttgcgaaaaaaaaaaaaaaaa

SEQ ID NO: 7694 - protein, 331 aa, Zea mays
  misc_feature: Ceres CLONE 357667
MLLLVFLGGGKHLCWWYLWPLVVHLGNGGSKRLCWCSGKHLGRRYVHLVDGSARERDLISREIVEFLLHRYSSGEGGFDGYPPPAHDVAREAPDPGRPVAPEGADGPRQLGGRQQVVRDGRDQQRLEGFDHDVVEHGAELLGHAVIRGAAEQHDDLATHVTILGARVAACLDHAVDRLESAEEWPPPPQGKPALLVGHGSCGGRWMRAGWVGGCDASKRGTGARRTADWIGRLGAPHLYIEQADGTESDSSFSACNACNSGSASWQMNLRQHLFPPHAVRRFIGALNQGPPLCYSYSMKCPKANFAEKQTSSSVILVLRISSVHWPKYVAS

SEQ ID NO: 7695 - DNA, 494 bp, Zea mays
  misc_feature: Ceres CLONE 357683-F
  misc_feature: Encodes the peptide sequence at SEQ ID NO. 7696
acaaaccctaacactccaccgacgcccagatctgttccttctctcttccacgccgccgcgcgcgcgccctcgaattttcgaatcctcagcaacaatcggccggccgccatgagggagatcctccacatccagggcggccagtgtggcaaccagatcggtgccaagttctgggaagtggtgtgcgcggagcacggcatcgacgccaccggccgctacggcggcgactccgacctgcagctcgagcgcgtcaacgtctactacaacgaggcctcgtgcggccgcttcgtgccccgcgccgtgctcatggacctagagcccggcaccatggactccgtgcgctccggtccctacggccacatcttccgccccgacaacttcgtcttcggccagtccggggccgggaacaactgggccaagggccactacaccgagggagccgagctcatcgactccgtgctcgacgtggtgcgcaggaggccgagaactgcgactgc

SEQ ID NO: 7696 - protein, 128 aa, Zea mays
  misc_feature: Ceres CLONE 357683-F
MREILHIQGGQCGNQIGAKFWEVVCAEHGIDATGRYGGDSDLQLERVNVYYNEASCGRFVPRAVLMDLEPGTMDSVRSGPYGHIFRPDNFVFGQSGAGNNWAKGHYTEGAELIDSVLDVVRRRPRTAT

SEQ ID NO: 7697 - DNA, 412 bp, Zea mays
  misc_feature: Ceres CLONE 357705-F
  misc_feature: Encodes the peptide sequence at SEQ ID NO. 7698
ctagccgcactgcgctcatttctgcatccccctcccgccgcgccgcctcaccgccgccggagaagatgggtcgcgtgatccgcgcgcaccgtaagggtgcggggtccgtgttcaagtcccacacccaccaccgcaagggccccgcccgcttccgctccctcgacttcggcgagcgcaacgggtacctcaagggcgtcgtcaccgacgtcatccacgaccccggccgtggcgcgccgctcgccaaggtcactttccgccacccattcaggtacaagcaccagaaggagctctttgtcgcagccgagggcatgtacacgggccagttcgtctactgcggtcgcgtccgcacaaatcccgtgctcccccgtctgaaaaccctccccacctccggcggcggcggcggcsctggcga

SEQ ID NO: 7698 - protein, 115 aa, Zea mays
  misc_feature: Ceres CLONE 357705-F
  misc_feature (11)..(90): Pfam Name: Ribosomal_L2 Pfam Description: Ribosomal Proteins L2, RNA binding domain
  misc_feature (114)..(114): Xaa is any aa, unknown, or other
MGRVIRAHRKGAGSVFKSHTHHRKGPARFRSLDFGERNGYLKGVVTDVIHDPGRGAPLAKVTFRHPFRYKHQKELFVAAEGMYTGQFVYCGRVRTNPVLPRLKTLPTSGGGGGXG

SEQ ID NO: 7699 - DNA, 104 bp, Zea mays
  misc_feature: Ceres CLONE 357718-F
gtcaaatcckccacaccctggactggagtggctgctgctcgtggccaggcgatsagcggcggcgggcccaggaggtgcgtgcgggccggactcccgcgtggaga

SEQ ID NO: 7700 - DNA, 323 bp, Zea mays
  misc_feature: Ceres CLONE 357737-F
aatttttttccctgtccagactggtggccacagcagggcacgccggcgacgcgcacccgccggcgaccagacggtggcgcgtcaagactccccacccggctgtccggcgaggacctcggctcctcgcccctccgccgctaaagagccgccatccagccgcccagccccaggccccaccgccccagctccacctcggtcccctctcctcacctcgacccggattccgcccctcgcctcacctcgacctacatctgcctcgtccccatggaggcggctgtgcgcttygttcagttcagttcatccgtgttcttgtttgcgaggtc

SEQ ID NO: 7701 - DNA, 506 bp, Zea mays
  misc_feature: Ceres CLONE 357746-F
  misc_feature: Encodes the peptide sequence at SEQ ID NO. 7702
tgaagagccccggcagctacgggttcagcaccaacctcagggcctgctgcggcgccggcggcggcaagtacaactaccagaacggcgcgcggtgcggcatgcccggcgcgtacgcgtgctctgacccggcgtcgtcgctcagctggtacggcatccacctgacggaggcggcgtacaggaagatcgccgacggctgggtcagcggggcctactgccacccggccatctcggcctagaggctgctccgggaccgggggtcgggggctggttggtggttcgctggcccctcaagttagggaaggggaatcggattaattgtaatttttttagctggaatcgaagcaggcaagaagacgatggaggtggtctgcaactgcaagaaataatcaattatataagcataattctctcgtgatcatcgtgcgacagcagtgctaagatcacttgtgtagcctagcgtgccattttagtaataaggctatcttatcaggccagggcaggacgag

SEQ ID NO: 7702 - protein, 77 aa, Zea mays
  misc_feature: Ceres CLONE 357746-F
  misc_feature: SWISSPROT Homolog: EC 3.2.1.51 Alpha-L-fucosidase
KSPGSYGFSTNLRACCGAGGGKYNYQNGARCGMPGAYACSDPASSLSWYGIHLTEAAYRKIADGWVSGAYCHPAISA

SEQ ID NO: 7703 - DNA, 453 bp, Zea mays
  misc_feature: Ceres CLONE 357793-F
  misc_feature: Encodes the peptide sequence at SEQ ID NO. 7704
attgcgcctcacttggcctgcgcggctgctgtaccaaaccaacccaagccacccaataaaccaaccaacgacgtagctgttgagcagtacgttgagctagctctagctataggtacagtacagtcacggagtctcggctcggccatgggcaactgcgtccagatcagcagcggcggcgtcggcgtcggcggcagtagaagctgcgcggccgccgtagaagcagggtgccagcagccgcaacggaggagaagcactgccggcggtgatgaggaggaggcaataattgatcaagcgatgacaccgtcgtcaatcttgaaggtgaagatggtgctgaccaagggcgagctggggtggctcgtggcgcagctcaaggccggcgaccgccgcctcgcggacgtgctccgggagatggcgcgcaagcgtgagggccgggcggctgccgacgggtggcgg

SEQ ID NO: 7704 - protein, 103 aa, Zea mays
  misc_feature: Ceres CLONE 357793-F
MGNCVQISSGGVGVGGSRSCAAAVEAGCQQPQRRRSTAGGDEEEAIIDQAMTPSSILKVKMVLTKGELGWLVAQLKAGDRRLADVLREMARKREGRAAADGWR

SEQ ID NO: 7705 - DNA, 480 bp, Zea mays
  misc_feature: Ceres CLONE 357797-F
  misc_feature: Encodes the peptide sequence at SEQ ID NO. 7706
tcacaagtagatctcgcggtgaatcctcccgagtcgcctccccctcaagttccacaaacgcaagccccaatctcgccgtcaccaccccaatccagcaaacgcaaaccccatctcgccgccgccgccgccgccgccgcgatgtctcgccgctatgacagccgcactacgatcttctcgccggaggggcgtctctaccaggtggagtacgcgatggaggcgatcggcaacgccgggtcagccctcgggatcctagcggccgacggcgtggtcctcgtcggcgagaagaaggtgacctccaagctcctccagacctcgcgctccgccgagaagatgtacaagatcgactcccacctggcgtgcgccgtggccgggatcatgtccgacgccaacatcctcatcaacaccgcccgcctccacgcccaacgctacgcgctctcctaccaggaacccatccccgtcgagcagctcgtccagtccctc

SEQ ID NO: 7706 - protein, 114 aa, Zea mays
  misc_feature: Ceres CLONE 357797-F
  misc_feature: SWISSPROT Homolog: EC 3.4.25.1 Proteasome endopeptidase complex
MSRRYDSRTTIFSPEGRLYQVEYAMEAIGNAGSALGILAADGVVLVGEKKVTSKLLQTSRSAEKMYKIDSHLACAVAGIMSDANILINTARLHAQRYALSYQEPIPVEQLVQSL

SEQ ID NO: 7707 - DNA, 795 bp, Zea mays
  misc_feature: Ceres CLONE 357821-R
  misc_feature: SWISSPROT Homolog: EC 1.11.1.6 Catalase
  misc_feature (612)..(612): n is a, c, t, g, unknown, or other
ccctttcgaccctttatagtaacagagtgtatagagataaatgtcacaatataatcagagtacttattacatagaggaagtcttacaaaaataaaagataaatataacacaaactaaggatcatccttggcgcaagaaagtcaactgtgagacgcatgctagatcgaatcgaactcctcgatttgtggctcctcttgaaccacctattcttctccatgagtgcgaacccgggagcacctggaggacgacggggaggcggtgaagtctcgggtcgacggcggctgtcacacctggcacttgagattccagttaccagggtgattcttcagatcctcgtggcctcactgcctcgattgagacggcaatgagacccagccacggcacacagctgcatcgcgacgcctgaaaacatatcggcgagcaataagcagggttcccagagacgacttgcccggatacttctagaccccatccagtagacctccgcgaccccgatgatccaccaccgaggtccggttcttggtgtctatgcctgacggcagccacggcggatccacacatcaagcggcaaatttcttaaatgatgggatccatttcgccgtgacggatgtntagggaatggtctcgtgcgaattcctgcagcccgggggatccactagttctagagcggccgccaccgcggtggagctccagcttttgttccctttagtgagggttaattgcgcgcttggcgtaatcatggtcatagctgtttcctgtgtgaaattgttatccgctcacaattcacacaacatt

SEQ ID NO: 7708 - DNA, 480 bp, Zea mays
  misc_feature: Ceres CLONE 357855-F
  misc_feature: Encodes the peptide sequence at SEQ ID NO. 7709
gagaaaagatcgtaaccctaatcggacaaaatcgggctatcttcttcctatatatcccgtcgccgctgcctcggccgtttcatgtccagcggccatggtgaagaagcccaacggtgtcgccaaggccacggcgacctctgctgacgcggcagcccagccatccaaggagaatccgtccacccctgggttggtcaaggcctcgaagtttaagaagagaaaggtcaaggccaaccgtgcgaagcaggcagtcgctgcagcagctattgacgaggtcgcccctgtaggtgcaggcactggtgatggcgatgcatctgcatcagcggctttaccgcaaccatccgatgttgccgaggcattacttgtggtgcaaacgccaaagtcaaccacttttgctgaggcatcacctgtggcacagacgcagaagccagccactgatgctgaaggattggtgcctgcaccaataccaaccactgctgtagc

SEQ ID NO: 7709 - protein, 128 aa, Zea mays
  misc_feature: Ceres CLONE 357855-F
MVKKPNGVAKATATSADAAAQPSKENPSTPGLVKASKFKKRKVKANRAKQAVAAAAIDEVAPVGAGTGDGDASASAALPQPSDVAEALLVVQTPKSTTFAEASPVAQTQKPATDAEGLVPAPIPTTAV

SEQ ID NO: 7710 - DNA, 448 bp, Zea mays
  misc_feature: Ceres CLONE 357949-F
  misc_feature: Encodes the peptide sequence at SEQ ID NO. 7711
acccacacagcaagccagcagagcagaaagcagccgcagccccagcccccacaagacgaggcaacaatggcgctagaagcagccaccgccccccgcgcactcctcgccgcgtgcctcgtcctgctggtcctcggcggcggcaccggcccgtcgtcggtgctgcgcggcgccggggcgcaggccggcgggcagtgcctgccgcagctaaaccgcctcctggcgtgccgcgcgtacctggtgcccggcgcgccggaccccagcgcggactgctgcagcgcgctgagcgccgtgtcgcacgagtgcgcctgcagcaccatgggcatcatcaacagcctgcccggccggtgccacctcgcccaagccaactgctgtaagcttgtagccaggccgcaacggcttcgtctcttcatctcggtgctatgctaagcttattaatcttatgttttcc

SEQ ID NO: 7711 - protein, 119 aa, Zea mays
  misc_feature: Ceres CLONE 357949-F
  misc_feature (43)..(101): Pfam Name: Tryp_alpha_amyl Pfam Description: Protease inhibitor/seed storage/LTP family
MALEAATAPRALLAACLVLLVLGGGTGPSSVLRGAGAQAGGQCLPQLNRLLACRAYLVPGAPDPSADCCSALSAVSHECACSTMGIINSLPGRCHLAQANCCKLVARPQRLRLFISVLC

SEQ ID NO: 7712 - DNA, 490 bp, Zea mays
  misc_feature: Ceres CLONE 357955-F
  misc_feature: Encodes the peptide sequence at SEQ ID NO. 7713
gaaaaccttttgccgtcttgcggcggccttctgctccgccgctcgttctcatatcttgcggcggcctggggaaaaagaggagagatcggagatgaaggcgtgtgcgaaggctgcgggggagaggctgcctctggtctgtgctccgtcaactaggcagcctctagctcggagctttgttaaggcaagaagattaccctctcaacatgagacgaagtcacaagtatcctgctcggttagggtgtcagaaaacacagctcacagaatagatgccacagcagaaaatattttcccagcaatgaaagatcatgtcttgaaagcaactgatgcaatcaacagaggagaagtgattgcggtgcctactgataccatatacgggtttgcatgtgatgcatgctctgcaggagcagttaatcgtatttatgagatcaaaggacgcatacaaacaaggcctctggcaatttgtgttggtgatgtcycagacatatcacgg

SEQ ID NO: 7713 - protein, 133 aa, Zea mays
  misc_feature: Ceres CLONE 357955-F
  misc_feature (129)..(129): Xaa is any aa, unknown, or other
MKACAKAAGERLPLVCAPSTRQPLARSFVKARRLPSQHETKSQVSCSVRVSENTAHRIDATAENIFPAMKDHVLKATDAINRGEVIAVPTDTIYGFACDACSAGAVNRIYEIKGRIQTRPLAICVGDVXDISR

SEQ ID NO: 7714 - DNA, 474 bp, Zea mays
  misc_feature: Ceres CLONE 357990-F
  misc_feature: Encodes the peptide sequence at SEQ ID NO. 7715
aaaaaaacggaagtttcggcggcgcggcgtgctcgtgatctcaaccaaggcgtgtctccgctccggtcacccgtcactccacgcaaacatgtcgaggaggaagaccagggagcccaaggaggagaacgtcacccttggacccactgtccgtgaaggagagtatgtctttggtgtcgctcacatctttgcatccttcaatgacaccttcattcatatcactgatttgtctgggagggaaactctggttcggatcaccggtggcatgaaggtgaaggctgaccgtgacgagtcgtcaccttacgctgctatgcttgctgctcaagacgtcgcacagcgctgcaaggagcttggcattactgcactgcacattaagcttcgtgccaccggaggcaacaagaccaagacccccggacctggtgcccagtctgccctcagggcgcttgcycgttctgggatgaaaatcggacgcattga

SEQ ID NO: 7715 - protein, 128 aa, Zea mays
  misc_feature: Ceres CLONE 357990-F
  misc_feature (28)..(128): Pfam Name: Ribosomal_S11 Pfam Description: Ribosomal protein S11
MSRRKTREPKEENVTLGPTVREGEYVFGVAHIFASFNDTFIHITDLSGRETLVRITGGMKVKADRDESSPYAAMLAAQDVAQRCKELGITALHIKLRATGGNKTKTPGPGAQSALRALARSGMKIGRI

SEQ ID NO: 7716 - DNA, 467 bp, Zea mays
  misc_feature: Ceres CLONE 358011-F
  misc_feature: Encodes the peptide sequence at SEQ ID NO. 7717
caggaaaagaaagggcatatcgaggaggtttttagggtggtggtggtgttgtgaggagctgctgccgctgctctccagtctccaccgatggcgatcaagaacatgacggtggcggcgacgacgcggtcgctggacgcggacatgacggtggacgagttcaaggagtggctgcggcggttcgacacggaccaggacgggcgcatcagccgcgacgagctgcggcgcgccctgcgtgccatccgctcccggttcacggggtggaggagcaggcagggcatcagttacgccgacgctgacggcgacggctacatcgacgacagcgaggtcgatggcctcatcgagttcgcgcagaagaacctcggcctcaagatcgtcgcctactgatctcacatggggcgcggcgcgcggcggtcggggggtgggacgcactagctcgccatgagctagctatagcgacaatgcaactc

SEQ ID NO: 7717 - protein, 98 aa, Zea mays; identical to SEQ ID NO: 7295
  misc_feature: Ceres CLONE 358011-F
  misc_feature (23)..(51): Pfam Name: efhand Pfam Description: EF hand

SEQ ID NO: 7718 - DNA, 477 bp, Zea mays
  misc_feature: Ceres CLONE 358043-F
  misc_feature: Encodes the peptide sequence at SEQ ID NO. 7719
ccctgacttgtgcgccatcacacacaagacacaaccccactcacccggcagggaggccctcttcgtcggcggaggccatggtttccctcaagccgcagaagaggctcgccgcgggagtcctaaaatgtggcaaggggaaggtgtggcttgaccccaacgaggtctacgagatctcgatggctaactcgcgtcagaacattcgtaagctggtgaaggatggattcataattaagaagccacagaaaatccactcaaggtcccgggcaaggagggcccatgaggccaagcagaaggggaggcactctggttacggtaagcgcaggggtaccagggaggctaggctccccaccaagatcctttggatgcgcaggatgcgtgtcctcaggcgtctgctgcgcaagtatcgtgaagcaaagaaaatcgacaaacacatgtaccacgatattgtatatgaaagtaaaaggaaacatgtttaaa

SEQ ID NO: 7719 - protein, 132 aa, Zea mays
  misc_feature: Ceres CLONE 358043-F
  misc_feature (2)..(130): Pfam Name: Ribosomal_L19e Pfam Description: Ribosomal protein L19e
MVSLKPQKRLAAGVLKCGKGKVWLDPNEVYEISMANSRQNIRKLVKDGFIIKKPQKIHSRSRARRAHEAKQKGRHSGYGKRRGTREARLPTKILWMRRMRVLRRLLRKYREAKKIDKHMYHDIVYESKRKHV

SEQ ID NO: 7720 - DNA, 470 bp, Zea mays
  misc_feature: Ceres CLONE 358139-F
  misc_feature: Encodes the peptide sequence at SEQ ID NO. 7721
actggagccctataggctatagccatcaccacactcgcctccctctctccctcccacactccaccacccgcgccgccgcctcctactccgccccggcccctctgatccggaccgagcgccggccatggcgctcgccttcgacgagttcgggcgccccttcatcatcctgcgggagcaggagaagaagacgcgccttagggggctcgacgcgcagaaggccaacatcgcctcggccaaggccgtcgcgcggatcctccgcacgtcgcttggacccaagggcatggacaagatgctccagtcccccgacggcgacgtcatcatcacaaatgatggagcgaccatcctggagcagatggatgttgacaaccagatagcaaagctgatggtggagctgtcccgtagtcaagactatgaaatcggggatggtaccaccggggtggtagtcatggcaggggctcttctcgagcagg

SEQ ID NO: 7721 - protein, 115 aa, Zea mays
  misc_feature: Ceres CLONE 358139-F
MALAFDEFGRPFIILREQEKKTRLRGLDAQKANIASAKAVARILRTSLGPKGMDKMLQSPDGDVIITNDGATILEQMDVDNQIAKLMVELSRSQDYEIGDGTTGVVVMAGALLEQ

SEQ ID NO: 7722 - DNA, 482 bp, Zea mays
  misc_feature: Ceres CLONE 358257-F
  misc_feature: Encodes the peptide sequence at SEQ ID NO. 7723
acggacgcttcgctctagtcggaaggtttcgaggaactcccgggctcgaggagatcgggacgatgatgggagggcgcgctctgctgctgctcctggtctcggcgctgctcgttcagatccgcgcctctgacccgctgctgtacgagccgtttgatgaggacttcgagggtagatggatcgtctccaagaaggatgaataccaaggtgtatggaagcatgccaagagtgatgggcatgaggactatggcctccttgttagtgacaaggcaaggaaatacgccataatcaaggagcttgatgagccagttaccttaaatgatgggacagtggtcctgcagtttgaagtgagacttcagaatggccttgaatgtggaggtgcctacattaagtacatccgccctcaggatgctggatgggatgccaaggagtttgataatgagactccatacactattatgtttggtccagataaatgtgggtca

SEQ ID NO: 7723 - protein, 140 aa, Zea mays
  misc_feature: Ceres CLONE 358257-F
  misc_feature (24)..(140): Pfam Name: Calreticulin Pfam Description: Calreticulin family
MMGGRALLLLLVSALLVQIRASDPLLYEPFDEDFEGRWIVSKKDEYQGVWKHAKSDGHEDYGLLVSDKARKYAIIKELDEPVTLNDGTVVLQFEVRLQNGLECGGAYIKYIRPQDAGWDAKEFDNETPYTIMFGPDKCGS

SEQ ID NO: 7724 - DNA, 488 bp, Zea mays
  misc_feature: Ceres CLONE 358276-F
  misc_feature: Encodes the peptide sequence at SEQ ID NO. 7725
  misc_feature (425)..(425): n is a, c, t, g, unknown, or other
aatcgaacaccaatggcattcttgcattgaaggaaccttccctccacctccaccgcccgagagcgagcggccggacggggttttggttgggcatggctgccccggcgatgctccaagtggtgatcctcgccgcggtcctccttctcccgttcctcagcgtgccgggcgccgaggcacagaccaagaagttctgcctcacgcagttcgccatcgctagccaggcctgcgccatcctgccacccaccagtcctgagcaccaccaccatcatcacgatgacgaggacaatgacgaggacaacgacgaagatgaggacgaagacgaggacaacgatgaagatgaagacgaggacaatgacgacgatagcggcggacgagcgaactaagtgcatgcagacttctggcgtttccttcaatgcatgccttancaatatatcagggaaaatacgagcattttatgttggaagcagttcagttacgtgtgaggtctg

SEQ ID NO: 7725 - protein, 96 aa, Zea mays
  misc_feature: Ceres CLONE 358276-F
MAAPAMLQVVILAAVLLLPFLSVPGAEAQTKKFCLTQFAIASQACAILPPTSPEHHHHHHDDEDNDEDNDEDEDEDEDNDEDEDEDNDDDSGGRAN

SEQ ID NO: 7726 - DNA, 508 bp, Zea mays
  misc_feature: Ceres CLONE 358290-F
  misc_feature: Encodes the peptide sequence at SEQ ID NO. 7727
gccatccaagaacaaattaagcggacacaggaaacaaagagaggaatggggcttcgcggcggagctcttgccctgcttctgctcctgttcgtccacggaggccagcgagcagcagaggccggcggggacgcgttcgtgagggtccagggcacccgcttcgtgcagggcggcaagccgttcttcgccaacgggttcaacgcctactggctcatgacattcggcgccgaccccgcgcggaggggcaaggtcacctcggcgctcagccaggccgccggcgccggcctctccgtggccaggacgtgggcgttcagcgacggcggcggcggcggcagcgcgctgcagtactctcccggccgctacaacgagaacaccttccaggggctggatttcgtgctgtctgaggctaggaagcatgggattaagatgattctgagcctcgtgaacaattacgacagctttggagggaggaagcagtacgtgcagtgggcsagggagcsggggcagacca

SEQ ID NO: 7727 - protein, 154 aa, Zea mays
  misc_feature: Ceres CLONE 358290-F
  misc_feature: SWISSPROT Homolog: EC 3.2.1.78 Mannan endo-1,4-beta-mannosidase
  misc_feature: The sequence is a functional homolog of SEQ ID NO 2 in US patent 7148399
  misc_feature (151)..(151): Xaa is any aa, unknown, or other
MGLRGGALALLLLLFVHGGQRAAEAGGDAFVRVQGTRFVQGGKPFFANGFNAYWLMTFGADPARRGKVTSALSQAAGAGLSVARTWAFSDGGGGGSALQYSPGRYNENTFQGLDFVLSEARKHGIKMILSLVNNYDSFGGRKQYVQWAREXGQT

SEQ ID NO: 7728 - DNA, 535 bp, Zea mays
  misc_feature: Ceres CLONE 358311-F
  misc_feature: Encodes the peptide sequence at SEQ ID NO. 7729
gtgctttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggcggcgagagatggcaggggagggcgagtggcggccacggcggtggcggcggctacggtggcggcggcggctacggtggtggtggcggcggctacggcggtggcaaccgtggcggcggctacg

SEQ ID NO: 7729 - protein, 145 aa, Zea mays
  misc_feature: Ceres CLONE 358311-F
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGYGGGRGGGGGERWQGRASGGHGGGGGYGGGGGYGGGGGGYGGGNRGGGY

SEQ ID NO: 7730 - DNA, 167 bp, Zea mays
  misc_feature: Ceres CLONE 358318-F
aaaaaaaacaagcaaatggaggcatgagctccgccgcctccccgtctctcgccgatctcccccaaaccctagcctcgacctgaccgccagcgggcccgcaggccggagaaggagtcggagtcgccmccacccacccaccctctgccgcgggcggggagcgggcggcg

SEQ ID NO: 7731 - DNA, 471 bp, Zea mays
  misc_feature: Ceres CLONE 358401-F
  misc_feature: Encodes the peptide sequence at SEQ ID NO. 7732
ctctcacacaaccaagctcgatccatctcactctccgctggtcgctcactcttgcagctccacccttcactcagtcttagtctcttattagctctaggctctagctagccgcgccactccttcgtgtagccatcagccttctcatcgccaccaatggccactgccgaggtccagaccccgaccgtcgtggcggccgaggaagcgcccgtggtggagaccccgccgccggccgtcgtgcccgaggagtctgcccccgccgaggccgaggccgaggccgaggctgctgctcctgctgatcccgaggagcttcccgcggccgagcagcaggcagccgccgaggcggaggccgcggctcctgctggtgccgaggagcccgtcgcggccgaaccggccgccgaggcggaggctgctgctcctgctggtcccgaggagactcctgcggtcgagcaggaggcagccgcgaggaggagg

SEQ ID NO: 7732 - protein, 106 aa, Zea mays
  misc_feature: Ceres CLONE 358401-F
MATAEVQTPTVVAAEEAPVVETPPPAVVPEESAPAEAEAEAEAAAPADPEELPAAEQQAAAEAEAAAPAGAEEPVAAEPAAEAEAAAPAGPEETPAVEQEAAARRR

SEQ ID NO: 7733 - DNA, 463 bp, Zea mays
  misc_feature: Ceres CLONE 358500-F
  misc_feature: Encodes the peptide sequence at SEQ ID NO. 7734
aaaaatcagtcatcacccaccgcctccgccgccgacaacagcgtagtgtagtgtagttccggagagggttggggagagtagtagtgatccgcaatgtcgacggaggaggctgttgtggctgaggtcccggtgaccgaggtgccagcggaggtcccggcggcccaggtggccgaggcgcccaaggcgaagaaggcgcccaaggagaagaaggcgcctaaggagaagaagctttccgcggcgaagaagccggcggcgcaccctccctacgctgagatgattgtagaggcgatcgctgccctcaaggagaggaaggggtcgagctcggtggccatcagcaagtacgtcgaggggaagcatggcggcaagctccccaccaacttccgcaagcagctcactgtgcagctgaagaagctcgctgccgccggcaagctgacgagggtgaagaactccttcaagctgccgg

SEQ ID NO: 7734 - protein, 123 aa, Zea mays
  misc_feature: Ceres CLONE 358500-F
  misc_feature (54)..(123): Pfam Name: Linker_histone Pfam Description: linker histone H1 and H5 family
MSTEEAVVAEVPVTEVPAEVPAAQVAEAPKAKKAPKEKKAPKEKKLSAAKKPAAHPPYAEMIVEAIAALKERKGSSSVAISKYVEGKHGGKLPTNFRKQLTVQLKKLAAAGKLTRVKNSFKLP

SEQ ID NO: 7735 - DNA, 456 bp, Zea mays
  misc_feature: Ceres CLONE 358502-F
  misc_feature: Encodes the peptide sequence at SEQ ID NO. 7736
  misc_feature (427)..(427): n is a, c, t, g, unknown, or other
atacggcataccacactagagccgccgccgccgccgtttcgcgcaccgtaccctagccctcgtcagcggcggcttcgagctcatccagccatgacgttcaagcggaggaatggcggacgcaacaagcacgggcgcggccacgtcaagtacatccgctgctccaactgcgccaagtgctgccccaaggataaggctatcaagcggttcttggtgaggaacattgttgagcaggctgccgtgagagatgtgcaggaggcctgtgtacatgatggatatgttctacccaaattgtatgcaaaggttcatcactgtgtctcatgtgcaatccatgcgcacattgtccgggtccgctctcgtgagaacaggaggaaccgtgagcccccgcagcgcttcagacgccgggatgatggcccaaggcctggtcagngacccgccgcgcccaggcggtgcagctcc

SEQ ID NO: 7736 - protein, 122 aa, Zea mays
  misc_feature: Ceres CLONE 358502-F
  misc_feature (1)..(114): Pfam Name: Ribosomal_S26e Pfam Description: Ribosomal protein S26e
  misc_feature (113)..(113): Xaa is any aa, unknown, or other
MTFKRRNGGRNKHGRGHVKYIRCSNCAKCCPKDKAIKRFLVRNIVEQAAVRDVQEACVHDGYVLPKLYAKVHHCVSCAIHAHIVRVRSRENRRNREPPQRFRRRDDGPRPGQXPAAPRRCSS

SEQ ID NO: 7737 - DNA, 435 bp, Zea mays
  misc_feature: Ceres CLONE 358571-F
  misc_feature: Encodes the peptide sequence at SEQ ID NO. 7738
ataaactagcccccgctctctctcctcacaaacttcccctgtcacgagagtacgagaccacgccttccgtgggatcaatcggctagggtttcggagatgttcggccgcgcgccgaagaagagcgacaacacccggtactacgagatcctgggggtttccaaggacgcgtcacaggatgacctcaagaaggcctaccgcaaggccgccatcaagaaccaccccgacaagggcggcgaccccgagaagttcaaggagctagctcaggcttatgaggtcctcagcgaccctgaaaagagagagatctatgaccagtatggcgaggatgccctcaaggagggaatgggaggcggtggtgggatgcatgatccctttgacatattccagtcattctttggtggtggaagcccttttggaggtggcagcagtaggggcaga

SEQ ID NO: 7738 - protein, 113 aa, Zea mays
  misc_feature: Ceres CLONE 358571-F
  misc_feature (13)..(71): Pfam Name: DnaJ Pfam Description: DnaJ domain
MFGRAPKKSDNTRYYEILGVSKDASQDDLKKAYRKAAIKNHPDKGGDPEKFKELAQAYEVLSDPEKREIYDQYGEDALKEGMGGGGGMHDPFDIFQSFFGGGSPFGGGSSRGR

SEQ ID NO: 7739 - DNA, 443 bp, Zea mays
  misc_feature: Ceres CLONE 358625-F
  misc_feature: Encodes the peptide sequence at SEQ ID NO. 7740
attcactttccaagttgtccgaaaagaccagactaccctgttgccccgaagtcagagagggagaggaggctagggatagagcagcgtcatcgcaccgctcgccggcgagccagaacatcagtaaggcagcgatggcggtggtggagctgtgggagacgctgaagcaggcgatcgttgcgtacacgggcctgtctccggcggccttcttcacggctgtggcggtggcggccgctctgtaccacgttgtgtcggggctcttcgcggccccgcccccgccgccgccgcgcccacgggaggagcccgagacggagccgctccctcctcccgtgcagatgggggaggtctccgaggaggacctccgccagtacgacggctcagaccctaagaagccgctcctcatggccatcaagggccagatctacgacgtcacccagagcagaatg

SEQ ID NO: 7740 - protein, 104 aa, Zea mays
  misc_feature: Ceres CLONE 358625-F
MAVVELWETLKQAIVAYTGLSPAAFFTAVAVAAALYHVVSGLFAAPPPPPPRPREEPETEPLPPPVQMGEVSEEDLRQYDGSDPKKPLLMAIKGQIYDVTQSRM

SEQ ID NO: 7741 - DNA, 482 bp, Zea mays
  misc_feature: Ceres CLONE 358718-F
  misc_feature: Encodes the peptide sequence at SEQ ID NO. 7742
aattccggaatgggcatgccgcgagcacgacccttggcctgcattgccgtggcggccattgcgctcctcgcgccgacgcgcggagcggagatggtcgagcggcagttcgtggagtgggtgcgctacatgggcggcctccggcacagcacgttccagcagcacgcgctggaccgcgcgtccccctcgtactcgctcgtcgtcgacgcgaacccggcgttcggagacttcacgaccatccaggccgccgtcgactcgctcccagacatgaacctcgtccgcgtcgtcatcagggtcaaccccggcacctacacggagaaggtgagcatctcggcgatgcgcgcgttcatcaccctggagggcgccggcgcggacagcacgatcgtgcagtggggcgacaccgcggactcgccgacgggggccaagggacgggcccctcggcacgttcaactccgcgtccttcgccgtgaacgcgcagtacttcc

SEQ ID NO: 7742 - protein, 157 aa, Zea mays
  misc_feature: Ceres CLONE 358718-F
  misc_feature: SWISSPROT Homolog: EC 3.1.1.11 Pectinesterase
MGMPRARPLACIAVAAIALLAPTRGAEMVERQFVEWVRYMGGLRHSTFQQHALDRASPSYSLVVDANPAFGDFTTIQAAVDSLPDMNLVRVVIRVNPGTYTEKVSISAMRAFITLEGAGADSTIVQWGDTADSPTGAKGRAPRHVQLRVLRRERAVL

SEQ ID NO: 7743 - DNA, 501 bp, Zea mays
  misc_feature: Ceres CLONE 358774-F
  misc_feature: Encodes the peptide sequence at SEQ ID NO. 7744
aaaaagataagaggaaaggatctccaccgagaaaaccctaattcgaacaaccgcgccgccgtcaccgactcaccgtcgtctctcgctcactcgctcgcgctctccatccagatcggagcgctcggttcggataggggcgactaggaggtgaaggcgggcgcgtcagccatggcggacgaggagcacccggagaggagggaggaggcctccgagcttgccccctttgatccaaccaagaagaagaagaagaagaaggttgtcatccaagagccttctgatgaagtggacaagcttgcagagaagacagaatcgctagcagttgcagaacctgctgaacttaacttcactggaatgaagaagaaaaagaagaagcaggtggatcttgattcatctattgatgaccttggagatggggaggacactcaaggtgatcaagttgtagaggaacaaggggacggtattgtgcttggaggtggcctacatatccttgggaaggaactg

SEQ ID NO: 7744 - protein, 111 aa, Zea mays
  misc_feature: Ceres CLONE 358774-F
MADEEHPERREEASELAPFDPTKKKKKKKVVIQEPSDEVDKLAEKTESLAVAEPAELNFTGMKKKKKKQVDLDSSIDDLGDGEDTQGDQVVEEQGDGIVLGGGLHILGKEL

SEQ ID NO: 7745 - DNA, 403 bp, Zea mays
  misc_feature: Ceres CLONE 358794-F
  misc_feature: Encodes the peptide sequence at SEQ ID NO. 7746
actaccgcaggccgcagcccagcaccggccgctctacgccggcacgtcctcgtttctgtccgaggtcatcgcctccgcaacttcgtggccggtgaggtcgcaccaccatggcgtcgctcctagcccggcaggcagcgcaggcgctccgcgcgaggcaaacggcgcagctcgggccggccgcgtcggcgatgcaagggcacctccgtacctacatgaacgcggggattcccaagcggttcaaagaggatgaggagaaagaacagcttgcaaaagatctcgcaaaagattggaatgctgtgtttgaaaggagcatcaatacattgtttttgactgaaatggtccgtggcttgatgctaactctcaagtacttctttgayagaaatgtcacaattaactatccgtt

SEQ ID NO: 7746 - protein, 98 aa, Zea mays; identical to SEQ ID NO: 6469
  misc_feature: Ceres CLONE 358794-F
  misc_feature (64)..(98): SWISSPROT Homolog: EC 1.6.5.3 NADH dehydrogenase (ubiquinone)
  misc_feature (69)..(98): SWISSPROT Homolog: EC 1.6.99.5 NADH dehydrogenase (quinone)

SEQ ID NO: 7747 - DNA, 363 bp, Zea mays
  misc_feature: Ceres CLONE 358855-F
  misc_feature: Encodes the peptide sequence at SEQ ID NO. 7748
aaaacccaaaccctaattgcgacctctgttcccccaaaaccctacggccatggacggcggargcggtggtgtagggggaggcggagttggggcaggtgtcatggtgggcggcggcgttggcgttggcgttggcggagacgtggagctcgtcagcaagacgctgcagttcgagcacaagctgttctacttcgatctgaaggagaacccgcgggggaggtacctcaagatctccgagaagacctcggccacgcgctccaccatcatcgtccccgtygacggcgtggcctggttcctcgacctcttcgactactacatccgcaccgacgagcgcgacgccttcagcaaggagctgcgactccagac

SEQ ID NO: 7748 - protein, 104 aa, Zea mays
  misc_feature: Ceres CLONE 358855-F
  misc_feature (5)..(5): Xaa is any aa, unknown, or other
MDGGXGGVGGGGVGAGVMVGGGVGVGVGGDVELVSKTLQFEHKLFYFDLKENPRGRYLKISEKTSATRSTIIVPVDGVAWFLDLFDYYIRTDERDAFSKELRLQ

SEQ ID NO: 7749 - DNA, 377 bp, Zea mays
  misc_feature: Ceres CLONE 358859-F
catcactggccaacatcatgtcgtttggcagcttggccatgcactcctggtacctggccagcaagctagagctgtgaagaaggggagacaagacgacacctttctccgccttgttgtgaatcttgtcagttgtcacgatggtgttgcttgctgctctcaaaccagtttcaaaattggaataactagaaaatggccagacacatacagacagggttttgtaaaatcacactatctccgatctcgaatattttgcaaaaccgcatgtcctcgtgcaaaaccatgtccacatgatgacaccgttctcgaatattctgtcgacaccaaaaccacatgtggatttatgccattatgaaagctaggtttttcccaaaaaaaaa

SEQ ID NO: 7750 - DNA, 671 bp, Zea mays
  misc_feature: Ceres CLONE 358876-R
cgattgggtaccgggccccccctcgaggtcgacggtatcgataagcttttttttttttttttttcgctttcgttcactttttggattgggctgggaattaaaaccaagcgaggaattcgagagtagcagcgagcaggcaatgcagcgaacccgctcggcaatgctgcgcgggagggtggcgcacccgcgcttggcgcggatcttgcaggggacggcgtcctggaactggaggaacttctcgatcgacgccatctccgccgaggccgccctgccccccttgttctttccgctgggtaggctgagctgcggcgccagcgactgctgcaccgcggggccggagacgcgggggcgcttcccgccggacgtcgggtaaggggaaacctcgtccggccaggagccggacgcgaggccgcccatcccacaccccgggatgcgggtgtacccacacgccacgccgctggcgttgctgccggccgactcggggctgccgttgccgccgcctccgtcgagctcctcgctgcccacctccgagatctgcgacatcaccgacccctgccgggacgagaagctcagctgccccttgagccccccggtccctgacgccgttcctgaacccgccgccgcccctgcccacccgggagcatgcctcccgtacccgtttggtccatgtt

SEQ ID NO: 7751 - DNA, 465 bp, Zea mays
  misc_feature: Ceres CLONE 358878-F
  misc_feature: Encodes the peptide sequence at SEQ ID NO. 7752
  misc_feature (426)..(426): n is a, c, t, g, unknown, or other
gaaaaaaaccctagctcacttaacgccgccgcggagctgctccgcgcccccgacgccggtgattaggagcaggagcaagaggggttcggaatggccaagtctaagaaccacacggcgcataaccagtcgttcaaggcgcacaagatcggcatcaagaagcccaagcgccaccgccagacctccaccaaggggatggaccccaagtttctgaggaacttgaggtactcaaggaagggcaataagaagagttgtgaggctgagtcagaggagtgagatgatgcctgagtttgtggcgacaaatgcatctcttgtatcgttagggtcttagttgtgaacttaattttcacatctgtatgattaaaagagattcatcaattggtactgaagtgttgtttttttgtctttgttgcctatctggagtttatntaactaaaatcatcagtystgtccttgagaatcgggcac

SEQ ID NO: 7752 - protein, 60 aa, Zea mays
  misc_feature: Ceres CLONE 358878-F
  misc_feature (3)..(42): Pfam Name: Ribosomal_L29e Pfam Description: Ribosomal L29e protein family
MAKSKNHTAHNQSFKAHKIGIKKPKRHRQTSTKGMDPKFLRNLRYSRKGNKKSCEAESEE

SEQ ID NO: 7753 - DNA, 384 bp, Zea mays
  misc_feature: Ceres CLONE 359075-F
  misc_feature: Encodes the peptide sequence at SEQ ID NO. 7754
  misc_feature (342)..(342): n is a, c, t, g, unknown, or other
atttttttcccgtccggtctttccgttacccggcggcttaaaccctagttcccattccatcttcgtttccgctccgccgccgtcgatggagttctggggtctcgaggtcaaacctggatccactgtcaagtgtgagcctggacatggctttatcctgcacgtttcccaggctgcccttggggaatcaaagaaaagtgacagtgccttaatgtatgtcaaagttgatgacaagaagcttgccattggaacgctctctatcgacaaatacccacagatacaattcgatttggttttcaataaagagtttgagctgtcacacacatcgaaaactaccagtgtatntttctctggttacaaggttgagcagccaattgagggagatga

SEQ ID NO: 7754 - protein, 99 aa, Zea mays
  misc_feature: Ceres CLONE 359075-F
  misc_feature: SWISSPROT Homolog: EC 5.2.1.8 Peptidylprolyl isomerase
  misc_feature (86)..(86): Xaa is any aa, unknown, or other
MEFWGLEVKPGSTVKCEPGHGFILHVSQAALGESKKSDSALMYVKVDDKKLAIGTLSIDKYPQIQFDLVFNKEFELSHTSKTTSVXFSGYKVEQPIEGD

SEQ ID NO: 7755 - DNA, 464 bp, Zea mays
  misc_feature: Ceres CLONE 359108-F
  misc_feature: Encodes the peptide sequence at SEQ ID NO. 7756
atcgcaagaaaaaggaaatcaaaacaaagtaaagtggggggaaaagcatggcgatagctcttctcccatccgttcgtcttcttccacaaagtctctccagaaggccaccaccaacctcgtcgccattatccgttcgccgcccacggccaagagcccttcccctccctcgcgtccactgccgcgccggccggaccccggaccccctcaccgctgctagggaggctgctgccttttgggctgggaagctcgccggcgctgtgccatggaaggccgcggtctccggcgtggtcgccctcgccgtctccttcacctgccttgttggtttggccaatgccagaactggggtaaacaaaccagaattgcttcctaaagaatttactaccgtcatcgatgttgctggttttctctcgtcaggccaggaaaaccgtttgcgccaagagatagaagacctggagaaagataca

SEQ ID NO: 7756 - protein, 139 aa, Zea mays
  misc_feature: Ceres CLONE 359108-F
MAIALLPSVRLLPQSLSRRPPPTSSPLSVRRPRPRALPLPRVHCRAGRTPDPLTAAREAAAFWAGKLAGAVPWKAAVSGVVALAVSFTCLVGLANARTGVNKPELLPKEFTTVIDVAGFLSSGQENRLRQEIEDLEKDT

SEQ ID NO: 7757 - DNA, 505 bp, Zea mays
  misc_feature: Ceres CLONE 359109-F
aaatccaacctatatatcacatttagcacacagaatacgtctctaatataaatttttgacgtgtagaggacacccaggagacaggctacctaaacctcgctatataagctgaggtacacagagataagagacggttgcattgcatctgagaaattagctactcgatcactgtagtggtattattaccgaactccaaataagcaatgtcgacaacttcgacatccctcggcctgctaatccgtccgccaagatcagctggtacgccgtcctttgggtctctcaaaccagtagtggtgactctcccttgtgctcctgctgagaagaagcggcctcgatccatctgttactctgtggatgccaaggctaccgaccatgccttcaacatctctcccgttgcccttgtgcatcccaacatgccgccaacgtcgacgccgcgatgggagatcaaggaagatggcaaggaagtcaggctgacattcttcaactttgtcggagggtgctacaa

SEQ ID NO: 7758 - DNA, 523 bp, Zea mays
  misc_feature: Ceres CLONE 359127-F
  misc_feature: Translation starting site: 101
ctaataaaccctgcacctccatcgcaccctctccgccgccaagaccatcctcgcatccgggttgccagctctccttgagcccagaagcacaccgcgcgccatgcgaccaccgagagggcgaggcggtggtggccggttcggcggaggaggaggccggggccgcggcgggggccgattcagcggtggtggccgagaggcggcgggggccgcttcggcggcgggttccgcgacgagggcccgcccgcggaggtcgtcgaggtttcgacgttcctgcacgcgtgcgagggggaggcggtgacgaagctcaccaacgagaaggtgccctacttcaacgcgcccatctatctgcagaacaagacccagatcggcaaggttgaagagatcttcggccccatcaacgaatcctatttctctgtgaagatgatggaggggatcattgcaacatcgtacaatgaaggcgacaagttctatatcgacccaatgaaattgctgccgctctcacgcttcctgccacaaccaaagg

SEQ ID NO: 7759 - DNA, 453 bp, Zea mays
  misc_feature: Ceres CLONE 359155-F
  misc_feature: Encodes the peptide sequence at SEQ ID NO. 7760
accgcagccctagcgcgccgccaccttcaccttcccaggccgccgccgccgccgcctccattgctgctaaacccgcaaccatgggtcccgtgctgaagcgcccgaccccgggcacggtgcagtgcttcgggcgcaagaagacggccgtggccgtggcctacacgaagccaggccgggggatgatcaaggtgaacggcgtcccgatcgagctgctccgtcccgagatgctgcggctcaaggccatggagcccgtgctgctggcggggcggtccaggttcaaggacatcgacatgcggatccgcgtgcgcggcggcgggaagacgtcgcagatctacgccatccgccaggccgtcgccaagggtctcgtggcctactaccagaagtacgtggacgaggcggcgaaaaaggagatcaaggacatcttcatgcgctacgagcgcaccctcctcgtcg

SEQ ID NO: 7760 - protein, 124 aa, Zea mays
  misc_feature: Ceres CLONE 359155-F
  misc_feature (17)..(124): Pfam Name: Ribosomal_S9 Pfam Description: Ribosomal protein S9/S16
MGPVLKRPTPGTVQCFGRKKTAVAVAYTKPGRGMIKVNGVPIELLRPEMLRLKAMEPVLLAGRSRFKDIDMRIRVRGGGKTSQIYAIRQAVAKGLVAYYQKYVDEAAKKEIKDIFMRYERTLLV

SEQ ID NO: 7761 - DNA, 485 bp, Zea mays
  misc_feature: Ceres CLONE 359174-F
  misc_feature: Encodes the peptide sequence at SEQ ID NO. 7762
tctgactagtcactagccgaccgcgcgggaagcggtccggttcacgacttcacgccgctggctcccctcgccatggccggggaccgcggccgcggggccgcggagagggtggatgctgccgtgggggcggtgggatccggtggctgggagttccggaacgcgtacaggcgccagctgctggctctgtcgcagcggatccggctcctcggccccttcgccgaggagctgcgggaggcacgccgggggtccgcggagcaggaggagcaggagcgggcgctggcgcctctcgccgacgcgctggaggaggcactcgacctgctccagctcggccgcgacggcagcaggatattcctggtccttgatagggatgaagtaatgaagaagttccatgaatcaattgctcagctggagcaagccctgtgcgattttccatatgataaactggatatatctgatgaamgctagagagcaggttgagttagtgc

SEQ ID NO: 7762 - protein, 129 aa, Zea mays
  misc_feature: Ceres CLONE 359174-F
MAGDRGRGAAERVDAAVGAVGSGGWEFRNAYRRQLLALSQRIRLLGPFAEELREARRGSAEQEEQERALAPLADALEEALDLLQLGRDGSRIFLVLDRDEVMKKFHESIAQLEQALCDFPYDKLDISDE

SEQ ID NO: 7763 - DNA, 347 bp, Zea mays
  misc_feature: Ceres CLONE 359204-F
  misc_feature: Encodes the peptide sequence at SEQ ID NO. 7764
actgccagctccggtccgaagagggagggaggargacgccagttgccactgcgcgccgctcccgcctccctctctccatccgacgagctcgagaagccaccatgatctccgcgcgcaccgccgcagcttcccccgcttccctgtggaarcsgggaggacgaagcgagggcggcggcagctgcgacggatgtcggacctacaggaacactttgcggagggccgcagcagcgaaggtgcgtgccttgccgtcgagggcggtggaggcggtcaaaatgggctccgcccgcsgargtggagcaggaggaggcggaggtagccgcrgccgcggacggcgtcgtcgtcgagga

SEQ ID NO: 7764 - protein, 82 aa, Zea mays
  misc_feature: Ceres CLONE 359204-F
  misc_feature (17)..(17): Xaa is any aa, unknown, or other
  misc_feature (63)..(63): Xaa is any aa, unknown, or other
  misc_feature (64)..(64): Xaa is any aa, unknown, or other
  misc_feature (74)..(74): Xaa is any aa, unknown, or other
MISARTAAASPASLWKXGGRSEGGGSCDGCRTYRNTLRRAAAAKVRALPSRAVEAVKMGSARXXGAGGGGGSRXRGRRRRRG

SEQ ID NO: 7765 - DNA, 461 bp, Zea mays
  misc_feature: Ceres CLONE 359210-F
gctagtaccagtagtcgtcgcgtttgcagctaggcagatctgagttagccggcggatccgatccgtgcgcgtgcgcagtgtgtgtgtgtgtgtgtgtgtgtgtgtgtgtcggtggagagatggccacagcttacgctcccatggcgagccaggtgatraagagcagcctcgtcgtgcactcgaggccgaggggcctgtcaggcgctgctgcgctcacgaggcggcccggccggttcaccgtcaaggccatccagcccgagaaggcaactaccaggtggtgcagcccatcaacggcgaccccttcatcggcagcctggagacgcsggtcacctcgagcccgctcgtggcgtgrtacctctccaaccttccggcctaccgcaccgcygtgagcccgctgctgcggggcgtcgaggtcggcctcgcgcacggctacctcctcgtggggcctttcgcgctcacgg

SEQ ID NO: 7766 - DNA, 479 bp, Zea mays
  misc_feature: Ceres CLONE 359231-F
  misc_feature: Encodes the peptide sequence at SEQ ID NO. 7767
  misc_feature (454)..(454): n is a, c, t, g, unknown, or other
agaaccggctctgacaataggccccaccctcacggcctaacctttctctttctctctctacctcctcgcgcgccctcgtcagaccagccacgcgctcaactccacgggccttgagctagggttttcttcgccgctacctccctacgaggcgggcgtgcagccatggcgctggtgcaggcgggcatgggccttacccgggtcgttatcctcgtcggcgccggcgttgccggctccgtcgtcctccgcaacggccgcctcgccgagatcctcggcgagctccaggagatactcgacaaggggaagaaggtgaaggatggaggagggggagacggggaaaccgatctcaacgaggctcttacctcgcaggtgcgtcgccttgccatggaggtccggcaacttggtaattcacgttcaataactgttctcaatggaggttctgcacwatcaggagtancagggcctgatagtacytgcagcaa

SEQ ID NO: 7767 - protein, 105 aa, Zea mays
  misc_feature: Ceres CLONE 359231-F
  misc_feature (94)..(94): Xaa is any aa, unknown, or other
  misc_feature (98)..(98): Xaa is any aa, unknown, or other
MALVQAGMGLTRVVILVGAGVAGSVVLRNGRLAEILGELQEILDKGKKVKDGGGGDGETDLNEALTSQVRRLAMEVRQLGNSRSITVLNGGSAXSGVXGPDSTCS

SEQ ID NO: 7768 - DNA, 474 bp, Zea mays
  misc_feature: Ceres CLONE 359299-F
  misc_feature: Encodes the peptide sequence at SEQ ID NO. 7769
atcagtacccaaccttcccctacaccagaaaaatccccagttctttggtccgcgtcagagaggcggcggcgatgtctgggcgcggcaagggcggcaagggtctgggcaagggcggcgcgaagcgccaccggaaggtgctccgcgacaacatccagggcatcaccaagccggcgatccggaggctggctaggaggggtggcgtgaagcgcatctcggggctcatctacgaggagacccgcggcgtgctcaagatctttctcgagaacgtcatccgcgacgccgtcacctacaccgagcacgcgcgccgcaagaccgtgaccgccatggacgtcgtctacgcgctcaagcgccagggccgcaccctctacggcttcggaggctaggctaggcgcctcttcgtagtcggggactggtyaggggacatgtctctgtgtgatgctttctgcatccttgttgtatctggatggatttgac

SEQ ID NO: 7769 - protein, 103 aa, Zea mays; identical to SEQ ID NO: 6459
  misc_feature: Ceres CLONE 359299-F
  misc_feature (25)..(94): Pfam Name: Histone Pfam Description: Core histone H2A/H2B/H3/H4

SEQ ID NO: 7770 - DNA, 782 bp, Zea mays
  misc_feature: Ceres CLONE 359305-R
  misc_feature (17)..(17): n is a, c, t, g, unknown, or other
  misc_feature (18)..(18): n is a, c, t, g, unknown, or other
  misc_feature (28)..(28): n is a, c, t, g, unknown, or other
  misc_feature (36)..(36): n is a, c, t, g, unknown, or other
  misc_feature (86)..(86): n is a, c, t, g, unknown, or other
  misc_feature (95)..(95): n is a, c, t, g, unknown, or other
  misc_feature (144)..(144): n is a, c, t, g, unknown, or other
  misc_feature (727)..(727): n is a, c, t, g, unknown, or other
cgattggggacccggtnncccctcgagntcgacggnatcgataaggtttttattttttttttttacgagggaccgctaagcccggncttggctancttaacgtaacaggcctaggtagctagatacatatagggcgcggttggngcgtttcgcagcggagcccgcccgctccaaacaggctagccagggcccggctcccgagatacggaagcgagacccgggtccccacagcctgggtcacagcgagatgctgcaccccgcggtgcaggggagcacagacatacaggcagccaaacaccgccccccagcccaccggacacggagaccagcaaccagagaagcgtacgccggatcttaccaggctggccggcccatatgcagcctaccaaacacggccagtaggcgcggaggagcccacagagccctagcaggacggaggagcccggccagcccgagaacacaaggccgggcacgcgccgggggagggggcagcactacaggcgggggggagccacccccccgggcggccggccgcgggcgggcgccgcgcccccggcggagcgcggcggcgtcgccgcctccgggggaccccggaggcaggcgggcgtgggccccccgcgggccccacggggaggcgggggcgagcccccagcgcggaccgcggggaaagggggggcccagcgccccggccggccgcgccgggaggcccgccccgccgcgacagcgncggagaagggccagcccgccgaggcggcgggattcgcgcccccggggcgaaaggg

SEQ ID NO: 7771 - DNA, 440 bp, Zea mays
  misc_feature: Ceres CLONE 359310-F
  misc_feature: Encodes the peptide sequence at SEQ ID NO. 7772
aacactgcatcacaacacacgccagccagccatcgtcacactggtgagctctgcactctgcttagctccgagcttcagtgccttcgttgtttgctccacagtccacacacacacacgtccagctagctgcactgcaccaatggccgccgtcgaggtccaggtcccgactgccgctcccgtcgaggaggctgcccagctggccgccgcctccgccgtcgagaccccgaacgaggagaccgctgctccggcggtggagaccgaggtcgtcgtcgctaaggagccggagccggtggaggccgagactgagactgagaccaaggaggccgaggccgttgctgagccgaccgaggcagagcccaaggaagcagagccggaggccgccgcgccggcagcagagacggaggtcaaggaagcagagacggaggccgccgcgccggcag

SEQ ID NO: 7772 - protein, 100 aa, Zea mays
  misc_feature: Ceres CLONE 359310-F
MAAVEVQVPTAAPVEEAAQLAAASAVETPNEETAAPAVETEVVVAKEPEPVEAETETETKEAEAVAEPTEAEPKEAEPEAAAPAAETEVKEAETEAAAPA

SEQ ID NO: 7773 - DNA, 387 bp, Zea mays
  misc_feature: Ceres CLONE 359319-F
  misc_feature: Encodes the peptide sequence at SEQ ID NO. 7774
gtttagaaactctttttttaactgtttgccggagccggaggcggtttcgactttggagccctccgaggctcttcagaaagaaacaagaaaatctgcaaacgaattgtttgtccaggagaaggcccccgacgcgattattctttctccccgcgtgctctctatctctcccctctttctctccctctgcccgacgactaggccgccgccgccacggccccgccgccgccgccgtgcccaggtctttgtcggtccttgtccggcaacgagcaccctacagatggctgggaggcacaccattattctgatgcagccatctcaaaatagggcttctagaacatttatggattacaattcgattaatcatgcattggatggaatctgtgggcy

SEQ ID NO: 7774 - protein, 36 aa, Zea mays
  misc_feature: Ceres CLONE 359319-F
MAGRHTIILMQPSQNRASRTFMDYNSINHALDGICG

SEQ ID NO: 7775 - DNA, 460 bp, Zea mays
  misc_feature: Ceres CLONE 359355-F
  misc_feature: Encodes the peptide sequence at SEQ ID NO. 7776
atctatctttgtggtcgtggtcctcccgtcgtcgtcgactcgtcgtcgtcggtgttgctccgatgggcaaggactcgaagccgaaggacgccaaggggaagggcaagcaggcggccggctcctctggcggcgacgacsgcggcggcaagggaggcaagggcaagggcaagggcaagggcggcaagtccgctgacggactcggcacttgcacctacgtcaaagctaggcacgtattgtgtgagaagcaggggaagatcaatgaagcttataagaagttgcaggatggatggctgaataatggggacaaagttcctcctgctgagtttgctaaggtagcacaagagtattctgaatgcccatcagggaagaaaggtggagatcttggttggttcccgcgtggcaagatggctggtctttccaggaggttgctttcaacacacctgagggaactgttagcgca

SEQ ID NO: 7776 - protein, 132 aa, Zea mays
  misc_feature: Ceres CLONE 359355-F
  misc_feature (56)..(132): Pfam Name: Rotamase Pfam Description: PPIC-type PPIASE domain
  misc_feature: SWISSPROT Homolog: EC 5.2.1.8 Peptidylprolyl isomerase
  misc_feature (26)..(26): Xaa is any aa, unknown, or other
MGKDSKPKDAKGKGKQAAGSSGGDDXGGKGGKGKGKGKGGKSADGLGTCTYVKARHVLCEKQGKINEAYKKLQDGWLNNGDKVPPAEFAKVAQEYSECPSGKKGGDLGWFPRGKMAGLSRRLLSTHLRELLA

SEQ ID NO: 7777 - DNA, 472 bp, Zea mays
  misc_feature: Ceres CLONE 359368-F
  misc_feature: Encodes the peptide sequence at SEQ ID NO. 7778
attctctgtcgccttcgcccctccaaggttctctgattccagacgcaaccccgcggggtcaaggagccagagggggggtgcacagcgatcgttctgccggagatcgaaaccctaaggtagggtttgaggcgccgggctgcggccgcgagatgtcgacgccggcgaggaagcggctgatgcgggacttcaggcgcctgcagcaggacccgcccgccgggatcagcggcgcgccgcacgacaacaacatcatgctctggaacgccgtcatattcgggccggatgatacgccttgggacggaggcacgttcaagcttaccttgcagtttacagaagattacccaaacaagccaccaactgttcggtttgtctctaggatgtttcatccaaacatatatgctgatggaagcatctgcttggatatcctacagaaccagtggagtcctatatatgatgttgctgcatcttgacttct

SEQ ID NO: 7778 - protein, 105 aa, Zea mays
  misc_feature: Ceres CLONE 359368-F
  misc_feature (8)..(105): Pfam Name: UQ_con Pfam Description: Ubiquitin-conjugating enzyme
  misc_feature: SWISSPROT Homolog: EC 6.3.2.19 Ubiquitin--protein ligase
MSTPARKRLMRDFRRLQQDPPAGISGAPHDNNIMLWNAVIFGPDDTPWDGGTFKLTLQFTEDYPNKPPTVRFVSRMFHPNIYADGSICLDILQNQWSPIYDVAAS

SEQ ID NO: 7779 - DNA, 435 bp, Zea mays
  misc_feature: Ceres CLONE 359390-F
  misc_feature: Encodes the peptide sequence at SEQ ID NO. 7780
acacccacacagcaagccagcagagcagaaagcagccgcagccccagcccccacaagacgaggcaacaatggcgctagaagcagccaccgccccccgcgcactcctcgccgcgtgcctcgtcctgctggtcctcggcggcggcaccggcccgtcgtcggtgctgcgcggcgccggggcgcaggccggcgggcagtgcctgccgcagctgaaccgcctcctggcgtgccgcgcgtacctggtgcccggcgcgccggaccccagcgcggactgctgcagcgcgctgagcgccgtgtcgcacgagtgcgcctgcagcaccatgggcatcatcaacagcctgcccggccggtgccacctcgcccaagccaactgctccgcttgaagcagggacctggcacgcgtgctgcaatggatggcaggaggggagaggaataaga

SEQ ID NO: 7780 - protein, 103 aa, Zea mays; identical to SEQ ID NO: 6200
  misc_feature: Ceres CLONE 359390-F
  misc_feature (43)..(101): Pfam Name: Tryp_alpha_amyl Pfam Description: Protease inhibitor/seed storage/LTP family

SEQ ID NO: 7781 - DNA, 513 bp, Zea mays
  misc_feature: Ceres CLONE 359451-F
  misc_feature: Encodes the peptide sequence at SEQ ID NO. 7782
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcabcgtctggacatctcgaacgcggcggtgacgcagatggcgacggaggcgtccctgtcgtgcgtccgctcgtggggcggcgcgctctcgtccatcacccacctcgtgtacgtctcgtcgagcgaggcgcgc

SEQ ID NO: 7782 - protein, 143 aa, Zea mays
  misc_feature: Ceres CLONE 359451-F
  misc_feature (10)..(143): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
  misc_feature (100)..(100): Xaa is any aa, unknown, or other
MVSSSMDTTSDKRASSMLAPNPGKATILALGHAFPQQLVMQDYVVDGFMKNTNCDDPELKEKLTRLCKTTTVRTRYVVMSDEILKNYPELAQEGLPTMNXRLDISNAAVTQMATEASLSCVRSWGGALSSITHLVYVSSSEAR

SEQ ID NO: 7783 - DNA, 423 bp, Zea mays
  misc_feature: Ceres CLONE 359457-F
  misc_feature: Translation starting site: 14
  misc_feature: SWISSPROT Homolog: EC 1.14.11.2 Procollagen-proline dioxygenase
atttcgccacgccatggttttctgcagccacctccatctcgcggctgtgctcgcgctcctcaccggctgcgcttctgcggcgagccggggcgctggttccttcgacccatcccgcgtggttcaactctcttggcgccccagggcgttcttgcacaagggtttcctgttggatgcggagtgcgaccacctcatcgcgctggccaaggacaagctggagaagtctatggtggcggacaacaagtccggtaagagtgtccagagtgaggtgcgcaccagctccggcatgttcctagaagaagcaggatgaagtagtaacgagaatagaggagaggatatctgcttggacatttcttccaccagagaatggtgaagccattcagatattacactaccagaatggtgagaaatatgaaccccactacg

SEQ ID NO: 7784 - DNA, 399 bp, Zea mays
  misc_feature: Ceres CLONE 359458-F
  misc_feature: Encodes the peptide sequence at SEQ ID NO. 7785
ctctagccaaaaccctagcagccgccggtgctccctctctgcagatctcccttcgcagcccgcggaagggaaaccccttcacagcgcggaagatggctgaacaggaggccccagtcgtggttgaggcaccaaccccagttcttggggagcctatggacttgatgactgctctgcagctcgtgatgaagaagtcaagtgctcatgatggacttgtgaagggtctccgtgaggctgccaaggccatcgagaagcacgccgctcagctttgcgtgcttgctgaggactgtgaccagccagattatgtcaagctggtgaaggcactctgcgcggagcacaatgttcacctggtcactgttcctgccgctaagacccttggcgagtgggctgggctttgcaaga

SEQ ID NO: 7785 - protein, 102 aa, Zea mays
  misc_feature: Ceres CLONE 359458-F
  misc_feature (25)..(102): Pfam Name: Ribosomal_L7Ae Pfam Description: Ribosomal protein L7Ae/L30e/S12e/Gadd45 family
MAEQEAPVVVEAPTPVLGEPMDLMTALQLVMKKSSAHDGLVKGLREAAKAIEKHAAQLCVLAEDCDQPDYVKLVKALCAEHNVHLVTVPAAKTLGEWAGLCK

SEQ ID NO: 7786 - DNA, 489 bp, Zea mays
  misc_feature: Ceres CLONE 359477-F
  misc_feature: Encodes the peptide sequence at SEQ ID NO. 7787
gtgctttctcagaggtgggttggcttctcctcccccaccggttcgtgttcaggttctggttcgtgggcgagagggaagagatggcggcgtcggacgttgagtaccgttgcttcgttggcggcctcgcctgggccaccgacgaccactccctcaacaacgccttcagcacctacggcgaggtcctcgagtcgaagatcatcctggatcgggagacgcagaggtcccgcggcttcggcttcgtcaccttctccacggaggacgcgatgcgcagcgccatcgagggcatgaacggcaaggagctcgacggccgcaacatcaccgttaacgaggcccagtcccgcggcggccgtggaggcggcggtggcggatacggtggcgggcgccgtgatggaggcggctacggggactggtacaaccaggagctggacctcaccctgcagcagcggatgcgctgggtgcagcgcaagtacatgatctacaactactgca

SEQ ID NO: 7787 - protein, 136 aa, Zea mays
  misc_feature: Ceres CLONE 359477-F
  misc_feature (10)..(81): Pfam Name: RRM_1 Pfam Description: RNA recognition motif. (a.k.a. RRM, RBD, or RNP domain)
  misc_feature (103)..(136): Pfam Name: XET_C Pfam Description: Xyloglucan endo-transglycosylase (XET) C-terminus
  misc_feature (11)..(85): SWISSPROT Homolog: EC 5.2.1.8 Peptidylprolyl isomerase
  misc_feature (110)..(136): SWISSPROT Homolog: EC 2.4.1.207 Xyloglucan:xyloglucosyl transferase
MAASDVEYRCFVGGLAWATDDHSLNNAFSTYGEVLESKIILDRETQRSRGFGFVTFSTEDAMRSAIEGMNGKELDGRNITVNEAQSRGGRGGGGGGYGGGRRDGGGYGDWYNQELDLTLQQRMRWVQRKYMIYNYC

SEQ ID NO: 7788 - DNA, 464 bp, Zea mays
  misc_feature: Ceres CLONE 359545-F
atcttactgggtgggaaagagaaaaataatcacgctagtatgaagaaattgacgtcaactgcatttacggagttcctaccgagttgctaaatgtggagagtaaatagagttgaatagcaactaagtaaatttagcaagtctatttagagaaccattggagaagcatttttctgttcatttcttaaatttaagatttagagagttgtttagagaactattgaagttgctcttagaggcccttgttgtcttgttgaagagttgaagacaccgcagttccggaaacttctgtagcagctgaaatagtacggacgtgtttgaacatgtacaggatctcgaggccacatctgtaaaacgaccacccctcacgcggaagcggagactggaaatcgggagggagaccggagacgagaccgccggagatggagccgagatctgcaatctacagatccggcgccttccttctc

SEQ ID NO: 7789 - DNA, 427 bp, Zea mays
  misc_feature: Ceres CLONE 359573-F
  misc_feature: Encodes the peptide sequence at SEQ ID NO. 7790
aaaggtcgcgttccatcgattctccacgagcggatagcggcgtacagatcttttcgtgctcgtcttcgcgtcggtgtggctggcccgtgactgtgagaagtcaaaatctcacagcatattgattgggctgattccgtgggagggaatcggggatctggcattctcgcgcccaaaaggtcgcagctttctttcgtgtcgccagccggtgcgcggtcgacgcagagcgcgtggagggtgtcccgctagtagctcctcgacgacgacggtgacgggaggccgggggttgaccatggtggcggcggcggacctggaggcggcggascgggtggtggcggagctccgcgaggcgtgcgcggcgcggctcgacgaggtggcggcggcgatggaggcggagatgcgcgccggactgcgcgaggagggcggcagc

SEQ ID NO: 7790 - protein, 46 aa, Zea mays
  misc_feature: Ceres CLONE 359573-F
  misc_feature (11)..(11): Xaa is any aa, unknown, or other
MVAAADLEAAXRVVAELREACAARLDEVAAAMEAEMRAGLREEGGS

SEQ ID NO: 7791 - DNA, 502 bp, Zea mays
  misc_feature: Ceres CLONE 359580-F
  misc_feature: Encodes the peptide sequence at SEQ ID NO. 7792
aatgaagtcgccgaaccacctcctatcggtaccaaactagcagcgccaatggggtcagggtgagaccgccgacgctgttcctcaacttcgccatcggtcggagtctgccaggcggccgggtttgggaacgccaatgccgggagagaaattaagatcgacctgtgtggatcttcctcaagcgcgagatgtagggatggatggcctcggccatggtgttcccttgccggtgcgggtctcgccgcggtgccgcaaccccgacgtggaccgatctcgtctcaaccttgtcgctgacgagcaagctacagaggattctgaggttcagctggtagagactgctgagcaggagctcgttgaaggagaagaataggtggttcaagtggagccaagtatcgaggagttcgattcgatctaggtggcgtctcccagtcagctttctggcgccaaggatagattttagatcctgcgatatttatctcttattttgtaagacttccgctatgta

SEQ ID NO: 7792 - protein, 77 aa, Zea mays
  misc_feature: Ceres CLONE 359580-F
MPGEKLRSTCVDLPQARDVGMDGLGHGVPLPVRVSPRCRNPDVDRSRLNLVADEQATEDSEVQLVETAEQELVEGEE

SEQ ID NO: 7793 - DNA, 242 bp, Zea mays
  misc_feature: Ceres CLONE 359624-F
aatctcgttgcccgttgtgctctctctctctattcgttccccgcctcaccccgagccagccgtctcgctagggtttcgccgccgccgcgcgcggcggtggcggwtctggcggcggcggtcgcagctacggtggtagctggggcggcggccggagatccggcggcgggggcggtcctggcgcgtgctacaattgcggcgagcccggccacatggccagggactgccctagcgccgacggcgga

SEQ ID NO: 7794 - DNA, 448 bp, Zea mays
  misc_feature: Ceres CLONE 359642-F
  misc_feature: Encodes the peptide sequence at SEQ ID NO. 7795
aaaaagcgcagagcgcatcagcgcagagcaggacagccatggcgacggcggcggcgcagtcccattcgccatcaatggacgcgcgccggtgggacgagtcatcgtaccgccgcggcatcctccgtgcccgcgacctctcgtcccgcaccctcttccgtgccgtcttctttgaccacagcgacgacccggataccgacatcctactcgccgccgcctccagcgacggttccctcgcttccttctccctttcatcctgcatctccgcatgttccactacctcccaggtggagacygccgccactctggtcgaccctgtctgcatcgtgcaagcgcacagcggacctgcctacgacgtcaggttctaccccgatcaacagcagccgctgctcttcagctgcggggacgatggccgcatcaagggttggaggtggcacgagatgcagagctg

SEQ ID NO: 7795 - protein, 136 aa, Zea mays
  misc_feature: Ceres CLONE 359642-F
  misc_feature (90)..(130): Pfam Name: WD40 Pfam Description: WD domain, G-beta repeat
MATAAAQSHSPSMDARRWDESSYRRGILRARDLSSRTLFRAVFFDHSDDPDTDILLAAASSDGSLASFSLSSCISACSTTSQVETAATLVDPVCIVQAHSGPAYDVRFYPDQQQPLLFSCGDDGRIKGWRWHEMQS

SEQ ID NO: 7796 - DNA, 431 bp, Zea mays
  misc_feature: Ceres CLONE 359666-F
  misc_feature: Encodes the peptide sequence at SEQ ID NO. 7797
acaaacctctcctggcacgagatcacgcttctcgttggatcgaacagctagggtttccaagatgttcgggcgcgcgccgaagaagagcgacaacacacggtactacgagatcctcggggtctccaaggacgcgtcccaggatgacctcaagaaagcctaccgcaaggccgccatcaagaaccaccccgacaagggcggcgatcccgagaagttcaaggagctagctcaggcttatgaggtcctcagtgatcctgaaaagcgggagatttatgatcaatatggtgaggatgccctcaaggagggaatgggaggtggtggagggatgcacgatccctttgacatattccagtcatcaccaccagctgccattgccatctactgacctgtgacctccgcatttccaaacagcccgagcgagcgagctagcagag

SEQ ID NO: 7797 - protein, 106 aa, Zea mays
  misc_feature: Ceres CLONE 359666-F
  misc_feature (13)..(71): Pfam Name: DnaJ Pfam Description: DnaJ domain
MFGRAPKKSDNTRYYEILGVSKDASQDDLKKAYRKAAIKNHPDKGGDPEKFKELAQAYEVLSDPEKREIYDQYGEDALKEGMGGGGGMHDPFDIFQSSPPAAIAIY

SEQ ID NO: 7798 - DNA, 449 bp, Zea mays
  misc_feature: Ceres CLONE 359684-F
  misc_feature: Encodes the peptide sequence at SEQ ID NO. 7799
  misc_feature (381)..(381): n is a, c, t, g, unknown, or other
aattatattgccccccacaccacaccacccccgactcctcacgaccattaatctgaagaagtgctttggtgtaggcctgctgcttgctcatcagctcgcgtataaacatgtctcttcccacgcggacgtagagctagctagctagctagatgtgtgtgtgcatagaatagcgccagtagatcccggccaaccttaagaggaggggagacacaaacggctctggcttttttcggaagggtgtctggaactcttccggttgccgacagagagggaaggggacatatggggaggaagctgggcggcctggacagggtcctggactgcttgtcgctctccctgctgtgctccggcgcctgcgcctgcgtacactccatggatgangaagaggaggaggacgacgagcggaagcaggccctgctgctgagcagccagctggtgcagcttagggg

SEQ ID NO: 7799 - protein, 55 aa, Zea mays
  misc_feature: Ceres CLONE 359684-F
  misc_feature (33)..(33): Xaa is any aa, unknown, or other
MGRKLGGLDRVLDCLSLSLLCSGACACVHSMDXEEEEDDERKQALLLSSQLVQLR

SEQ ID NO: 7800 - DNA, 369 bp, Zea mays
  misc_feature: Ceres CLONE 359705-F
  misc_feature: Encodes the peptide sequence at SEQ ID NO. 7801
ataggatagacatggcggccgcggtggagggggtgcggcaccgaacgctggaggcgaacggagtgcgcctgcacgtggcggaggctgggcccgaggagggcagcgccccagtggtgctgctccttcacggcttcccggacctctggtacggctggcgccaccagatggccgccctggcggcgcgtggttaccgcgccgtggccccggacctccgcggctacggcgactccgactccccgcctgatgcgtccagctacaccaccttccatgtcgtcggggacctcgttgcgctcatctccgacctcggccagcggcaggtgttcgtggtggggcacgactggggagccaccgtggcgtggcagctttgtc

SEQ ID NO: 7801 - protein, 119 aa, Zea mays
  misc_feature: Ceres CLONE 359705-F
  misc_feature: SWISSPROT Homolog: EC 3.3.2.10 Soluble epoxide hydrolase
MAAAVEGVRHRTLEANGVRLHVAEAGPEEGSAPVVLLLHGFPDLWYGWRHQMAALAARGYRAVAPDLRGYGDSDSPPDASSYTTFHVVGDLVALISDLGQRQVFVVGHDWGATVAWQLC

SEQ ID NO: 7802 - DNA, 515 bp, Zea mays
  misc_feature: Ceres CLONE 359743-F
  misc_feature: Encodes the peptide sequence at SEQ ID NO. 7803
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctgtcgcaggaggggctgccgacgatgaatcagcgtctggacatctcgaacgcggcggtgacgcagatggcgacggaggcgtccctgtcgtgcgtccgctcgtggggcggcgcgctctcgtccatcacccacctcgtgtacgtctcgtcgagcgaggcgcgctt

SEQ ID NO: 7803 - protein, 143 aa, Zea mays
  misc_feature: Ceres CLONE 359743-F
  misc_feature (10)..(143): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MVSSSMDTTSDKRASSMLAPNPGKATILALGHAFPQQLVMQDYVVDGFMKNTNCDDPELKEKLTRLCKTTTVRTRYVVMSDEILKNYPELSQEGLPTMNQRLDISNAAVTQMATEASLSCVRSWGGALSSITHLVYVSSSEAR

SEQ ID NO: 7804 - DNA, 515 bp, Zea mays
  misc_feature: Ceres CLONE 359783-F
  misc_feature: Encodes the peptide sequence at SEQ ID NO. 7805
aaaccagacaggcaccgggcggcatccttcgtctcgtactgacccccgcaccgccaaaccctagtccacagcggcgaggcgaccttgcgacctccgttcctctgcgctccgactgagttgctgatttgggataatcatgttctctctaagtgaatgaacatgtctgggaatgatgataagccacatgctgctgcagacagaataaaggcagccacgttatcagtgactaagggattgagcagggctcaagctgaatgggctacgactgttgctgcccgcaatgtgaatgcctatgggcagaaggaagagggaccaagccgctggcaggagaggaaggaagccaagagtcagatgtatctgatgagtacagagaaggttgcgaagctgggcactgtgaagccaaaagcttcagaaacttcttctattggcgcatatacccaatgccagaagtgtttccagcatggtcactggacatatgagtgccaaaaagagcgggtgtacatatcacgacctca

SEQ ID NO: 7805 - protein, 120 aa, Zea mays
  misc_feature: Ceres CLONE 359783-F
MNMSGNDDKPHAAADRIKAATLSVTKGLSRAQAEWATTVAARNVNAYGQKEEGPSRWQERKEAKSQMYLMSTEKVAKLGTVKPKASETSSIGAYTQCQKCFQHGHWTYECQKERVYISRP

SEQ ID NO: 7806 - DNA, 516 bp, Zea mays
  misc_feature: Ceres CLONE 359807-F
  misc_feature: Encodes the peptide sequence at SEQ ID NO. 7807
gagagaacctgctggtcgtcgaggaagcaacgcaacttgactgctctgtccggctgcgcctacaaatccagcacacaggcgcgcacggcgcatcccgctcctccacctcgtcgcagcccccaaggccccaactacccccagtctcggaagagaactatccagaagcgcaagactccaaagccgtcgccttcctatccatcccttcctcgccgcgggggtcgcctgagatcacataaacaatggtgaaggctgttgctgtgcttggtagcagcgatggtgtcaagggcaccatcttcttcacccaagagggagatggccctaccactgtcaccggaagtgtctctggcctcaagcctggcctccatgggttccatgtgcatgcacttggtgacaccaccaatggctgcatgtcaactggaccacactacaatcctgcgagcaaggaacatggagcaccagaagatgagaaccgccatgccggtgatcttggaaatgtgacagctggagcagatggtg

SEQ ID NO: 7807 - protein, 92 aa, Zea mays
  misc_feature: Ceres CLONE 359807-F
  misc_feature (1)..(92): Pfam Name: Sod_Cu Pfam Description: Copper/zinc superoxide dismutase (SODC)
  misc_feature: SWISSPROT Homolog: EC 1.15.1.1 Superoxide dismutase
MVKAVAVLGSSDGVKGTIFFTQEGDGPTTVTGSVSGLKPGLHGFHVHALGDTTNGCMSTGPHYNPASKEHGAPEDENRHAGDLGNVTAGADG

SEQ ID NO: 7808 - DNA, 450 bp, Zea mays
  misc_feature: Ceres CLONE 359831-F
  misc_feature: Encodes the peptide sequence at SEQ ID NO. 7809
attcgctcccacggtccagactccacagtccacactccccgcatctggcgacattgtgtgctcggcagtctcggactcggagtgagagcgaccaacaagagggaggaaatgatggagaagcgacacggcggcggaggttgcaccctgctccacctcctcggcaccgccgccgcatggcgttcctgctgccgcggtccgccggagctgccaacgacgccaagtggcacgcccatgcccatccggtcgccggcgccggcctctcgccgctctcggcaccgccgcccaccgcgggagccgacgacgacttgctgccgccgcgagccgcgcgcccgtggagaaggccgccccgcacttcggcttccctctgcagccgggcgacgcgtcgcggcggcccgtccggaagcgaggggtacccgtttatcggcagcaacccgacggtgccgctgccca

SEQ ID NO: 7809 - protein, 92 aa, Zea mays
  misc_feature: Ceres CLONE 359831-F
MAFLLPRSAGAANDAKWHAHAHPVAGAGLSPLSAPPPTAGADDDLLPPRAARPWRRPPRTSASLCSRATRRGGPSGSEGYPFIGSNPTVPLP

SEQ ID NO: 7810 - DNA, 157 bp, Zea mays
  misc_feature: Ceres CLONE 359877-F
  misc_feature (125)..(125): n is a, c, t, g, unknown, or other
gcgccagrgccacgcacgctagtgtcagtggcacgcaggbcagccgcgcgcaccgaggggaggccagakctagcggcgaggccaagggcgcgggcgckggcgcggacggcaattggcgagagctnggaggcggcggtccggtccgcggcgcggcgct

SEQ ID NO: 7811 - DNA, 512 bp, Zea mays
  misc_feature: Ceres CLONE 359929-F
  misc_feature: Encodes the peptide sequence at SEQ ID NO. 7812
gtcgcatccatagacttccacgaaaccctagcgcctcatatatatagtttctctcctgccacttttgcgagcttacttcacgcacgccgccgcagccgccgccgctacagcccgcacctcgcttcctctcccgtcgccgagatgacgaagcgaaccaagaaggccggaattgttggcaaatatggaaccaggtatggtgctagcttgcgtaagcaaatcaagaagatggaggtatctcagcactccaagtatttctgtgagttctgtgggaagtttgctgtgaagaggaaagcggttgggatttggggatgcaaggactgtgggaaggtcaaggccggtggtgcttataccatgaacactgctagtgcggtcactgtcaggagcacgatccgtcgcttgagggagcagactgaagcatgatccgtcgcttgtcaggcatactggggtccactatattggctgtttagccgagacagtactccagcatttttgggttatgctctaggatctct

SEQ ID NO: 7812 - protein, 92 aa, Zea mays
  misc_feature: Ceres CLONE 359929-F
  misc_feature (2)..(91): Pfam Name: Ribosomal_L37ae Pfam Description: Ribosomal L37ae protein family
MTKRTKKAGIVGKYGTRYGASLRKQIKKMEVSQHSKYFCEFCGKFAVKRKAVGIWGCKDCGKVKAGGAYTMNTASAVTVRSTIRRLREQTEA

SEQ ID NO: 7813 - DNA, 509 bp, Zea mays
  misc_feature: Ceres CLONE 359933-F
  misc_feature: Encodes the peptide sequence at SEQ ID NO. 7814
acagtcgaaacaaagccacaacacatacaggaaagcaagcaagaatcatcggaataatggcccgtgcatgcgtgttcctcgtcgtgctcctcctggccgccatcgcggtggcaccgttcgcgggcgccgcacgcgtggacgttgtggagggtaggtccatggcatccgccgatgcaccggaggcggcggccgatgctcccgctcctagccccgactccgcctcatccccagactcgtcatcggaggcgccctctagcagcagttcctccgactagacgcaaaaacctcttcattctctggaataactaacagtatatacgttgcaccctgatgatatagaaacatgtacgtgcatcagtgtatggaatgcgagtggcaaacacatggaatgtgcttgcctaattattgtttatttctttatttattatatgtctctctcgtttgttttttatttttcttaatgcaagtaatataatttgttataccccaatatatatagacaatgtgtg

SEQ ID NO: 7814 - protein, 72 aa, Zea mays
  misc_feature: Ceres CLONE 359933-F
MARACVFLVVLLLAAIAVAPFAGAARVDVVEGRSMASADAPEAAADAPAPSPDSASSPDSSSEAPSSSSSSD

SEQ ID NO: 7815 - DNA, 477 bp, Zea mays
  misc_feature: Ceres CLONE 359961-F
  misc_feature: Encodes the peptide sequence at SEQ ID NO. 7816
acccaacgcactcgagctcgagccctcgcccgctcagtcacaaagcctcagatctcagtcgcctgcgccgccgcttcgttcgtgtggaggggagaagacaggaaatggcggcgactgagggcgtgctcttggggatgggcaaccccctcctcgacatctccgccgtcgtcgatgacgccttcctgacaaagtatgacatcaagctgaacaatgctattctcgctgaggagaagcacttgcctatgtatgacgagttggctagcaagagcaatgttgaatatattgccggaggagccacccagaactctatcagggttgcccaatggatgcttcaaactcctggtgcaacaagttacatgggatgcattggaaaggacaagtttggtgaggaaatgaagaaaaacgctcaagctgcaggagttactgctcattactacgaggatgagactgctcctactggcacatgtgctgtatgtg

SEQ ID NO: 7816 - protein, 124 aa, Zea mays
  misc_feature: Ceres CLONE 359961-F
  misc_feature: SWISSPROT Homolog: EC 2.7.1.20 Adenosine kinase
MAATEGVLLGMGNPLLDISAVVDDAFLTKYDIKLNNAILAEEKHLPMYDELASKSNVEYIAGGATQNSIRVAQWMLQTPGATSYMGCIGKDKFGEEMKKNAQAAGVTAHYYEDETAPTGTCAVC

SEQ ID NO: 7817 - DNA, 514 bp, Zea mays
  misc_feature: Ceres CLONE 360001-F
  misc_feature: Encodes the peptide sequence at SEQ ID NO. 7818
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacscagatggcgacggaggcgtccctgtcgtgcgtccgctcgtggggcggcgcgctctcgtccaatcacccacctcgtgtacgtctcgtcgagcgaggcgcgc

SEQ ID NO: 7818 - protein, 143 aa, Zea mays
  misc_feature: Ceres CLONE 360001-F
  misc_feature (10)..(142): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
MVSSSMDTTSDKRASSMLAPNPGKATILALGHAFPQQLVMQDYVVDGFMKNTNCDDPELKEKLTRLCKTTTVRTRYVVMSDEILKNYPELAQEGLPTMNQRLDISNAAVTQMATEASLSCVRSWGGALSSNHPPRVRLVERGA

SEQ ID NO: 7819 - DNA, 431 bp, Zea mays
  misc_feature: Ceres CLONE 360054-F
  misc_feature: Encodes the peptide sequence at SEQ ID NO. 7820
aaggaaatctgggcctttaatcgtcgtcacctagctcgcggatggtccgcacgcagtttccaccgtcagtatcgcattggagtgaaacaactcccatccttgccaccggttaggaacttaggaatggactcgccggtgcctgctacgctcgcgcgcgcgccagcgagaccgcaagcgcgggcgggcgaggaggcttgtgcggatactcggcaggatgctccggcggaagcggagccacctccccgtcggccgccctcgttctacagctccgtgttcgcgcagatcgaagagatcgggtggaagcagcttgtgagcgccacaggagacggagtgtcctgtctcaccttccgcgtcgtggatgaaccaggacggatgcatttactggagatcyacactgcccatgggctatcccgaaagtcctccttcaatct

SEQ ID NO: 7820 - protein, 102 aa, Zea mays
  misc_feature: Ceres CLONE 360054-F
  misc_feature (90)..(90): Xaa is any aa, unknown, or other
MDSPVPATLARAPARPQARAGEEACADTRQDAPAEAEPPPRRPPSFYSSVFAQIEEIGWKQLVSATGDGVSCLTFRVVDEPGRMHLLEIXTAHGLSRKSSFN

SEQ ID NO: 7821 - DNA, 513 bp, Zea mays
  misc_feature: Ceres CLONE 360072-F
  misc_feature: Encodes the peptide sequence at SEQ ID NO. 7822
gacggcatttgcatctgagttcctgattgttgtattccagtttcttctgtgagttttgtgggatcgcgaggaagaactagaaggatgtcgtgctgcggaggcaactgcgggtgcggcgccggctgcaagtgcggcagcggctgcggagggtgcaagatgtacccggacatggctgagcaggtgaccaccactacccagactctcatcatgggtgttgcaccgtccaagggcgggttcgaggcggccgccggagctgagaacggcgggtgcaagtgcggcgccaactgcacctgcgacccctgcacctgcaagtgagacgacggcgatgacgctgcagggcgtcatgggatcggaaggactcttttatcttaagctctagtataatattctagcagtgtcgtttgtgttttgttcgagtcagtcagacagtcagccgcgtgccatgggccatggcatagcatgccattgcctcgctctatctgctccatcgctttttctagtggtggtactgat

SEQ ID NO: 7822 - protein, 76 aa, Zea mays; identical to SEQ ID NO: 6267
  misc_feature: Ceres CLONE 360072-F
  misc_feature (1)..(75): Pfam Name: Metallothio_2 Pfam Description: Metallothionein

SEQ ID NO: 7823 - DNA, 493 bp, Zea mays
  misc_feature: Ceres CLONE 360187-F
  misc_feature: Encodes the peptide sequence at SEQ ID NO. 7824
ctagaaaaatcacattttggcccaatcgatccctgtcttctcttcccaattcccagtccccaatcgcgttctcttcctcggcgacatggcggccgccaccggctacagcgacgccccaaccgacgagcaactgctggcgtacgctgagctgcccagacatggccgctacatggcggaggtgttcgccgtgcgcatcctcgccaccgccggaggagacccgccgccccatggcaccatcactttctacggcggccactgctgcagcgatttcatttacagctggagtccactggaagagggagaagacacctcgaagcaaacctgcgacagccagggtaacctcgtgctaactgggccatcatgggccacctcggcatacagtccaattgccttcaccctctacctccatgatggcagcccgcaagccggagaagccgctgaggacgacgaggacatcgggaggataatctgcgactgcatcgacggtgacttc

SEQ ID NO: 7824 - protein, 136 aa, Zea mays
  misc_feature: Ceres CLONE 360187-F
  misc_feature: SWISSPROT Homolog: EC 3.2.2.22 rRNA N-glycosylase
MAAATGYSDAPTDEQLLAYAELPRHGRYMAEVFAVRILATAGGDPPPHGTITFYGGHCCSDFIYSWSPLEEGEDTSKQTCDSQGNLVLTGPSWATSAYSPIAFTLYLHDGSPQAGEAAEDDEDIGRIICDCIDGDF

SEQ ID NO: 7825 - DNA, 412 bp, Zea mays
  misc_feature: Ceres CLONE 360194-F
  misc_feature: Encodes the peptide sequence at SEQ ID NO. 7826
ctcgcccagatccacaagtttcgtgggtagaggaggcactagatactgtgccagatcggggtctggtagtggcagttgggtgattacgacggagtgggatgggcctcctcgacaagctgtgggacgacaccgtcgcgggcccgcgcccggacaccggcctcggccgcctccgcaagcagcccgcgcgccccgccgccgttaagatcagtgatccggccggggacgctgcagcgctcgtgccgccctcgccggcttcgggtagcgaggagacgccggtgaaggtgacgcgcagcatcatgatcaagcgtcccgcggggtacccgtcttcgccgaggagcgcggcaagcacgccgccggcctctccactagggactaccccgcccatctcgccgtttgccggcgctggtggtcg

SEQ ID NO: 7826 - protein, 104 aa, Zea mays
  misc_feature: Ceres CLONE 360194-F
  misc_feature (7)..(104): Pfam Name: Auxin_repressed Pfam Description: Dormancy/auxin associated protein
MGLLDKLWDDTVAGPRPDTGLGRLRKQPARPAAVKISDPAGDAAALVPPSPASGSEETPVKVTRSIMIKRPAGYPSSPRSAASTPPASPLGTTPPISPFAGAGG

SEQ ID NO: 7827 - DNA, 235 bp, Zea mays
  misc_feature: Ceres CLONE 360200-F
atttcttctcctctctgctctgttcacttcgttcthgtggggagcgcctccbctgcagttgccgccgccaccagagcagtgsacctcggtcygatatggcgaccggrartbcaagtgccatcgcgtccttctccgtggcggcggcagcggctgctgctctgcgcggtcaggcggccatgcgctcgcgcttgcgcttgggccccctcgcagcgaccgcagcaaggggcactcgtca

SEQ ID NO: 7828 - DNA, 443 bp, Zea mays
  misc_feature: Ceres CLONE 360222-F
  misc_feature: Encodes the peptide sequence at SEQ ID NO. 7829
gcgccggtatttcgatttgtctcctgaagcaagcgcagcaatgccagctcttcccgcttttcccctcacccgccgcccatccgatgccagacgccgcggtcgcctcgtcctttccctcgtcgtcttcgttgctgtctccgccgccgcagccctcgcctacctatctttcccctctgccgggcggacatcgcccccggcggtccggacggaggtcgactgctgcaggggtatggagggcctcgagctctggggcccggcggtcaagtggggctcagaccaccgcctgccctccgccgccgcctgctgcgccgcctgcaaggccatgtgccctcaccctaaggacggggcctgccgctgcgactcgtgggtcttctgcggtgacgagcgcaaatgcaaggacaggctcggggagtgctggctgaagaaacagaaggatgtcatgg

SEQ ID NO: 7829 - protein, 134 aa, Zea mays
  misc_feature: Ceres CLONE 360222-F
MPALPAFPLTRRPSDARRRGRLVLSLVVFVAVSAAAALAYLSFPSAGRTSPPAVRTEVDCCRGMEGLELWGPAVKWGSDHRLPSAAACCAACKAMCPHPKDGACRCDSWVFCGDERKCKDRLGECWLKKQKDVM

SEQ ID NO: 7830 - DNA, 484 bp, Zea mays
  misc_feature: Ceres CLONE 360231-F
  misc_feature: Encodes the peptide sequence at SEQ ID NO. 7831
actccccactcttggtgctcttgcttgaatatagtccccctcctctctctctcacacacctgttcttcgatctcggcctagctagctagctagcgagcaagctatagcttagctcggctagccgggtgtgtcgccggtcggctaggcaacgccgctagcgatcgcaaaatggcagatgcgggggaggggcggcgggtgtgcggcatgccggagaaggcgcagctgcacgttgcgatgctggcgctgcagttcggctacgcgggcttccacgtggtgtcgcggctggcgctcaacatgggcatcagcaagctcgtcttccccgtctaccgcaacatcatcgcgctctgcctcctcgtgcccttcgcctactttctagagaagaaagacaggccgcagctgaccctcaacttcgtcgtccagtttttcttttctcgcgctctgcggcatcacggcgaaccaagggttttacctcctgggcctggac

SEQ ID NO: 7831 - protein, 105 aa, Zea mays
  misc_feature: Ceres CLONE 360231-F
MADAGEGRRVCGMPEKAQLHVAMLALQFGYAGFHVVSRLALNMGISKLVFPVYRNIIALCLLVPFAYFLEKKDRPQLTLNFVVQFFFSRALRHHGEPRVLPPGPG

SEQ ID NO: 7832 - DNA, 507 bp, Zea mays
  misc_feature: Ceres CLONE 360238-F
  misc_feature: Encodes the peptide sequence at SEQ ID NO. 7833
gttcaatctcgttgcccgttgtgctctctctctctattcgttccccgcctcaccccgagccagccgtctcgctagggtttcgccgccgccgccgccgccgccgccgctatgcctcgccgcagctcaggaaggtctgccccacgcccagctacccgtgctgctccagtgaggaacccgccacagccagcacgccaggctcctcctccagctcctgttcgagatggtggtggctccatgtttggaggaattgggtccaccattgctcaaggtatggcgtttggctgtggcgggttcctccagaagtagccatacggattcagatcgcggccgcggcgactccccgagcagaagaacccgatcgaacgcggccgcggcggcgactccccgatctcagatccctgctgcgagcgaagggttccattcgagcagagatggcggcggcatgggaggtgctggctgtgttgctcgtcgcggcgcaggtggcgtcagcggcgcaggtcacggcgc

SEQ ID NO: 7833 - protein, 65 aa, Zea mays
  misc_feature: Ceres CLONE 360238-F
MPRRSSGRSAPRPATRAAPVRNPPQPARQAPPPAPVRDGGGSMFGGIGSTIAQGMAFGCGGFLQK

SEQ ID NO: 7834 - DNA, 1887 bp, Zea mays
  misc_feature: Ceres CLONE 360267
  misc_feature: Encodes the peptide sequence at SEQ ID NO. 7835
cttttcccctctcgaaacgcaccctgcatttactgcacgtcgctcgccctccggccatccgcgatcttcaaatcttccactgtaaaaagcgggcggagacgggaaggccgtgcgctcaaggatggcgcgcgagcagctggaggagtccatcgtggccgacggcaacggcaaggaggaagaggtcggggtcatgggcatcggcgccgcggacggcgccgacgaccagcacggcggcggcaagctcagcatgaagagcctgctgtggcacggcggctccgtctgggacgcgtggttcagctgcgcctccaaccaggtggcgcaggtgctcctgacgctgccgtactccttctcccagctggggatgctgtccggcgtgctgctgcagatcttctacggcttcctgggcagctggaccgcgtacctcatcagcgtcctctacgtcgagtaccgctcccgcaaggagaaggagggcgtcagcttcaagaaccacgtcatccagtggttcgaggtgctggacgggttgctgggcccctactggaaggcggcgggtctggccttcaactgcacgttcctgctgttcggctccgtcatccagctgatcgcctgcgcgagcaacatctactacatcaacgatcggctggacaagcggacatggacgtacatcttcggcgcctgctgcgccaccacggtgttcatcccgtccttccacaactaccggatctggtccttcctgggcctcggcatgaccacctacaccgcgtggtacctcgccatcgccgcgctcctcaacggccaggccgaaggcgtggcgcactccggcccgaccaagctcgtgctctacttcaccggcgccaccaacatcctctacaccttcggcggccacgccgtcacagtcgagatcatgcacgcgatgtggaagcccgccaagttcaagtacatctacctgctggcgacgctgtacgtgttcacgctgacgctgccgtcggcggcggccatgtactgggcgttcggcgacgagctgctgacccactcgaacgccttctcgctgctgcccaagacccggtggcgcgacgcggcggtgatcctgatgctgatccaccagttcatcaccttcggcttcgcgtgcacgccgctctacttcgtgtgggagaaggtgatcgggatgcacgacgccaagagcatcttcaagcgcgcgctggcgaggctgcccatcgtcgtgcccatctggttcctcgccatcatcttccccttcttcgggcccatcaactccgccgtcggcgcgctgctcgtcagcttcaccgtctacatcatcccggccctggcgcacgtcctcacctaccgcacggcgtccgcgcgcatgaacgccgcggagaagccgcccttcttcctgccgagctggacggggatgttcgtcctcaacatgttcatcgtggtgtgggtgctggtggtcggcttcgggctgggcggctgggccagcatggtcaacttcgtgaggcagatcgacacgttcgggctgttcgccaagtgctaccagtgcccgaagccgccggtcccggcggccgcgcagtcgccggcgccgctgccgcaccactagggcgcgcaggcatggagctagcgtcgctgcttgcattgcagccggtgttaattgctactaggttttggtcgccttgtaatatacaagcctcctctagggtcgtagaactcgatcacagcagagtcacgcaaaggcggctcgtgccgtgccgccgccgcgttgctttcccgcccaccctcctctgcctgatcggtccgtcggcattggtgtcgttttgttttcgtttggcttgccaccggtattaaaaagttgagtgatggtcatggcttcttaatccaaaaaaaaaaaaaaaa

SEQ ID NO: 7835 - protein, 490 aa, Zea mays
  misc_feature: Ceres CLONE 360267
  misc_feature (49)..(443): Pfam Name: Aa_trans Pfam Description: Transmembrane amino acid transporter protein
MAREQLEESIVADGNGKEEEVGVMGIGAADGADDQHGGGKLSMKSLLWHGGSVWDAWFSCASNQVAQVLLTLPYSFSQLGMLSGVLLQIFYGFLGSWTAYLISVLYVEYRSRKEKEGVSFKNHVIQWFEVLDGLLGPYWKAAGLAFNCTFLLFGSVIQLIACASNIYYINDRLDKRTWTYIFGACCATTVFIPSFHNYRIWSFLGLGMTTYTAWYLAIAALLNGQAEGVAHSGPTKLVLYFTGATNILYTFGGHAVTVEIMHAMWKPAKFKYIYLLATLYVFTLTLPSAAAMYWAFGDELLTHSNAFSLLPKTRWRDAAVILMLIHQFITFGFACTPLYFVWEKVIGMHDAKSIFKRALARLPIVVPIWFLAIIFPFFGPINSAVGALLVSFTVYIIPALAHVLTYRTASARMNAAEKPPFFLPSWTGMFVLNMFIVVWVLVVGFGLGGWASMVNFVRQIDTFGLFAKCYQCPKPPVPAAAQSPAPLPHH

SEQ ID NO: 7836 - DNA, 470 bp, Zea mays
  misc_feature: Ceres CLONE 360459-F
  misc_feature: Encodes the peptide sequence at SEQ ID NO. 7837
acggacgcttcgctctagtcggaaggtttcgaggaactcccgggctcgaggagatcgggacgatgatgggagggcgcgctctgctgctgctcctggtctcggcgctgctcgttcagatccgcgcctctgacccgctgctgtacgagccgtttgatgaggacttcgagggtagatggatcgtctccaagaaggatgaataccaaggtgtatggaagcatgccaagagtgatgggcatgaggactatggcctccttgttagtgacaaggcaaggaaatacgccataatcaaggagcttgatgagccagttaccttaaatgatgggacagtggtcctgcagtttgaagtgagacttcagaatggccttgaatgtggaggtgcctacattaagtacatccgccctcaggatgctggatgggatgccaaggagtttgataatgagactccatacactattatgtttggtccagat

SEQ ID NO: 7837 - protein, 136 aa, Zea mays; identical to SEQ ID NO: 2855
  misc_feature: Ceres CLONE 360459-F
  misc_feature (24)..(136): Pfam Name: Calreticulin Pfam Description: Calreticulin family

SEQ ID NO: 7838 - DNA, 461 bp, Zea mays
  misc_feature: Ceres CLONE 360494-F
  misc_feature: Encodes the peptide sequence at SEQ ID NO. 7839
atcctcacttcaggtctgcagcccccaactacccccagcctcggaaggaaccttccagaagcgcaagactctaaaggccgtcgccttcccattcttcctcgccgcgggggtcgcctgagttgtttgcagatcacataaacaatggtgaaggctgttgctgtgcttggtagcagcgatggtgtcaagggcaccatctttttcacccaagagggagatggccctaccgctgtcaccggaagtgtctctggcctcaagcctggcctccatgggttccatgtacatgcacttggtgacaccaccaatggatgcatgtcaactggaccacactacaatcctgcgagcaaggagcatggggcaccagaagatgagaaccgccatgctggtgatcttggaaacgtgacagctggagcagatggtgttgctaatatcaatgtcaccgacagccagatcccactgactgg

SEQ ID NO: 7839 - protein, 106 aa, Zea mays
  misc_feature: Ceres CLONE 360494-F
  misc_feature (1)..(106): Pfam Name: Sod_Cu Pfam Description: Copper/zinc superoxide dismutase (SODC)
  misc_feature: SWISSPROT Homolog: EC 1.15.1.1 Superoxide dismutase
MVKAVAVLGSSDGVKGTIFFTQEGDGPTAVTGSVSGLKPGLHGFHVHALGDTTNGCMSTGPHYNPASKEHGAPEDENRHAGDLGNVTAGADGVANINVTDSQIPLT

SEQ ID NO: 7840 - DNA, 457 bp, Zea mays
  misc_feature: Ceres CLONE 360525-F
  misc_feature: Translation starting site: 150
attgggggcaatccaggctcagcccaactactctctcgtcctcttgttccactgtttcccaccccaaaatactccaccaccgcacccactagggtttccgcaccgcattgcagaacctcgccgcctccacccgcaccacaccaccggcgatgtccacagcggcggcgcagggcggcagcgacaagccggcgctccggaggcccgtcttcaccaaggtcgaccagctcaggccgggcaccaacgggcacaccctcaccgtcaaggtcgtcagcgccacccccgtgcctgggcgcgcgcgccaggcgcacccgccgccgccccatcccgcgcgccgcgcatcgccgagtgcctcgtcggggacgagaccggcgccatcgtcttcaccgcccgcaacgaccaagttgacttgcygaagcccaatgcgacagtgatcttgcgcaatgccaaaatagacayg

SEQ ID NO: 7841 - DNA, 375 bp, Zea mays
  misc_feature: Ceres CLONE 360526-F
  misc_feature: Encodes the peptide sequence at SEQ ID NO. 7842
ggatttggaagccatcaccacctataataaattgcacgagatttgccgcgagaccgcatctccatcccgcatcgcgcatcgcatccaccgccgagctttctttctttctttctttcttttttctgggagaagaggaagaagaggggaggcgcgacaaaaagggcgccgcgccacgcatcgcccccgacgccggcatctctccctcgctctccttctcccgatctgatccgaagcgcggcgtcgacgacgacgacctaagggcacgatgcattcgaccaacctgctgctggaggagcccatccggatggcctccatcctggagccatccaagaccagcttcttcccggcgatgaccaagatcgtcggcacgctcgg

SEQ ID NO: 7842 - protein, 36 aa, Zea mays
  misc_feature: Ceres CLONE 360526-F
MHSTNLLLEEPIRMASILEPSKTSFFPAMTKIVGTL

SEQ ID NO: 7843 - DNA, 447 bp, Zea mays
  misc_feature: Ceres CLONE 360534-F
attggggacggggcggagaacgcgagtaagcactaccctcctcaactcctaccctccgccgtaaaccccgctgttctttgccggagcaccccctccccgtctccagccccagtctcggtccccccggacttcgatatcttcggagaccgcctgcatgctcaaatcgtagacactctgggtaggcgcaaggtggagatccgtccgggcacggatcaatttcttcgttcgctggtactcaggctctaatatttttacaaaatcgatggaaagttctaaatctcctcagtcatcaaaaaacagtcggattgtggtgcttctgatagtaatcgcccccgatttgacaatgacggtttttcttcagaaactgcatcaaatcaaatggtcgtgttcaactctgaagcagcagattgaactgggagaaaaccgtctgcagaagtcagtgataac

SEQ ID NO: 7844 - DNA, 429 bp, Zea mays
  misc_feature: Ceres CLONE 360549-F
  misc_feature: Encodes the peptide sequence at SEQ ID NO. 7845
atctttgcgcttggggcaatgacgcagcttatgaggtcataccgaggcgcgtcaattgctggttgaaaactatttccaaaccccctctttggcccactgggccactgagaatttctggaagggctccttttcctcggagaagcaatcttgagtcctgggtcttcgctgccagcacgcttcacgcttgtggccaagaaacgttgggggcagtttggacctcggagcagcagcatccatggcgggagaagaggccgggaggaggggcgttccctctctgctgaacccgccgtccgcttccagcgaggggcagcaggagcacatcgcctctgatgtcacacagctcatcggatggacacctctggtcgagctcaagcgaatcgccgccaaggaaggggtaggcgcgcgcatcgtcggcaaggtggargcgta

SEQ ID NO: 7845 - protein, 64 aa, Zea mays
  misc_feature: Ceres CLONE 360549-F
  misc_feature: SWISSPROT Homolog: EC 2.5.1.47 Cysteine synthase
MAGEEAGRRGVPSLLNPPSASSEGQQEHIASDVTQLIGWTPLVELKRIAAKEGVGARIVGKVEA

SEQ ID NO: 7846 - DNA, 485 bp, Zea mays
  misc_feature: Ceres CLONE 360559-F
  misc_feature: Encodes the peptide sequence at SEQ ID NO. 7847
aaaaagcgcagagcgcatcagcgcagagcaggacagccatggcgacggcggcggcgcagtcccattcgccatcaatggacgcgcgccggtgggacgagtcatcgtaccgccgcggcatcctccgtgcccgcgacctctcgtcccgcaccctcttccgtgccgtcttctttgaccacagcgacgacccggataccgacatcctactcgccgccgcctccagcgacggttccctcgcttccttctccctttcatcctgcatctccgcatgttccactacctcccaggtggagaccgccgccactctggtcgaccctgtctgcatcgtgcaagcgcacagcggacctgcctacgacgtcrggttctaccccgatcaacagcagccgctgctcttcagctgcggggacgatggccgcatcaagggtyggaggtggcacgagatgcagagctgcmttgtcccgctctccctgcaaggggatcatctagaa

SEQ ID NO: 7847 - protein, 149 aa, Zea mays
  misc_feature: Ceres CLONE 360559-F
  misc_feature (107)..(107): Xaa is any aa, unknown, or other
  misc_feature (129)..(129): Xaa is any aa, unknown, or other
  misc_feature (138)..(138): Xaa is any aa, unknown, or other
MATAAAQSHSPSMDARRWDESSYRRGILRARDLSSRTLFRAVFFDHSDDPDTDILLAAASSDGSLASFSLSSCISACSTTSQVETAATLVDPVCIVQAHSGPAYDVXFYPDQQQPLLFSCGDDGRIKGXRWHEMQSCXVPLSLQGDHLE

SEQ ID NO: 7848 - DNA, 494 bp, Zea mays
  misc_feature: Ceres CLONE 360634-F
  misc_feature: Encodes the peptide sequence at SEQ ID NO. 7849
gcatcgaacaccaatggcattcttgcattgaaggaaccttccctccacctccaccgcccgagagcgagcggccggacggggttttggttgggcatggctgccccggcgatgctccaagtggtgatcctcgccgcggtcctccttctcccgttcctcagcgtgccgggcgccgaggcacagaccaagaagttctgcctcacgcagttcgccatcgctagccaggcctgcgccatcctgccacccaccagtcctgagcaccaccaccatcatcacgatgacgaggacaatgacgaggacaacgacaaagatgaggacgaagacgaggacaacgatgaagatgaagacgaggacaatgacgacgatagcggcggtgggatggggaacccagtcaacgtgggcatcgcggtgcaggcggactgggagaaccgcgagttcatctccaacatctccctcaacgtccgacgcctcttcgacttcctcctcagattcgaagc

SEQ ID NO: 7849 - protein, 133 aa, Zea mays
  misc_feature: Ceres CLONE 360634-F
MAAPAMLQVVILAAVLLLPFLSVPGAEAQTKKFCLTQFAIASQACAILPPTSPEHHHHHHDDEDNDEDNDKDEDEDEDNDEDEDEDNDDDSGGGMGNPVNVGIAVQADWENREFISNISLNVRRLFDFLLRFE

SEQ ID NO: 7850 - DNA, 442 bp, Zea mays
  misc_feature: Ceres CLONE 360677-F
  misc_feature: Encodes the peptide sequence at SEQ ID NO. 7851
cgtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcaactccgacgggaactggagg

SEQ ID NO: 7851 - protein, 114 aa, Zea mays
  misc_feature: Ceres CLONE 360677-F
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGYGGGRGGGGYGNSDGNWR

SEQ ID NO: 7852 - DNA, 517 bp, Zea mays
  misc_feature: Ceres CLONE 360680-F
  misc_feature: Encodes the peptide sequence at SEQ ID NO. 7853
ctctagccaaaaccctagcagccgcccggtgctccctctcttcagatctcccttcgcagccgccgaggaaccccttcacagcgcggaagatggctgaacaggaggccccagtcgtggttgaggcaccaaccccagttcttggggagcctatggacttgatgactgctctgcagctcgtgatgaagaagtcaagtgctcatgatggacttgtgaagggtctccgtgaggctgccaaggccatcgagaagcacgccgctcagctttgcgtgcttgctgaggactgtgaccagccagattatgtcaagctggtgaaggcactctgcgcggagcacaatgttcacctggtcactgttcctgccgctaagacccttggcgagtgggctgggctttgcaagattgactctgagggcaaggcaaggaaggttgtaggctgctcctgtgtcgtcgtcaaggactacggtgaagaatctgaggggccttaaccatagttgcaggagtatgtcagtcgcactagatg

SEQ ID NO: 7853 - protein, 130 aa, Zea mays
  misc_feature: Ceres CLONE 360680-F
  misc_feature (25)..(120): Pfam Name: Ribosomal_L7Ae Pfam Description: Ribosomal protein L7Ae/L30e/S12e/Gadd45 family
MAEQEAPVVVEAPTPVLGEPMDLMTALQLVMKKSSAHDGLVKGLREAAKAIEKHAAQLCVLAEDCDQPDYVKLVKALCAEHNVHLVTVPAAKTLGEWAGLCKIDSEGKARKVVGCSCVVVKDYGEESEGP

SEQ ID NO: 7854 - DNA, 390 bp, Zea mays
  misc_feature: Ceres CLONE 360769-F
  misc_feature: Encodes the peptide sequence at SEQ ID NO. 7855
aaatcaagaaaacagtcgtctccagtttccatgcagagcagaaaagatcagctagcgagagaagcaatggcgtcggctcctgcgttctgcgtcgcgctgctgctggcttccgtcgctgccgtccaagcggtgccgccccaggccggcacgtcgtccacctgcagcactgacctcctccgcctcctcccctgcctgcccttcatcgggggcaccgccaccgtgccggcggacacctgttgcgccaacctgggcagcatggtgcacgacgagccgcagtgcctctgccaggccctcagcaaccccagcacggcccccgtcgccgtcaacatgacgcgcgtgatggccatgcctcggctctgccgcctcgacctcccgcccgccaccggcgcc

SEQ ID NO: 7855 - protein, 120 aa, Zea mays
  misc_feature: Ceres CLONE 360769-F
  misc_feature (44)..(117): Pfam Name: Tryp_alpha_amyl Pfam Description: Protease inhibitor/seed storage/LTP family
MQSRKDQLAREAMASAPAFCVALLLASVAAVQAVPPQAGTSSTCSTDLLRLLPCLPFIGGTATVPADTCCANLGSMVHDEPQCLCQALSNPSTAPVAVNMTRVMAMPRLCRLDLPPATGA

SEQ ID NO: 7856 - DNA, 614 bp, Zea mays
  misc_feature: Ceres CLONE 360776
  misc_feature: Encodes the peptide sequence at SEQ ID NO. 7857
attgatgggtgtaacgtaccagcggctgctctcgcaggggagccagagccagcgtccgcggagcggcgtgcgggcgcggggcgtgggtgctgctgcggtgggcggccgtgcggctaagctgcgcggcgaggcggcggttactggtggcggcggcgcaggccgcgcgcggaggctggcgtgggcggggctctgcggaagaggcggcagcggcaggaggagcgccacggcgggcggcggggccggagccggagccggggtgctggggtacgattccgccagctacgcgcgcaacttcgatgacggtgcgtggaaggccgaggagggcgtgtcctgggccggccccggcggcgcgttcttccccggcgccaacatcggcggcgcggccgtggacaccgcccgcctgtgatgccgttcccagctccgtccgtccactagctaactggtaactgttgctgcgctggaaatggatggatcgtggtcgtggatgcgtcactcgggatttgctttcttttcttttttttcttgttcatctggattattggcatttactttcttcggtcgaaaatgaaaaatattcaggccgtgcttgttcgggtgcaaaaaaaaaaaaaaaa

SEQ ID NO: 7857 - protein, 133 aa, Zea mays
  misc_feature: Ceres CLONE 360776
MGVTYQRLLSQGSQSQRPRSGVRARGVGAAAVGGRAAKLRGEAAVTGGGGAGRARRLAWAGLCGRGGSGRRSATAGGGAGAGAGVLGYDSASYARNFDDGAWKAEEGVSWAGPGGAFFPGANIGGAAVDTARL

SEQ ID NO: 7858 - DNA, 444 bp, Zea mays
  misc_feature: Ceres CLONE 360810-F
  misc_feature: Encodes the peptide sequence at SEQ ID NO. 7859
aacaccaatggcattcttgcattgaaggaaccttccctccacctccaccgcccgagagcgagcggccggacggggttttggttgggcatggctgccccggcgatgctccaagtggtgatcctcgccgcggtcctccttctcccgttcctcagcgtgccgggcgccgaggcacagaccaagaagttctgcctcacgcagttcgccatcgctagccaggcctgcgccatcctgccacccaccagtcctgagcaccaccaccatcatcacgatgacgaggacaatgacgaggacaacgacgaagatgaggacgaagacgaggacaacgatgaagatgaagacgcggaggatgcggcaaaaggatccaatgaaattgtgtttttttggtcttgttgtggtaccgtaactggaattttggtattttttgtctactatttactgtagtgg

SEQ ID NO: 7859 - protein, 117 aa, Zea mays
  misc_feature: Ceres CLONE 360810-F
MAAPAMLQVVILAAVLLLPFLSVPGAEAQTKKFCLTQFAIASQACAILPPTSPEHHHHHHDDEDNDEDNDEDEDEDEDNDEDEDAEDAAKGSNEIVFFWSCCGTVTGILVFFVYYLL

SEQ ID NO: 7860 - DNA, 665 bp, Zea mays
  misc_feature: Ceres CLONE 360872-R
cagattgggtaccgggccccccctcgaggtcgacggtatcgataagcttttttttttttttttttctgaaaaggagaaacagtagcatttgaaactttacaacaatcaatttgagcattttcatatttccaaatatgtaaacaccactactcccgttaccccccatctgaacaaaccaaatgaatacgaatacaatcctcgccttccatcacaataccgtgtcatctgaggacagtgactcatgcagcaacggcatttctcttggtggcgatatacgggttggtctcgagcagattctccagggatttcgcctttctgcttcgcacccggccagcctccttcaatagctccccaagcctccgcttctcgtcgtcaacgtctgggtttgccgtacctagcttctcctcgcgcattccaaccacatattccaagatctcgatggcctcatccagccttcccatcgcgtcataagttccagcaagattactgtagactcctaaagtatccggatggtatggcccgtattcttgttccagaacagttctagcttcctcgaacaattctgctgcttcgtttatcgaatacctctgaacacatgccagccccatctggttcagggcaatcccgaagaaggcagacttcttctcgccacaagtgcggagctt

SEQ ID NO: 7861 - DNA, 636 bp, Zea mays
  misc_feature: Ceres CLONE 360917-R
cgattggtgaccgggccccccctcgaggtcgacggtatcgataagcttttttttttttttttttaccagaataaatggttgtagaaacatcagcgaaaaacagaaggattgaagggcatcattattatcagaaatcatgtaatgtgactgatccaacacagtgaagtagccatctactgggtagaacaaaaaccatagtactagcagaacccaatcacatgcatgatccaacataaccaaggtagatactagtagtagctagaacggacacatcaagatttgcgctagggcagtagtaagagcactgtagcagagatccaatcacttggagacttgaggctagtgactgcaaatctgtagacacgtaggtagctaggtgacgatggctaataaggagtggaagcagagaccatgccatcgatgtccgacttgacgttgctgaagacgttgtggagcagcacgaagatcaccactgataagttgctcccgaggccgtggccggcgagcacctgaccgtcgacaccggtgaggtccaccttcctggcgaacaccgtgcctctgtcaagaggggtgccgccgcaagcgctcgacaccatcttgagcacgatctccagcttctccatgatctgcagcgcc

SEQ ID NO: 7862 - DNA, 439 bp, Zea mays
  misc_feature: Ceres CLONE 360918-F
  misc_feature: Encodes the peptide sequence at SEQ ID NO. 7863
atcccctcttgtattcgcactgcatgcctctcactctccctctccctagcggtctccacatgtgagaaacgcctctctagtaattaagcagcatggcagagaagatgtcgacgctaatcatcgtggttgaccttgattgccgcaagtgctaccacaagatccgcaagattctctgccagctgcaagaccatgagaggatccgcaccatctccttcgacgacaagagcaagacggtgaccatggtgggcccgttcgacccgcagcggctcgcgtgcaagctacgctgcaagggcggcaaggtggtgcgggacgtctacatcgtcgacgccaacggcggcgccggcggcaagcctcctcctcctccacagaacgtgccggacgacgggccacccgcgccggccccggcgcagtgaggagcggcgggaagagcaagaacaag

SEQ ID NO: 7863 - protein, 106 aa, Zea mays
  misc_feature: Ceres CLONE 360918-F
MAEKMSTLIIVVDLDCRKCYHKIRKILCQLQDHERIRTISFDDKSKTVTMVGPFDPQRLACKLRCKGGKVVRDVYIVDANGGAGGKPPPPPQNVPDDGPPAPAPAQ

SEQ ID NO: 7864 - DNA, 493 bp, Zea mays
  misc_feature: Ceres CLONE 360957-F
  misc_feature: Translation starting site: 53
  misc_feature: Pfam Name: Peptidase_C12 Pfam Description: Ubiquitin carboxyl-terminal hydrolase, family 1
  misc_feature: SWISSPROT Homolog: EC 3.4.19.12 Ubiquitinyl hydrolase 1
actccacaggctcggtttccgccctcctctcccaccgccgcgcaccgagaagatggggaagcggtggatcccgctggaggccaacccggacgtcctgaaccagttcatatgggggctgggagtccacgaggaggatgtgcagttctgcgacgtctacggccttgacgatgagctgctcgctatggtgccccagcccgttctcgccgtcctcttcctctacccgctcacctccctggacgaggagaaagaagaatcaagtgtttctgctgccacatcgacctcagcgggcaagttgaggggtcctattttgagaagttctataagcaaacggctgatatggatccagctcagcgtgctgcctttctcgaggaagatgatgagatggaagatgcacattctgttgctgcatctgctggtgacactgatgctaatgttgatgttaatgaacattttgtatgtttctcctgtgttgatggtgaactttatgagctga

SEQ ID NO: 7865 - DNA, 501 bp, Zea mays
  misc_feature: Ceres CLONE 360984-F
  misc_feature: Encodes the peptide sequence at SEQ ID NO. 7866
accagttcgttcgcgttgcccgcgactctctccgtcctcctactgcccacccgactcacacgcttggcacgcgcgtgcttccacccgtccgtcgcctctctctcggctgcctgattgatttggttgccccggttccagcaatggcggtccaggcgcattatcaccaccactaccaccgcgagtcccctttcctcgtcaggtacctgccgtggccgctgtgcatcttctaatcgtttcttccgcgtcgatcgtcggtctgctggatcgtattcggatgggtgatttgagcgtctgggttgtcagcggcgcgccggagggcagccggttggcggcggcgatggagctgcatcatcaggcgcagaaggaggctatggcgccgcagcaggctcaggctccgcccctcttcttggacttctcgcatggagattacggcggcgggaggaagcggcagcgcgaggcggagcccatgtcgtcgcaagttcttctctctgcagcagcaac

SEQ ID NO: 7866 - protein, 75 aa, Zea mays
  misc_feature: Ceres CLONE 360984-F
MGDLSVWVVSGAPEGSRLAAAMELHHQAQKEAMAPQQAQAPPLFLDFSHGDYGGGRKRQREAEPMSSQVLLSAAA

SEQ ID NO: 7867 - DNA, 324 bp, Zea mays
  misc_feature: Ceres CLONE 360994-F
cgcttatgtgatagcacggcccaacactacaactgcctctcggccctctcctcggcgacgccactactcctgcctcacgccgccgctcaaaccgcagaagaragaagagaagcacgcccaaaaattccgaggttttcacctcttggagcgcaccaacaccacccggagaccggagcgactcgccaccggcgcggaaaaggagggcggaggctcgatggcggatgagaatcaggctggaagaaagaggaggaggaatttagcacaggccctctgtcagtccyaatgatgagtgttaagaacaacacccaggtcctcatcaattgt

SEQ ID NO: 7868 - DNA, 908 bp, Zea mays
  misc_feature: Ceres CLONE 361138-R2
  misc_feature (1)..(1): n is a, c, t, g, unknown, or other
  misc_feature (20)..(20): n is a, c, t, g, unknown, or other
  misc_feature (86)..(86): n is a, c, t, g, unknown, or other
  misc_feature (908)..(908): n is a, c, t, g, unknown, or other
ntttttttttttttttcctnccatcacactcacccgtgcacccccgcaccccccgcaccacccaccccctcccgaccccccacacnaaggggtgttccggccaggcagacgacacagacacgggaacgggacgggacggaagaagatgacgagcagctgcgggctacgctcaccgcgctgcccccaaattagggccgcagctcggcagccacttgagcagctcacacagaaacccaccagtcacccccaagccaaaggcacaaacttgacccataaccacacacttacggacaagtagagaagcgttagagacaaacgagacggcaatataccctgacaaactctacagaatcccatccacacctccttgttcaaaagaaaaggctccatttttttcaaagaggacctggacctggacctgggattaaggcggaaaggcgcgacccttaaaacaggcattgacagacaccaccaccctaaaacgcgcctcaccattccagcagaacgaccccgccagcagcgagggagcagacactatttacgctatccccacgacaccacgcaaccaccccaacacgcgctttggggctccttcccccccaaggtgccctccccctcccatccccaatcgccacgcacccaacaaccctgaaacccccatgacccccctaagggcccggcccccaaattgccggggggttccggcgcgcgccctcccacggaaagtggaaagaggtgagtcccccccccgggccgactccacccgcataaggaaaacccaccgggccagatcactgcacgcgccccgcaaccggacctactctagagcccccagctcccggcacactggggacgctcccccaccgagtatagtcacaacctgaagacttcccacggcaaacaacgcn

SEQ ID NO: 7869 - DNA, 750 bp, Zea mays
  misc_feature: Ceres CLONE 361138-R3
  misc_feature: Pfam Name: Pollen_allerg_1 Pfam Description: Pollen allergen
  misc_feature (652)..(652): n is a, c, t, g, unknown, or other
cgattggtgaccgggccccccctcgaggtcgacggcatcgatattttttttttttttttttgaaaaggtgtgttccggtcatggagacagacacagacacgggacgggacgggacggaagaagatgacgagcagctgcgggctacgctcaccgcgctgcccccaaattagggccgcagctcggcagccacttgagcagctcacacagaaacccaccagtcacccccaagccaaaggcacaaacttgatccataaccacacacttacggagaagtagagaagcgttagagacaaacgagacggcaatataccctgacaaactctagagaatcccatccacacctcttgttcagaagaaaaggctccatttttttcagagaggacctggacctggacctgggattaaggcgggaaggcgtgaccttaaaacaggcattgacagcacccaccaccctaacacgcgcttagtactccagtagcagtagtacgctagcaggagtgagtagtaataattacgtataagaagaaagaaagaaagaaagaaaagagttttggcttcttctcccaagtcgcatcccatcccatcccatcccatgcatcagaccctgaagttcttgccctcgaaggtctggccgaactgccaggtgctcggngcggcgttcccagaggtggaggtgcggcggtcgctggcggtgacgcggaaggagagcgcctggccgacgaggatggcgttgcactgccagttctgggc

SEQ ID NO: 7870 - DNA, 605 bp, Zea mays
  misc_feature: Ceres CLONE 361138-R
  misc_feature (510)..(510): n is a, c, t, g, unknown, or other
  misc_feature (587)..(587): n is a, c, t, g, unknown, or other
gtgttccggtatggagacagacacagacacgggacgggacgggacggaagaagatgacgagcagctgcgggctacgctcaccgcgctgcccccaaattagggccgcagctcggcagccacttgagcagctcacacagaaacccaccagtcacccccaagccaaaggcacaaacttgatccataaccacacacttacggagaagtagagaagcgttagagacaaacgagacggcaatataccctgacaaactctagagaatcccatccacacctcttgttcagaagaaaaggctccatttttttcagagaggacctggacctggacctgggattaaggcgggaaggcgtgaccttaaaacaggcattgacagcacccaccaccctaacacgcgcttagtactccagtagcagtagtacgctagcaggagtgagtagtaataattacgtataagaagaaagaaagaaagaaagaaaagagttttggcttcttctcccaagtcgcatcccatnccatcccatcccatgcatcagaccctgaagttcttgccctcgaaggtctgggcgaactgccaggtgctcggggcggncgttccaggaggggaagg

SEQ ID NO: 7871 - DNA, 463 bp, Zea mays
  misc_feature: Ceres CLONE 361158-F
  misc_feature: Encodes the peptide sequence at SEQ ID NO. 7872
gtcgccgtctgcccgtctccatctcactttcgatcgacacagaaaattccccaccaaaatctcctccccctgaagtcccgaagctcgcggaagcgccgagatgtaccatcccacgagaggcggcgtccgcggcggcagagatcaattcaaatgggacgatgtgaaggttgacaagcatcgggagaattaccttggtcatagtgttaaggctccggttggtagatggcagaaaggaaaggatctttactggtatactcgggataagaaatccgacacgggagatgctcttaaggaagaaatcaggagagtgaaggaagaggaggaacaggctatgcgtgaggctcttggcttagctcctaagcgcagcaatcgaactcagggtaatcgcttggataagcatgaatatgctgagctgattaagagaggatcaactgcggaggacttgggagcaggacacgctgaa

SEQ ID NO: 7872 - protein, 121 aa, Zea mays
  misc_feature: Ceres CLONE 361158-F
MYHPTRGGVRGGRDQFKWDDVKVDKHRENYLGHSVKAPVGRWQKGKDLYWYTRDKKSDTGDALKEEIRRVKEEEEQAMREALGLAPKRSNRTQGNRLDKHEYAELIKRGSTAEDLGAGHAE

SEQ ID NO: 7873 - DNA, 514 bp, Zea mays
  misc_feature: Ceres CLONE 361192-F
  misc_feature: Encodes the peptide sequence at SEQ ID NO. 7874
agaagctcctccggtcctcccttctctccgtagaaacatttcccgacgggtgtttcccacgccggaatggaccagccggcaccataagcccaagattcgtttgcattcagtaatgcctttgcctaaatcagacctggggtcataactctttagtagagaaccaagaagatgcaggcatctagggcaaggcttttcaaggagtacaaggaggtacagcgagagaagtcagctgaccctgatatccaattaatatgtgatgattctaacatattcaagtggactgctcttatcaagggcccttctgaaacaccttatgaaggtggtgtgtttcaacttgcattcgcaattccagagcagtatcctctgctgcctcctcaagttcgatttttgaccaaaactttccacccaaatgtgcatttcaagacaggtgagatttgtctggatatattgaagaatgcatggagccctatatggacccttcagtctgtttgtagagccataattgctctgatgg

SEQ ID NO: 7874 - protein, 115 aa, Zea mays
  misc_feature: Ceres CLONE 361192-F
  misc_feature (7)..(115): Pfam Name: UQ_con Pfam Description: Ubiquitin-conjugating enzyme
  misc_feature: SWISSPROT Homolog: EC 6.3.2.19 Ubiquitin--protein ligase
MQASRARLFKEYKEVQREKSADPDIQLICDDSNIFKWTALIKGPSETPYEGGVFQLAFAIPEQYPLLPPQVRFLTKTFHPNVHFKTGEICLDILKNAWSPIWTLQSVCRAIIALM

SEQ ID NO: 7875 - DNA, 751 bp, Zea mays
  misc_feature: Ceres CLONE 361231-R
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (8)..(8): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (36)..(36): n is a, c, t, g, unknown, or other
  misc_feature (41)..(41): n is a, c, t, g, unknown, or other
  misc_feature (45)..(45): n is a, c, t, g, unknown, or other
  misc_feature (46)..(46): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (374)..(374): n is a, c, t, g, unknown, or other
  misc_feature (456)..(456): n is a, c, t, g, unknown, or other
nnnaaaanaaaaaaaaacacaaaaaannnaaaaaanaagcncgcnncnnnnnaaannnnnnnnnnnnnnnnnnnccgattggtacgggcccccctcgagtcgaggtatcgataagcttttttttttttttttttgtagccagcacacggggctatacatgcacaatagtggatccaaaattacacgacacaacccccctcccacttcgccccccggttcacccagtcatttcccgaccaacccaacagcaatcaacaccgacatcaggaatgactcttatctggtgaccaccaagaattatcggcgcaggacgacttaacacgacgactaaagaagcaaaaaaaactccacatgtagtctcctccttctcgcangtgccagggcagggcagggcaaggcacggcccatcctgtaagtccccctcctcactttgctgccgcacttgaaagccatggncacacccgacagggattgatgattgaggaatgaccccccgaatggatgaattgcccaaggaacgaattccagcctggaaatttttccagggtttttgggaaacccaaattttttttccggcccgccaaaccttttgggggggcccccgtggcttggccctggaagaaaaactttgggtgccccccgtggaaaaaacccccccagaaatttttttctcgaagttttttttgttggcccgaaaacaaaaaaaaaaaaggttttaaaaaaatattttttttttttgggccgcacaaag

SEQ ID NO: 7876 - DNA, 330 bp, Zea mays
  misc_feature: Ceres CLONE 361283-F
  misc_feature: Encodes the peptide sequence at SEQ ID NO. 7877
attcgataaccaagaacaaaccattgttggacgcgttcccctcctgcacgcaacctcatctcgtcctccagatccaggatggccgtcctccttgagaccttgcctccccgagtgctctcggtgagctactttgtttcgatttatcaggaaatccgtttgcttcatgttgtgcaggctcatatctgattgctggattcggcaaacccgcgttggatcctgtatcggttagtccttgcctgcaaggttcttgttgttttgttttggtggtcgagcatcgcatgttctgcttctggatccagatctggagaaatcgcgatgctcgaccaccaa

SEQ ID NO: 7877 - protein, 35 aa, Zea mays
  misc_feature: Ceres CLONE 361283-F
MAVLLETLPPRVLSVSYFVSIYQEIRLLHVVQAHI

SEQ ID NO: 7878 - DNA, 454 bp, Zea mays
  misc_feature: Ceres CLONE 361296-F
  misc_feature: Encodes the peptide sequence at SEQ ID NO. 7879
aaaactcctctatcttcgcatctggcacgagcagccaagcaaataaaagtagagcggcgagcgacgaccggcctgggccaccctttcggccgagcgtagccgagcaggtcgtcgtcgtcgtcgcagcaccccgccggctagcatggccacgaggaggcagtggtggtggtggtgcctgctgctgctggcggcgtggtgctgcgccgcggccgcgcagtcgccgccggcggcggacccgctgcagagcaagtgccagggggacttcgggaagctgacggactgcatggactacgcgacggggcacgcggcgtcgccctcgtccacctgctgcggcgacgccggcgacacggagaaggcgcgccccgagtgcctctgctacatcatccagcaggtgcacacggggcgcaaccaggtgcagtcgctcggcctgcgcttcgaccgactcatggcgctc

SEQ ID NO: 7879 - protein, 104 aa, Zea mays
  misc_feature: Ceres CLONE 361296-F
MATRRQWWWWCLLLLAAWCCAAAAQSPPAADPLQSKCQGDFGKLTDCMDYATGHAASPSSTCCGDAGDTEKARPECLCYIIQQVHTGRNQVQSLGLRFDRLMAL

SEQ ID NO: 7880 - DNA, 448 bp, Zea mays
  misc_feature: Ceres CLONE 361310-F
  misc_feature: Encodes the peptide sequence at SEQ ID NO. 7881
gaacctacgaagagccgactcaaccgctagtacagtccacacatgacacaacgacaccaactgtcctcaatccagcagccctcgagtctcgtccccgcacatcagcagagagacgccwctaccaccaccgcaagcgacgacggggagatgtttctgcgacggatcctgaccggcggaggtggcctggcggcgctgagggcggcgcgcgccgtgaaggagacgacggggatcgtcggccttgaggtggcgcccaacgcgcgggaggttctcatcgggctctacacgcgtacgctcaaggagatcgaggccgtccccaaagacgagggctaccgcaaggccgtttgagtccttcaccaatcaccgcctccagatctgcaggaggaggacgactggaagcgcatcgaggaccgaatcggatgcgggcaagtcgaggagctcatcgaggagg

SEQ ID NO: 7881 - protein, 65 aa, Zea mays
  misc_feature: Ceres CLONE 361310-F
  misc_feature (35)..(65): Pfam Name: ETC_C1_NDUFA5 Pfam Description: ETC complex I subunit conserved region
MFLRRILTGGGGLAALRAARAVKETTGIVGLEVAPNAREVLIGLYTRTLKEIEAVPKDEGYRKAV

SEQ ID NO: 7882 - DNA, 230 bp, Zea mays
  misc_feature: Ceres CLONE 361489-F
acctctcacccttgttataaataccgctcggattcctcacgcccccacacggccacacctctcctctctctctctccctctgtccagcgcactctttctcctcactagctacccacctcagcgagccaaggccggcgaagcgcatccatcggtccatggagttgtacgtggacgagaagtggaagttctccaagaagagccggaacaacggcagccggcgcgtcccggga

SEQ ID NO: 7883 - DNA, 853 bp, Zea mays
  misc_feature: Ceres CLONE 361604
  misc_feature: Encodes the peptide sequence at SEQ ID NO. 7884
ggattaaaaaattcacctccccattccacccgctcaccatccgtctccgacccttaggctgttctgcaattctgctgcccgaccccgaataatggcggcagaggcccaggccgagggacgcgcgctgccccgagcgcctcctccgcccctggcgcgcgggggctcttccgcttccccggagaagcgcgggctcccgatcccggggttcgacggcgtggccgaggaggaggaggagcgggtgcccgagccaaagcggcgccgcgcgtgggtcgccgcgctcgacagtgcggtggcgggctgcggcgggracggggatggcgggtcgttctcgttccagcacgcgccgggctgcttcgtggcgccggaggccacgcccaagttcgggtccttcaacccgccaggggaccaagccgagctagcgggcctagatccgaagcccgtggggcgcgaagctgacgcggaagactcgccggaggcgggcgacgaggtctccgctgcgtcggcgcctggggcggaggccaaagacgagaggttgatggcatgaactgtgacctcgattttgaccagccacggaagctgcctgttagattgcttgtggtagcattacgtttctgctcgggttgaggcttcctagtttgccagttcgcaatcacttgtatttacattgttaacagttgacaagtgcagtccatttgatgctcacgctgtcaaaccaagaaacttcacctggagctattcggctcttgttgacagaaacaagtaaccgtcagtaatgttacgcagaaatcatggttgccatgcttgagaaaacaataagcctttcaaaaaaaaaaagaaaaaaaaaaaaaaaaaa

SEQ ID NO: 7884 - protein, 150 aa, Zea mays
  misc_feature: Ceres CLONE 361604
  misc_feature (73)..(73): Xaa is any aa, unknown, or other
MAAEAQAEGRALPRAPPPPLARGGSSASPEKRGLPIPGFDGVAEEEEERVPEPKRRRAWVAALDSAVAGCGGXGDGGSFSFQHAPGCFVAPEATPKFGSFNPPGDQAELAGLDPKPVGREADAEDSPEAGDEVSAASAPGAEAKDERLMA

SEQ ID NO: 7885 - DNA, 482 bp, Zea mays
  misc_feature: Ceres CLONE 361609-F
  misc_feature: Encodes the peptide sequence at SEQ ID NO. 7886
gaacagcggtgttatgtggatatcctcacctgatcggcttgaagatcctcgaaggccatttcagtactctaacagttctggctctccctgtgtttcagaatcaggatctgacatttatggcaaaagagaggtcatacagaagctaagacagcacctcaagaaacgtgatgagatgatcatggagatgcaaactcagattgctgatcttaagaactctcttaacattcaggtgacacagtccagcaatctgcagtctcaattggatgctgccaatcgtgatctgtttgaatctgaacgagagattcagcatctaaggaagattattgcagatcattgtgtcacagaagcactctctcatgataaacctttgcaagctgcgcattggcagccagatgccgcaaatgggcattctaatggctatggtgatggttgtgttgatgatgctgacctgcattgtattagcatcgagaagaggaaggtag

SEQ ID NO: 7886 - protein, 160 aa, Zea mays
  misc_feature: Ceres CLONE 361609-F
NSGVMWISSPDRLEDPRRPFQYSNSSGSPCVSESGSDIYGKREVIQKLRQHLKKRDEMIMEMQTQIADLKNSLNIQVTQSSNLQSQLDAANRDLFESEREIQHLRKIIADHCVTEALSHDKPLQAAHWQPDAANGHSNGYGDGCVDDADLHCISIEKRKV

SEQ ID NO: 7887 - DNA, 399 bp, Zea mays
  misc_feature: Ceres CLONE 361623-F
  misc_feature: Encodes the peptide sequence at SEQ ID NO. 7888
acaagtggcggcgggcatggcggtggcggcgttcccttcctgcggcgccttcgcccctccttgcctagtgagtacaaggagagccttctcctcggtggtggccatggcttccgcagcccccaggaagcccttcgcccctcctcgcgaggtacaccgccccgtggcgcactcgctgcccccgcagaagcgggagatcttcgagtcgctcgagtcgtgggcggcggacaacatcctggtgctcctcaagcccgtggagaggtcctggcagccgcaggactacctgccggacgccgcctccgagtccttcgacgacgaggtccgggagctgcgagagcgcgcccgggagatccccgacgactacttcgtctgcttcgtgggcgacatggtcaccgaggaggc

SEQ ID NO: 7888 - protein, 127 aa, Zea mays
  misc_feature: Ceres CLONE 361623-F
  misc_feature: SWISSPROT Homolog: EC 1.14.19.2 Acyl-[acyl-carrier-protein] desaturase
MAVAAFPSCGAFAPPCLVSTRRAFSSVVAMASAAPRKPFAPPREVHRPVAHSLPPQKREIFESLESWAADNILVLLKPVERSWQPQDYLPDAASESFDDEVRELRERAREIPDDYFVCFVGDMVTEE

SEQ ID NO: 7889 - DNA, 477 bp, Zea mays
  misc_feature: Ceres CLONE 361627-F
  misc_feature: Encodes the peptide sequence at SEQ ID NO. 7890
aaggaagggatgcgctttaccgacggcgacgcgtacaaaagcggttatcgaagctgccggagatgccactccccgcaccattccgaattttctccccaccctcctccgtggctgccagtcccgcgggagcgcagcgcgcgctgctctacggtcgccgcgcgccgttcgcgggagcgctcctgtttttcagcatcggcgccgtcagcgctgcggtcgcgttcaggacagggtgcgccatctcacaccgacgtccccccttcctcggggcaagaggtctcagttccactagaatggagtcagcttcgaccacagtgccatccattgtcgtgtatgtgacagttccaaatagggaagcagggaagaagctgtcacagagcatcatcagcgagaagcttgctgcttgtgtcaatatattacctggcattgaatccgtgtactggtgggagggaaaggtacaatctgatgctgaagaattac

SEQ ID NO: 7890 - protein, 138 aa, Zea mays
  misc_feature: Ceres CLONE 361627-F
  misc_feature (86)..(138): Pfam Name: CutA1 Pfam Description: CutA1 divalent ion tolerance protein
MPLPAPFRIFSPPSSVAASPAGAQRALLYGRRAPFAGALLFFSIGAVSAAVAFRTGCAISHRRPPFLGARGLSSTRMESASTTVPSIVVYVTVPNREAGKKLSQSIISEKLAACVNILPGIESVYWWEGKVQSDAEEL

SEQ ID NO: 7891 - DNA, 395 bp, Zea mays
  misc_feature: Ceres CLONE 361640-F
  misc_feature: Encodes the peptide sequence at SEQ ID NO. 7892
aacctcctccagcgccccacccgccagaggcccgatcgtcccacactcccaccacgcgacaggaacacaaaaaccctagcacaagcccacacgacgccacccggccccggacggccggcccccccgtcccacgttcccaccgggctccgagcacaaaaccctaaccttctcgctattaaagtcggcgtccagtccgtcggctgctgctacgccaccgaatccgcatctcctcgccggtcgcgcacgggcaaagcagcgatggcagcagcgacggcagttggcggacacgacagggtggaggctgcggcgtcgtccgcgggggctgtgctggccgtcgccgttgcctcgcagaggttgataggcctgctcgctcttgcggttcaaactgtaaattg

SEQ ID NO: 7892 - protein, 45 aa, Zea mays
  misc_feature: Ceres CLONE 361640-F
MAAATAVGGHDRVEAAASSAGAVLAVAVASQRLIGLLALAVQTVN

SEQ ID NO: 7893 - DNA, 393 bp, Zea mays
  misc_feature: Ceres CLONE 361654-F
  misc_feature: Encodes the peptide sequence at SEQ ID NO. 7894
aaaaactgaaccagcaacaaaccgatgcccatgagattgacatggtgatcgagctacaggccggtcgtcttctccaacgctagacaacgaagaaggagcaattaatcaagtagatcgattcaatccaatccaatggggtttctgataccagcccgtccggagcaatgcacgttgagccgtgtcgtgtctctcatcaccgtcggtgtcgtcatcgtggtttgcacgtacgtcacatcttctccggccggtggcgacgccgggaaggaggagttcttcagcatatggcaccgtcgatcatcggattttgtccccgacgatctggaggtggcgctgcgcggccgcagcgtacgcgaacaggacgctgatcctgaccatgctgaacwaggcttattc

SEQ ID NO: 7894 - protein, 87 aa, Zea mays
  misc_feature: Ceres CLONE 361654-F
  misc_feature (84)..(84): Xaa is any aa, unknown, or other
MGFLIPARPEQCTLSRVVSLITVGVVIVVCTYVTSSPAGGDAGKEEFFSIWHRRSSDFVPDDLEVALRGRSVREQDADPDHAEXGLF

SEQ ID NO: 7895 - DNA, 777 bp, Zea mays
  misc_feature: Ceres CLONE 361692-R
ttttacgatttgggtaccgggccccccctcgaggtcgacggtatcgataagcttttttttttttttttttggtatataaaatacaacaccacttttttaagaagtacatataaactctgttacgatacaaagctcttgattattccacgatattaatatttttaggctgctctagaagtctttcttatccttccccatcacacttcttatccaaactttactatataaataatatacgatgtaaaacaatattttttatggctatatacacgcttgctcatcacgtgcataacctacacaagtccaggagcacagaattttttgtgccatcactatcgctgtcccccatctttgctacagacagcatcaagtcttctgttttcagcttcagaaaatgtgcagctatactcctttacttgcaggagcacaacgtttctgcctacgagcaacagttctgtccccctgaaactacaaattcaagcaaaaacctaccgtgaagtttctgcaacattcagtcttccttcgatgacatctctaacgaaactgttcaaagaacaccgagaagatccaccttcctgatctgcgcggcgtgaagcctctctcagctccgcagcccttcttctcatctataggctatcatcgtcagtcaaatccataagcttcgttacagtatcgcagatcgcggccctttcgtacacaccatcctcccctctccgttccctcaagtcgacgccgtatcttccactcatcaggcaccgagatggccaatcaccaggc

SEQ ID NO: 7896 - DNA, 469 bp, Zea mays
  misc_feature: Ceres CLONE 361744-F
  misc_feature: Encodes the peptide sequence at SEQ ID NO. 7897
aaagttctcccttcccctctcgcttcgcttcgccaacgcctgcgagagctagggtttcgtgcgccactgcacttccggtcttccgcccgccatggccgaggcccccacgtatcagatcctggtgcgtctcctcgacgggcgcaccacatgtcttcgcttctccacgcccaccgtctccggcgccgtgctcctcgaagctgtcgcgtctatatctcgcgtccccgccgccgccctctggcgcagacgctaagaagcttaagatttggttgggaaagaacaaagtagaagaagatgaaagtgatagcgatagtgacagtgacatggatgatgaggacagtgaagatcaggagagcgcagatgcaaaatctctcgtagttgatgaaggcaattgctcaaatggatccataaaaaatgagaaacttgatctgggttctgtttctggatcacattcagaaggagagtcctcagg

SEQ ID NO: 7897 - protein, 155 aa, Zea mays
  misc_feature: Ceres CLONE 361744-F
SSPFPSRFASPTPARARVSCATALPVFRPPWPRPPRIRSWCVSSTGAPHVFASPRPPSPAPCSSKLSRLYLASPPPPSGADAKKLKIWLGKNKVEEDESDSDSDSDMDDEDSEDQESADAKSLVVDEGNCSNGSIKNEKLDLGSVSGSHSEGESS

SEQ ID NO: 7898 - DNA, 480 bp, Zea mays
  misc_feature: Ceres CLONE 361772-F
  misc_feature: Encodes the peptide sequence at SEQ ID NO. 7899
agatccacaacaaatagcgaaaccctagcccaaactcgaccgcctctgctataagtagctccactctctctcctccaagcctaccccagccgccgccgccgccaccgccacctgccccagcgcgccgccgccgcagccaccatgggtcgcgtccgcaccaagaccgtgaagaagacctccaggcaggtgatcgagaagtactactcccgcatgaccctcgacttccacaccaacaagaaggtgctcgaggaggtctcgattctgccctcgaagcgcctccgcaacaaggtggctggcttcagtacccacctgatgcgccgcatccagcgcggcccagtccgcggcatctcgctcaagctgcaggaggaggagcgcgagcgccgcatggacttcgtgccggagaagtccgcgctcgaggtcgaagagatccgcgtcgacaaggagaccatggagatgctcgctgccctcgggcatggccga

SEQ ID NO: 7899 - protein, 113 aa, Zea mays
  misc_feature: Ceres CLONE 361772-F
  misc_feature (1)..(113): Pfam Name: Ribosomal_S17e Pfam Description: Ribosomal S17
MGRVRTKTVKKTSRQVIEKYYSRMTLDFHTNKKVLEEVSILPSKRLRNKVAGFSTHLMRRIQRGPVRGISLKLQEEERERRMDFVPEKSALEVEEIRVDKETMEMLAALGHGR

SEQ ID NO: 7900 - DNA, 446 bp, Zea mays
  misc_feature: Ceres CLONE 361789-F
  misc_feature: Encodes the peptide sequence at SEQ ID NO. 7901
atttttttctactttcgagcgcagaaacgagagggcaggagcagccgcagtcccggcgatcccgccgccggtcgccctcatacttcctcgtcactgccttcgtttctctttccaacaatcaagatgagccgtggcggtagcgcgggtggtggtcaaagttctctgggttacctctttggaagcggtgagccccccaaaccagcagtggcaccagctgtaagtgctccacctgctgctgcaggtgctccacctgctgagaaaccacctgctgcaaagcctgatggcaccagtcagattgctgctggggttaccagccaaaccaataactaccacagggccgacggtcagaacaccggcaacttccttacggaccgccyttcgaccaaggtccacgctgctcctggcggtggctcttccctgggatacctgtttggtggcaactgatg

SEQ ID NO: 7901 - protein, 106 aa, Zea mays
  misc_feature: Ceres CLONE 361789-F
  misc_feature (85)..(85): Xaa is any aa, unknown, or other
MSRGGSAGGGQSSLGYLFGSGEPPKPAVAPAVSAPPAAAGAPPAEKPPAAKPDGTSQIAAGVTSQTNNYHRADGQNTGNFLTDRXSTKVHAAPGGGSSLGYLFGGN

SEQ ID NO: 7902 - DNA, 442 bp, Zea mays
  misc_feature: Ceres CLONE 361800-F
  misc_feature: Encodes the peptide sequence at SEQ ID NO. 7903
aatctcgttgtccgttgtactctctctctctattcgttccccgcctcaccccgagccagccgtctcgctagggtttcgccgccgccgccgccatgcctcgccgcagctcaggaaggtctgccccacgcccagctccccgtgctgctccagtgaggaacccgccacagccagcacgccaggctcctcctccagctcctgttcgagatggtggtggctccatgtttggaggaattgggtccaccattgctcaaggtatggcgtttggcacgggtagtgccatggcacacagggctgttgtatcgtgatcatggtcctgggagttgttgcatccggggcgcgctttttaggtcaggcgtcgtgtgcgatgtttgtggggtcaggctggcatgtcatgcccgtgcgtgaccctgattgcgagccggcaagcaagaagacaaaaaaa

SEQ ID NO: 7903 - protein, 70 aa, Zea mays
  misc_feature: Ceres CLONE 361800-F
MPRRSSGRSAPRPAPRAAPVRNPPQPARQAPPPAPVRDGGGSMFGGIGSTIAQGMAFGTGSAMAHRAVVS

SEQ ID NO: 7904 - DNA, 420 bp, Zea mays
  misc_feature: Ceres CLONE 361851-F
  misc_feature: Encodes the peptide sequence at SEQ ID NO. 7905
acaccctaaccaaaacatcctgccgtttcccgttcacccagcgtgcgctccatcttggcgaggccgcgagggcgaccgctacagcagcagccgccgccgcgcgcagatccccaggccttcgttgaacccttcgccgtaacgagatcagatggctgggtatatgtcaagagggccccaaaatggttctgtgtatgtctgcaatctacctcctggaactgatgaaaatatgttggctgaatattttggcaccataggcttgctaaagaaggacaaaaggactgggcgtccaaaaatttggatatacagggacaaagttactaatgaaccaaagggtgatgcaacagtcacctatgaggatccacatgctgcttcagctgctgtggaatggttcgataacaaggatttccatgggagcactat

SEQ ID NO: 7905 - protein, 90 aa, Zea mays
  misc_feature: Ceres CLONE 361851-F
  misc_feature (14)..(90): Pfam Name: RRM_1 Pfam Description: RNA recognition motif. (a.k.a. RRM, RBD, or RNP domain)
MAGYMSRGPQNGSVYVCNLPPGTDENMLAEYFGTIGLLKKDKRTGRPKIWIYRDKVTNEPKGDATVTYEDPHAASAAVEWFDNKDFHGST

SEQ ID NO: 7906 - DNA, 469 bp, Zea mays
  misc_feature: Ceres CLONE 361921-F
  misc_feature: Encodes the peptide sequence at SEQ ID NO. 7907
aataaagctatgtcggcccaacgcgcacggcacgcgtccaggctcggaggctccaacagcacgacgcaaccgaccccaccttccctttacgcgaagaagcatcaccgcgagacgcgagtcgtcctcctctctgtcttcgctcggcgatctatcaaggagggtgagggggagatggcggagaatccgcagctgtttgggaacgggatgccggtgccgttctacggcgagatgttcgtcctcgtccgcgacggcgtcgagttccacgtcgacaagatcccgtcagctcctggaggtcatgtgaaaacaaaaggcacaatttacctgtccaatataaggatggtgtttgttgccagcaagcctgttggcaacttctttgcttttgatatgccactgttgtttgtgcatggtgagaagttcaatcagcccatatttcactgcaacaacatctctggattcgttgaaccagtcg

SEQ ID NO: 7907 - protein, 99 aa, Zea mays
  misc_feature: Ceres CLONE 361921-F
MAENPQLFGNGMPVPFYGEMFVLVRDGVEFHVDKIPSAPGGHVKTKGTIYLSNIRMVFVASKPVGNFFAFDMPLLFVHGEKFNQPIFHCNNISGFVEPV

SEQ ID NO: 7908 - DNA, 521 bp, Zea mays
  misc_feature: Ceres CLONE 361974-F
  misc_feature: Encodes the peptide sequence at SEQ ID NO. 7909
aatcccgctgttcgcgagccactccctctgacgagtgacgacgaaaccctaggccatggcttggcgcggcgccgcctcccgctccattatcgccgccgtccgtgctcgcgcggcatccccgtcttccaccgccgcctcgcgcctccgctcgacagctccacttcccgccccctcgcgcctccgctcgacagctccacttcccgccccctcgcgccggtccgtccccgccttcgctttcgcgaccgcgaggccgttggcggcgatgtcggggtccccggcggcggccgtggtgaagctcaccgggcacgcggcgacgagcgtgcgggcgtgctgtgagctctcccagggcacttaatgcgcactttctgtccttaaatgcaagggttggattctttggaggttgcatcccttgaaactcgtcgggcttgcgtccttttccatgcattttgcagagtacttagcacctcgtgtgtcggcaaacggacagtatatctgctgtaacttacataaataatcatatg

SEQ ID NO: 7909 - protein, 99 aa, Zea mays
  misc_feature: Ceres CLONE 361974-F
MAWRGAASRSIIAAVRARAASPSSTAASRLRSTAPLPAPSRLRSTAPLPAPSRRSVPAFAFATARPLAAMSGSPAAAVVKLTGHAATSVRACCELSQGT

SEQ ID NO: 7910 - DNA, 496 bp, Zea mays
  misc_feature: Ceres CLONE 362016-F
  misc_feature: Encodes the peptide sequence at SEQ ID NO. 7911
accttggccgctgttctcctcaccgctcgtgctctctctctctcggcgccgactcggctaccgcgccgccctacggaagcttcccaggtcttcgtcaggcttttctccggcaacgagcaccctgatcgtgaacctccacacctcaacgatagatggcggggttcagaagccttgcacccaagaccaggaacctggtggtggccgggggactgtctgccttcgtgctcggggtctactactacaccatgagagcggtgggaggcacggacgagctccaggtggcgatcgacaagtttgaggagacgaagaagcaggatgccgctagaaactctagctccagcgcaggaggatcataattcataaacacgcggacacgccctggatctgctgcaggctgacatggtagtggtacgacgacagtcacgtcgctcagtaggccatgaccatgcgttctgcttgtactgtggaataaataaatgatgggttacggtactct

SEQ ID NO: 7911 - protein, 67 aa, Zea mays
  misc_feature: Ceres CLONE 362016-F
MAGFRSLAPKTRNLVVAGGLSAFVLGVYYYTMRAVGGTDELQVAIDKFEETKKQDAARNSSSSAGGS

SEQ ID NO: 7912 - DNA, 486 bp, Zea mays
  misc_feature: Ceres CLONE 362052-F
acagtacagacaccaggaacggttgaacaagcgtgggtgggagctgggaagcagaggcggccagtgggggcaccgggaggtggagctgttgtgccaaccgagagttggtggcgcggcgcctgccgccgggcagggactggtggtgctgccttctcggagtgtggcagcggcggcggcggagcagtgccagatctgcgactccgacggcgcaatccaccattccctggccagtgggggcaccgggaggtggagctgttgttccagcaaccgagagttggtggcgcggcgccggccgccgggcagggattggtggtgctgccttctcggagtgcggcggcggcggagcagtgccagatctgcgaccccgacggcgcamtccaccattccctggcctccgcattgcatcaggatctaacaatcaacaagcaagcttgtccagtctcataagtaacagctatctggtgtagaagggttgctgctatctgc

SEQ ID NO: 7913 - DNA, 319 bp, Zea mays
  misc_feature: Ceres CLONE 362147-F
  misc_feature: Encodes the peptide sequence at SEQ ID NO. 7914
  misc_feature (258)..(258): n is a, c, t, g, unknown, or other
aaaaaacacgtttccttaccctaaccgacagcagccgcsgtttcttcatcttcctcgcagcggcggcgctccgtcttccgctcctccctcccccgacacgcgctcggcacgcaggcracggcggcagcgctcaggctcgggctcgggctctcagcgacggcggggcagtcccagactcggcggcggcktcaccggctccccctcccgcatctcgccaatcgccttgcgccctcgcctccggtcctccgcacaacggcnggcgaccctgcgtgcgcgcttcccgctcccctgccgcctccggkggaccgtaracggcgct

SEQ ID NO: 7914 - protein, 106 aa, Zea mays
  misc_feature: Ceres CLONE 362147-F
  misc_feature (13)..(13): Xaa is any aa, unknown, or other
  misc_feature (39)..(39): Xaa is any aa, unknown, or other
  misc_feature (63)..(63): Xaa is any aa, unknown, or other
  misc_feature (86)..(86): Xaa is any aa, unknown, or other
  misc_feature (101)..(101): Xaa is any aa, unknown, or other
  misc_feature (104)..(104): Xaa is any aa, unknown, or other
KNTFPYPNRQQPXFLHLPRSGGAPSSAPPSPDTRSARRXRRQRSGSGSGSQRRRGSPRLGGGXTGSPSRISPIALRPRLRSSAQRXATLRARFPLPCRLRXTVXGA

SEQ ID NO: 7915 - DNA, 476 bp, Zea mays
  misc_feature: Ceres CLONE 362190-F
  misc_feature: Encodes the peptide sequence at SEQ ID NO. 7916
atcaccatttcgctagctccatagcacttgttccagctagctaggagagagagctttgtttaggtaatttagctttgtgtatatcttcttggttctagctctttgaaattttttttatctgggtgcaggcggcggcaagatgaacaggaagccaggagactgggactgcagggcgtgccagcacctcaacttcagccgtcgggatgcatgccagcgctgcagtgaaccacgtggagttggtgatcgtagcggcggtggtggcgacttgggtgggcgtggtggttcctccttcggcggtggctttggtgctggctctgatgtccgccctggtgactggtactgctcctgcggcgcacacaacttcgccagccgctccaactgcttcaggtgctctgcctacaaggaggaggctgccggcgcctttgatagtgacatgtcacgctcacgcggctacgccggcttcggcagcggcgctg

SEQ ID NO: 7916 - protein, 112 aa, Zea mays
  misc_feature: Ceres CLONE 362190-F
  misc_feature (62)..(90): Pfam Name: zf-RanBP Pfam Description: Zn-finger in Ran binding protein and others
  misc_feature (4)..(33): Pfam Name: zf-RanBP Pfam Description: Zn-finger in Ran binding protein and others
MNRKPGDWDCRACQHLNFSRRDACQRCSEPRGVGDRSGGGGDLGGRGGSSFGGGFGAGSDVRPGDWYCSCGAHNFASRSNCFRCSAYKEEAAGAFDSDMSRSRGYAGFGSGA

SEQ ID NO: 7917 - DNA, 489 bp, Zea mays
  misc_feature: Ceres CLONE 362231-F
  misc_feature: Encodes the peptide sequence at SEQ ID NO. 7918
ataaggtctctcctacgccgcggccacacagactccagtctcctctagccgtctcgcgcgcttcaccttccccaccccgccgccgccatcgcacgcccgcagccgcatccgctatgggtgcgtacaagtacgtctcggagctatggcggaggaagcagtccgatgtgatgcggttcgtgcagcgcgtgcgctgctgggagtacaggcagcagccggccatcgtccgcctcacaaggcccactcgccctgacaaggcgcgccgcctcggctacaaggccaagcagggttatgttgtttaccgtgtccgtgttaggcgtggtggcaggaagaggcctgtgcctaaaggtattgtctatggcaagccaaagcaccagggtatcacccagctcaagttccagaggaacaagaggtctgttgctgaggagagggctggacgaaagcttggtggactcagggttctcaactcctactgggtgaatgaggawagca

SEQ ID NO: 7918 - protein, 125 aa, Zea mays
  misc_feature: Ceres CLONE 362231-F
  misc_feature (2)..(125): Pfam Name: Ribosomal_L15e Pfam Description: Ribosomal L15
  misc_feature (124)..(124): Xaa is any aa, unknown, or other
MGAYKYVSELWRRKQSDVMRFVQRVRCWEYRQQPAIVRLTRPTRPDKARRLGYKAKQGYVVYRVRVRRGGRKRPVPKGIVYGKPKHQGITQLKFQRNKRSVAEERAGRKLGGLRVLNSYWVNEXS

SEQ ID NO: 7919 - DNA, 499 bp, Zea mays
  misc_feature: Ceres CLONE 362237-F
  misc_feature: Encodes the peptide sequence at SEQ ID NO. 7920
aacaaagcatcttgagtgttcgacagcgagccatggagaagacgtccgagaacgccatcccgccggcggcatccccgctgatgctgttcgggtcgtgggcgagctcgtacacgcaccgcgtgcagctggcgctgcggctcaagggcctggagtacgactaccttgacgacgcctggccggagacccgcccgctgctccccgccgacgccttcgaccgcgcgctcgcgcggttctggtgccacttcgccgacgacaagctcgggccggcggtgggcgcggtgttcgcgtcgacgggggagggccaggaggcggcggtgcggcaggtgcacgagaacctggcgctgatcgagtccgagctccgcgacggcgcgttccggggccgccgcttcttcggcggcgacgaggtgggcctgctggacgtcgtcctgggctgcggctcctactggctcgccgtgttcgaggaggtgaccggggtgcgcctcgtggacgccgacgcctt

SEQ ID NO: 7920 - protein, 155 aa, Zea mays
  misc_feature: Ceres CLONE 362237-F
  misc_feature: SWISSPROT Homolog: EC 4.4.1.5 Lactoylglutathione lyase
MEKTSENAIPPAASPLMLFGSWASSYTHRVQLALRLKGLEYDYLDDAWPETRPLLPADAFDRALARFWCHFADDKLGPAVGAVFASTGEGQEAAVRQVHENLALIESELRDGAFRGRRFFGGDEVGLLDVVLGCGSYWLAVFEEVTGVRLVDADA

SEQ ID NO: 7921 - DNA, 532 bp, Zea mays
  misc_feature: Ceres CLONE 362316-F
  misc_feature: Encodes the peptide sequence at SEQ ID NO. 7922
agagtgtctagctgagaacatggtgacctcaagcaagggcaaggtatgtgtaaccggggcctcaggctttgttgcctcttggcttatcaaacggctcctcgagtctggatatcatgtggtagggactgtcagggacccaggaaatcaccaaaaaacagcccacctttggaaattacctggcgctaaagagaggctgcaaatcgtgcgagctgatctgttggaagaagggagcttcgacagcgccgtgatggcctgtgagggtgtattccacactgcatcccccgtcctcgctaaacccgactctactagcaaggaggaaacgctcgttcctgcggtgaacggtactctgaacgtgctgagatcgtgcaagaagaaccccttcctgaaaagggtcgtccttacgtcttcgtcgtctgcggtgaggatcagggacgatggtggccagtccagcagtaacatctcgctggacgaaacgacatggagctccgtgccactctgcgagaagatgcacgtgagatactgaacagtgtct

SEQ ID NO: 7922 - protein, 167 aa, Zea mays
  misc_feature: Ceres CLONE 362316-F
  misc_feature (7)..(141): Pfam Name: adh_short Pfam Description: short chain dehydrogenase
  misc_feature: SWISSPROT Homolog: EC 1.1.1.219 Dihydrokaempferol 4-reductase
MVTSSKGKVCVTGASGFVASWLIKRLLESGYHVVGTVRDPGNHQKTAHLWKLPGAKERLQIVRADLLEEGSFDSAVMACEGVFHTASPVLAKPDSTSKEETLVPAVNGTLNVLRSCKKNPFLKRVVLTSSSSAVRIRDDGGQSSSNISLDETTWSSVPLCEKMHVRY

SEQ ID NO: 7923 - DNA, 659 bp, Zea mays
  misc_feature: Ceres CLONE 362337-R
  misc_feature: Encodes the peptide sequence at SEQ ID NO. 7924
ccgattgggtaccgggccccccctcgaggtcgacggtatcgataagcttttttttttttttttttgtagtaggacaattatcgatcgtgataaagtatgccaagtacatcaacgaaccccgacgatcacctagcgctcgtcatcgtggtcgtcgtcgtctatgcatgcgttcttgccacgggggtcgccatcgtcgtcacctccgtgcaccgcctcgtcgacgacacccacaccacctgcggctgctgcggcagcgttggcgaactgcagcctgagccggccgccctcgcgcgtggcctgcaggagctccttcccggggatcaccacctccagcagcacgaaccggccgtcctcccggaacgaccggaagcacacgtacggcttgccgccgcgcccgatggacggtatcggcggcgggaacgtctttggctgcctctcctccttcaccgcctcctcggcgtcgctgccgtccgccgtgtccgtgcccttgagcgcggcggcggcggcctcggcctcggcctcggcgtcgccgtccttgaacatgtcgtcagcgtccacggtgctctcggagccgagcccctcggtgcagagcagcagcgacgcggaggagcccttcttggtgcagaagctcgcgctcctcttcaccgtggccacggtgg

SEQ ID NO: 7924 - protein, 90 aa, Zea mays
  misc_feature: Ceres CLONE 362337-R
DWVPGPPSRSTVSISFFFFFFVVGQLSIVIKYAKYINEPRRSPSARHRGRRRLCMRSCHGGRHRRHLRAPPRRRHPHHLRLLRQRWRTAA

SEQ ID NO: 7925 - DNA, 1584 bp, Zea mays
  misc_feature: Ceres CLONE 362394
  misc_feature: Encodes the peptide sequence at SEQ ID NO. 7926
agcttctttcgccctcctgccttccgcttgtagttgtagtagtggggggagagtgggagaaccggagaagagatgaacagtagtgaggctagcacgcaagaccgtgttgcgcccgcgctcgaggctacggagaagatactggccgccgtggcgcggctgccgggacgtcggatgctggagctaaggcggctgggacgcgctgcgccctccgcgggtgcggagaccgaggcggcgaagcggggccgctctgtgtcggacgacacctccgcgggctcgtcccgcgagtcgtctgcgaaggtggcgcccgagcccgagccgcagggtggtggggctcctgcggtggcaccggggtggcccaggcccgtgtcgcacggcgcgatgtcggtgatcgggcggcgccgggagatggaggacgcggtcgccgtcgccgcgccgttcccggcgggggtggagttcttcgcggtgtacgacgggcacggcgggtcgcgggtggcggacgcgtgccgggagcggctgcacgtggtgctcgcggaggaggtggcggcgcgtctgcaccttgttaggaacggcggcgaggacgaggagggggacggggcgcgctggagggaggccatggaggcctgcttcgcgcgcgtggacggcgaggtggccgtcgtggagagcgagtcgaacaacgtcggccacgcggtgacggtgggctccaccgccgtcgtggtggtcgtggggccccgccacatcgtggtcgccaactgcggcgactcccgcgccgtgctctcccgcggcggcgtccccgtgccgctttccttcgaccacaagccagatcggcctgatgagttggaaagggtagaatcagcaggtggcagggtcattaactggatggggtaccgtgtcctgggtgtgcttgcgacatcaaggtcaattggtgactattacatgaagccattcatatcagcggaaccagaggtgactgtcacagagcgcacgcacagggacgagttcatcatcctggcgagcgacgggctgtgggacgtcatgtccaacgaggtggcctgcagggtcgcgaagagctgtctgtgcgggcgcgcggcttccaagtgccctgacaccatccgcgggagctcggccagtgatgccgccgcggtgctggtggagttcgccatgtcgcggggcagcactgacaacatcagcgtcgtggtggtggagctgaaacgtctgaagaggtggaagggtggcagtagacagaacggtcggacgtagcctggccctgtaggagtctccggctcgtcgcgaaatatatgcatggcgacggagctctagggaagcagccgagcatatgacggaatggtgtaaaaagaagaagaagaagaagaagagagggttctgactcttgagagctatacctatgctgtgaccaggtgagtgtaggagctgctcgtagctttgccgttgtattgcgttggttacttggttctttagttcaatcaatactaacaaaatggcgttccgggccaaaaaaaaaaaaaaaaaaaaaaaaaaaaaaaaaaaaaaaaaaaaaaaaaaaaaaaaagraaaaaaaaaaaaaaa

SEQ ID NO: 7926 - protein, 394 aa, Zea mays
  misc_feature: Ceres CLONE 362394
  misc_feature (98)..(371): Pfam Name: PP2C Pfam Description: Protein phosphatase 2C
  misc_feature: SWISSPROT Homolog: EC 3.1.3.16 Phosphoprotein phosphatase
MNSSEASTQDRVAPALEATEKILAAVARLPGRRMLELRRLGRAAPSAGAETEAAKRGRSVSDDTSAGSSRESSAKVAPEPEPQGGGAPAVAPGWPRPVSHGAMSVIGRRREMEDAVAVAAPFPAGVEFFAVYDGHGGSRVADACRERLHVVLAEEVAARLHLVRNGGEDEEGDGARWREAMEACFARVDGEVAVVESESNNVGHAVTVGSTAVVVVVGPRHIVVANCGDSRAVLSRGGVPVPLSFDHKPDRPDELERVESAGGRVINWMGYRVLGVLATSRSIGDYYMKPFISAEPEVTVTERTHRDEFIILASDGLWDVMSNEVACRVAKSCLCGRAASKCPDTIRGSSASDAAAVLVEFAMSRGSTDNISVVVVELKRLKRWKGGSRQNGRT

SEQ ID NO: 7927 - DNA, 499 bp, Zea mays
  misc_feature: Ceres CLONE 362403-F
  misc_feature: Encodes the peptide sequence at SEQ ID NO. 7928
atctgcatctgtatgtgtgcttgcccccggccggccacctttccggccgatccatcatctagagctagctcatcatcagtctttggcgtgtgtgtatgtatatggtggtgaccagcagctagctatagcagcagggtggttgttctatagttcgttcctatggttatggcggcggcggcggcggtactgctcgcgctggccgccgtggcgacggaggtggccgcggcaggaacgacgtacacggtgggcgcgccggacgggctgtgggacatgcagaccgactacgcgcagtgggtgaagagcaagaccttccgccccggcgacaccatcacgttcacgtactcgccggarctgcacgacgtggtggaggtgacgagggccggctacgatgcctgctccagcgccaacaacatctccgccttccgcaccggcaacgacgccgtgcccctcaccgccgtcggcacccgctacttcctctgcggcctcacgggccactgcg

SEQ ID NO: 7928 - protein, 111 aa, Zea mays
  misc_feature: Ceres CLONE 362403-F
  misc_feature (34)..(111): Pfam Name: Cu_bind_like Pfam Description: Plastocyanin-like domain
MAAAAAVLLALAAVATEVAAAGTTYTVGAPDGLWDMQTDYAQWVKSKTFRPGDTITFTYSPELHDVVEVTRAGYDACSSANNISAFRTGNDAVPLTAVGTRYFLCGLTGHC

SEQ ID NO: 7929 - DNA, 466 bp, Zea mays
  misc_feature: Ceres CLONE 362453-F
  misc_feature: Encodes the peptide sequence at SEQ ID NO. 7930
aaagttctcccttcccctctcgcttcgcttcgccaacgcctgcgagagctagggtttcgtgcgccactgcacttccggtcttccgcccgccatggccgaggcccccacgtatcagatcctggtgcgtctcctcgacgggcgcaccacatgtcttcgcttctccacgcccaccgtctccggcgccgtgctcctcgaagctgtcgcgtctatatctcgcgtccccgccgccgccctctggcgcagacgctaagaagcttaagatttggttgggaaagaacaaagtagaagaagatgaaagtgatagcgatagtgacagtgacatggatgatgaggacagtgaagatcaggagagcgcagatgcaaaatctctcgtagttgatgaaggcaattgctcaaatggatccataaaaaatgagaaacttgatctgggttctgtttctggatcacattcagaaggagagtcctc

SEQ ID NO: 7930 - protein, 154 aa, Zea mays
  misc_feature: Ceres CLONE 362453-F
SSPFPSRFASPTPARARVSCATALPVFRPPWPRPPRIRSWCVSSTGAPHVFASPRPPSPAPCSSKLSRLYLASPPPPSGADAKKLKIWLGKNKVEEDESDSDSDSDMDDEDSEDQESADAKSLVVDEGNCSNGSIKNEKLDLGSVSGSHSEGES

SEQ ID NO: 7931 - DNA, 500 bp, Zea mays
  misc_feature: Ceres CLONE 362488-F
attatcattgcttctatattgttccaaacacttgtactcttccgataaccgcggactaatttgaaaccagtaaccgtgaactaacttcaaatccactaccattcatttactcgcaggagctccagctgcaaaccctccacagggaggagattttgaagcgaaagtcacgaagcttgtggagctcggttttgacagggcgtcggtgacacaagcgctcaagttgttcaacgggaatgaggagcaagctgctgcgttcttgtttggtggttagactggtgggagcagccgttcctggctttgtgttcgctcaaccctttccagggttgagtacttgaatatttgatacgaaagtgattaaagtatttggatactgtttgtccagtgaaaggacttacttttagaggttttatgttttctcttttctgagaacaaacatttgttttctgtacctgatacatagactgatagacaccagaatggagacaaaaaaaaaaaaaaaa

SEQ ID NO: 7932 - DNA, 502 bp, Zea mays
  misc_feature: Ceres CLONE 362499-F
  misc_feature: Encodes the peptide sequence at SEQ ID NO. 7933
aaccctatttcatgtgacgtgaacccctttcgctcgctccgagtgcggaggaaggggagctcgacgcacccaagtcgcccgcccacggaacgcgccgccgccgccgccgctggccaaagcaaggtcgcttgagacgggaacgaagctgcacatctccaaccttgactccggcgtcaccatcgaggatgtccaggaactcttctcagaagttggggagctcaagcgttattctatgaattatgacaaggatgggagatctaaggggactgtggaagttgtctttgcaaggaaagtggatgctttggatgctatcaagagatacaatggtgttctacttgatgggaagccaatgaatctagagctcattggaaacaatgtcgaaccacctcccatgccaccagtaatacacagtcgtcctttgcagaactataatgatatccatagcagtatgcctcaatcccaaagaggtggtcagcgaagagtaccccaaggcaacggtcgg

SEQ ID NO: 7933 - protein, 90 aa, Zea mays
  misc_feature: Ceres CLONE 362499-F
MNYDKDGRSKGTVEVVFARKVDALDAIKRYNGVLLDGKPMNLELIGNNVEPPPMPPVIHSRPLQNYNDIHSSMPQSQRGGQRRVPQGNGR

SEQ ID NO: 7934 - DNA, 456 bp, Zea mays
  misc_feature: Ceres CLONE 362512-F
  misc_feature: Encodes the peptide sequence at SEQ ID NO. 7935
aacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctggcaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggtacgtggtgatgtcggatgagatcctcaagaactacccggagctggcgcaggaggggctgccgacgatgaatcagcgtctggacatctcgaacgcggcggtgacgcwgatggcgacggaggcgtccctgtcgtgcgtccgctcgtgg

SEQ ID NO: 7935 - protein, 124 aa, Zea mays
  misc_feature: Ceres CLONE 362512-F
  misc_feature (10)..(124): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
  misc_feature (111)..(111): Xaa is any aa, unknown, or other
MVSSSMDTTSDKRASSMLAPNPGKATILALGHAFPQQLVMQDYVVDGFMKNTNCDDPELKEKLTRLCKTTTVRTRYVVMSDEILKNYPELAQEGLPTMNQRLDISNAAVTXMATEASLSCVRSW

SEQ ID NO: 7936 - DNA, 455 bp, Zea mays
  misc_feature: Ceres CLONE 362657-F
  misc_feature: Encodes the peptide sequence at SEQ ID NO. 7937
aatataaaccgaccccaacgcatccattatattcagcttcttgatctcacacgaaggcatggcgacggagatccagggctactacgatgacggcaccgccgtggtgtcgttcgacgtgcacaacatcgacaccacgctgacgaacttgggcagcgtggtggagtggtggctgggtgagacctatcgcctccaccaccgcggccacatcgccggcctcgacgtggagtggcgccccgctcgcgtgccgggccccgtccccgtcgccgtgctgcagatctgcgtcgaccaccgctgcctcgtattccagatcctccaagccgactacatccccgacgccctgtccaggttcctcgccgaccgccggttcaccttcgtgggggtcgggatcagcggcgacgtcgcaaagctgcgggcgggtacaggctgggggtggcgagcgccgtggacctgcgcgt

SEQ ID NO: 7937 - protein, 132 aa, Zea mays
  misc_feature: Ceres CLONE 362657-F
MATEIQGYYDDGTAVVSFDVHNIDTTLTNLGSVVEWWLGETYRLHHRGHIAGLDVEWRPARVPGPVPVAVLQICVDHRCLVFQILQADYIPDALSRFLADRRFTFVGVGISGDVAKLRAGTGWGWRAPWTCA

SEQ ID NO: 7938 - DNA, 493 bp, Zea mays
  misc_feature: Ceres CLONE 362670-F
  misc_feature: Encodes the peptide sequence at SEQ ID NO. 7939
gtcatgttctttggcaaacacacacacacacacatcgtttgctgttgcaacaaagctctacacgggaagacaggctgcttctttcttgcagtctctggtccagaagcctgaagaaatggcgtcacccaacgtcacattcctcgccttcttcgtggccctcgcactattggcgcttcacaccaccgacgcagcagcggcggcggcagaaaccttgcgccataggagcgacacatggtgcgtggccaagccgtcgacgcaggaggcggcgctgcggggcaacctggagttcgcctgctccgagagcgactgcggcgccatccagggcaccggcggctgcgcccagcccgacagcctgctgtcacgggcgtcggtggccatgaacgcctactaccaggcccgggggaggaactcgtggaactgcttcttcaacggcaccggctaatcaccatcactgaccccagtgagtgcttccttgcttgctgtgagtgtctca

SEQ ID NO: 7939 - protein, 108 aa, Zea mays
  misc_feature: Ceres CLONE 362670-F
  misc_feature (39)..(108): Pfam Name: X8 Pfam Description: X8 domain
  misc_feature: SWISSPROT Homolog: EC 3.2.1.39 Glucan endo-1,3-beta-D-glucosidase
MASPNVTFLAFFVALALLALHTTDAAAAAAETLRHRSDTWCVAKPSTQEAALRGNLEFACSESDCGAIQGTGGCAQPDSLLSRASVAMNAYYQARGRNSWNCFFNGTG

SEQ ID NO: 7940 - DNA, 466 bp, Zea mays
  misc_feature: Ceres CLONE 362674-F
  misc_feature: Encodes the peptide sequence at SEQ ID NO. 7941
caccgcagccctagcgcgccgccaccttcaccttcccaggccgccgccgccgccgcctccattgctgctaaacccgcaaccatgggtcccgtgctgaagcgcccgaccccgggcacggtgcagtgcttcgggcgcaagaagacggccgtggccgtggcctacacgaagccaggccgggggatgatcaaggtgaacggcgtcccgatcgagctgctccgtcccgagatgctgcggctcaaggccatggagcccgtgctgctggcggggcggtccaggttcaaggacatcgacatgcggatccgcgtgcgcggcggcgggaagacgtcgcagatctacgccatccgccaggccgtcgccaagggtctcgtggcctactaccagaagtacgtggacgaggcggcgaaaaaggagatcaaggacatcttcatgcgctacgagcgcaccctcctcgtcgccgacccccgcc

SEQ ID NO: 7941 - protein, 128 aa, Zea mays
  misc_feature: Ceres CLONE 362674-F
  misc_feature (17)..(128): Pfam Name: Ribosomal_S9 Pfam Description: Ribosomal protein S9/S16
MGPVLKRPTPGTVQCFGRKKTAVAVAYTKPGRGMIKVNGVPIELLRPEMLRLKAMEPVLLAGRSRFKDIDMRIRVRGGGKTSQIYAIRQAVAKGLVAYYQKYVDEAAKKEIKDIFMRYERTLLVADPR

SEQ ID NO: 7942 - DNA, 467 bp, Zea mays
  misc_feature: Ceres CLONE 362679-F
  misc_feature: Encodes the peptide sequence at SEQ ID NO. 7943
aacgacaaacacgagcgcgggcgcgcacaagttcgccaacccccaccccccgcgtgctgcgcgtcgttggaaccaaggcttggattagcctcgccgaggaggaggtggtggtcggcgaggggctcgcggggatggggatctcgaggccccttgtggtggcgatggcggtggcgctgctgatcgccgtcgccggtgcgaccgccgaggagcaggagcccctgctggcggcggacgcggtggccggcgcggtggaggcggcgctcagggccgagctggggcaactccgggcgaagatctcggcgctagagtcagacatagaagagcgatctcaagaactgaagaataaggatgatgccatcatgaacctggagaaagccattgaagagaagtcaaaggctattacctctatgctggacgagattgcttccctccaggcaaaagggtctgtagctgccgaggagcaggct

SEQ ID NO: 7943 - protein, 112 aa, Zea mays
  misc_feature: Ceres CLONE 362679-F
MGISRPLVVAMAVALLIAVAGATAEEQEPLLAADAVAGAVEAALRAELGQLRAKISALESDIEERSQELKNKDDAIMNLEKAIEEKSKAITSMLDEIASLQAKGSVAAEEQA

SEQ ID NO: 7944 - DNA, 1162 bp, Zea mays
  misc_feature: Ceres CLONE 362702
  misc_feature: Encodes the peptide sequence at SEQ ID NO. 7945
caccacagcatccgcagttccccgaccacaccgttcctccgaggtccgagcccaggagcagccccgcgccaggaggaagtttgttcttttaacaatatgtcgagggaggagaatgtttacatggccaagttggctgagcaggctgaaaggtatgaggagatggttgagtatatggagaaggtggctaagactgtagatgtggaagagctcactgttgaggagcgtaatcttctgtctgttgcatacaagaatgtgattggggctcgccgcgcttcatggcgcattgtttcttccattgaacaaaaggaggagtcccgtaagaacgaagagcatgtgaaccttatcaaggaatatcgtggcaagatcgaggctgaactgagcaatatctgtgatggcatcttgaagctgcttgactcccacctagtgccttcttctactgctgctgaatcaaaggtcttctacctcaagatgaagggtgactatcacaggtatcttgcggaatttaagactggtgctgagaggaaggaatctgctgagagcacaatggtggcctataaggctgctcaggacattgctctggctgagctggcacctacccatccgataaggctgggacttgctcttaatttttcagtgttctattatgagattctgaactccccagacaaagcttgcaacctggcaaagcaggcgtttgatgaagctatctctgagttagacagccttggtgaggagtcatacaaggatagcactctgatcatgcaactcctgagggataacttgaccctttggacatccgacctcacggaggatggtgctgatgagggcaaagatgccccgaaaggcgatgcaggcgagggacagtaatctttggagggggtgcaaagttgttcgagccccaatgttttagatgctctatgctgtcgaagctgtgctgtgccattattgtagctgatttcgtctccattcacttctttttccttgttagtaggctggtagtggtcgaattagtaccccattgctttgtgttgccgctagtccatgtggactggtattgttcccctggatttatttggcaagcgtgtccgtgctcgctctagcgttttattgagcttttaaagtcatcgcattctttttcgattgcaaaaaaaaaaaaaaaaaa

SEQ ID NO: 7945 - protein, 256 aa, Zea mays
  misc_feature: Ceres CLONE 362702
  misc_feature (3)..(240): Pfam Name: 14-3-3 Pfam Description: 14-3-3 protein
  misc_feature: The sequence is a functional homolog of SEQ ID NO 404 in the 10/374,780 US patent application
  misc_feature: The sequence is a functional homolog of SEQ ID NO 68 in the 11/375,241 US patent application
  misc_feature: The sequence is a functional homolog of SEQ ID NO 864 in the 10/225,066 US patent application
MSREENVYMAKLAEQAERYEEMVEYMEKVAKTVDVEELTVEERNLLSVAYKNVIGARRASWRIVSSIEQKEESRKNEEHVNLIKEYRGKIEAELSNICDGILKLLDSHLVPSSTAAESKVFYLKMKGDYHRYLAEFKTGAERKESAESTMVAYKAAQDIALAELAPTHPIRLGLALNFSVFYYEILNSPDKACNLAKQAFDEAISELDSLGEESYKDSTLIMQLLRDNLTLWTSDLTEDGADEGKDAPKGDAGEGQ

SEQ ID NO: 7946 - DNA, 424 bp, Zea mays
  misc_feature: Ceres CLONE 362798-F
  misc_feature: Encodes the peptide sequence at SEQ ID NO. 7947
gtagctgtcccccgcgcggctcgtcccctggctcctcggcgccgctgccggccagcgcctgcgcctgcgcctgcggctcgcgccctctatacctccgcccgcccccctcgtgccgctctgcctgcccccgcattccgcgccgcctcgccaccgaactgggaggaatccgaggggaagggggatatggggtcgccgggtgcggggagcagcggcggccacgagtgctccttcaagttcctcctcatcggggactcgggcgtcggcaagagcagcctcctcgtcagcttcgtcgccgcctcccacctcgacggcgacatcgcccccaccatcggtgtggattttaaaatcaagttccttacagttggtggaaagaaactaaagttgacaatatgggatactgctggccaggagaggtttaggacaa

SEQ ID NO: 7947 - protein, 80 aa, Zea mays
  misc_feature: Ceres CLONE 362798-F
  misc_feature (17)..(80): Pfam Name: Ras Pfam Description: Ras family
MGSPGAGSSGGHECSFKFLLIGDSGVGKSSLLVSFVAASHLDGDIAPTIGVDFKIKFLTVGGKKLKLTIWDTAGQERFRT

SEQ ID NO: 7948 - DNA, 300 bp, Zea mays
  misc_feature: Ceres CLONE 362809-F
  misc_feature: Encodes the peptide sequence at SEQ ID NO. 7949
attttcctccgcctgcagtctagctgcagctaataaccccggccgccggatgttctccttctcgcatgcttttttttttgggggtaacataatctcgctgatggtgttcctttcgccgctgccgacgttctaccgcgtgtaccgcaagaagtcgacggaggggttccagtcgaccccgtacgtggtgacsctgttcagctgcatgctgtggatcttctacgcgctgctcaagtccggcgccgarctgctggtgaccatcaacggcgtcgggtgcgtgatcgaggcggcgtacctgggcga

SEQ ID NO: 7949 - protein, 83 aa, Zea mays
  misc_feature: Ceres CLONE 362809-F
  misc_feature (8)..(83): Pfam Name: MtN3_slv Pfam Description: MtN3/saliva family
MFSFSHAFFFGGNIISLMVFLSPLPTFYRVYRKKSTEGFQSTPYVVTLFSCMLWIFYALLKSGAELLVTINGVGCVIEAAYLG

SEQ ID NO: 7950 - DNA, 457 bp, Zea mays
  misc_feature: Ceres CLONE 362811-F
  misc_feature: Encodes the peptide sequence at SEQ ID NO. 7951
caccgcagccctagcgcgccgccaccttcaccttcccaggccgccgccgccgccgcctccattgctgctaaacccgcaaccatgggtcccgtgctgaagcgcccgaccccgggcacggtgcagtgcttcgggcgcaagaagacggccgtggccgtggcctacacgaagccaggccgggggatgatcaaggtgaacggcgtcccgatcgagctgctccgtcccgagatgctgcggctcaaggccatggagcccgtgctgctggcggggcggtccaggttcaaggacatcgacatgcggatccgcgtgcgcggcggcgggaagacgtcgcagatctacgccatccgccaggccgtcgccaagggtctcgtggcctactaccagaagtacgtggacgaggcggcgaaaaaggagatcaaggacatcttcatgcgctacgagcgcaccctcctcgtcgccg

SEQ ID NO: 7951 - protein, 125 aa, Zea mays
  misc_feature: Ceres CLONE 362811-F
  misc_feature (17)..(125): Pfam Name: Ribosomal_S9 Pfam Description: Ribosomal protein S9/S16
MGPVLKRPTPGTVQCFGRKKTAVAVAYTKPGRGMIKVNGVPIELLRPEMLRLKAMEPVLLAGRSRFKDIDMRIRVRGGGKTSQIYAIRQAVAKGLVAYYQKYVDEAAKKEIKDIFMRYERTLLVA

SEQ ID NO: 7952 - DNA, 437 bp, Zea mays
  misc_feature: Ceres CLONE 362812-F
  misc_feature: Encodes the peptide sequence at SEQ ID NO. 7953
aactctgttccaaacgaccccatctctctccccaaaacggggaggctcccctccccaagctcagaccttcgatccgttgctcctccacggcgccagccgccagcgcctccgttcctcaacgcctgtttgtccttgcatggccggagccagacgtcgcaccttgcctccaccctcgcattccgatcacccacttccagctcctctccgtctcgctgctcctccactagcagagctgagctgatcgatggaccacgagcagcggcgccagcggcagcagcacagtcccagaggcaatgctcctgggagcgggaggtgcggctcctcgtcgaggaagcacaagggcgggggcaagaaacccatcaaagtggtgtacatctccaaccccgtgcgcgtcaagactagcgctgctggtttccgcgccctcgtccaggagctca

SEQ ID NO: 7953 - protein, 64 aa, Zea mays
  misc_feature: Ceres CLONE 362812-F
MDHEQRRQRQQHSPRGNAPGSGRCGSSSRKHKGGGKKPIKVVYISNPVRVKTSAAGFRALVQEL

SEQ ID NO: 7954 - DNA, 663 bp, Zea mays
  misc_feature: Ceres CLONE 362852-R
  misc_feature: Pfam Name: DUF584 Pfam Description: Protein of unknown function, DUF584
ccgattgggtaccgggccccccctcgaggtcgacggtatcgatattttttttttttttttttgaacatgaactagtatttacttaattattatgcattgcaatagtacacagaaatacagattgcgtggtaactcatacgatcgaaatttagcagtactacttcccccaaaaagaagccaccccgtactagcaagaaatttagcagctaactcatacgatcgagcattcgcgcatcttattggcagtagatagctagctaccttgatcgatcgagcaaggaacatgcactaattccttgctttagtgagctgtgtagtacgtagatcgatgcatgcttgaccttgaccaccacctagcttaagcttaatagttaatactagtaataagctaccgcgcgctcagagaaggcggagcacggcgtctctgaccttggtcagctcccgccccttgctcctccccgcctgatccggcggcgacgccgacgccacgccgcccatccgctccatcttcctcgccagccactcatgcggaggcagcatctcccccgcatcgtcctcctcgtcacctctgccgccgcctcgcctcgccgagctcgagctgccagccggaatggccaccggcgccgacgaccttcctcctccgcccttgttgttgccgcccct

SEQ ID NO: 7955 - DNA, 806 bp, Zea mays
  misc_feature: Ceres CLONE 362868-R
  misc_feature: Translation starting site: 351
  misc_feature: SWISSPROT Homolog: EC 2.5.1.18 Glutathione transferase
  misc_feature (10)..(10): n is a, c, t, g, unknown, or other
  misc_feature (11)..(11): n is a, c, t, g, unknown, or other
aaaaaaaaannccaattgggtaccgggccccccctcgaggtcgacggtatcgatattttttttttttttttttgctgaggaacctaaggcaaagtttattttaaagaagagcacaggaatgctcatttccgaacaattcaaggtctcgttacaagcaagcatgctcacacataggcactcaactttcgtcatagaaagacacatcactgaacaagcaaacaacccagaacagacttggcttattccattcaccgattgacagggcaaccgtttcaagcagacggcttcatcaaggcagcgaccttctggacagacggcctctccatcagaccagaccaccaggccttcacatgcgggtaggcgtcgagcacagatgcgtagggcgtagcgaacaggcagagagtgacagacacatggttcaggtcggcgaggctgaggaagtctccagcaaggtacttgcacttggtcaggcgtgcctcgtacacctctagcaccttcttcagcttctcaaggttctcatccacaacttttctggtcggtggatcccccaagcatcggactgatgaggacctggaagagaatggggttcagtgcagcggtgtactggttagcctccacctcgatccaaacatccaccattgctgcctcctcgaggtttccttccctcaacagctctgggctgttttttgcgagcagcgtacttgcagattgctcgtgattccaaaaagtacaagtcacccatccctgcaaagctggaaacctgaccaaaacgggttggcggaaccaagtggttccggggctcttgt

SEQ ID NO: 7956 - DNA, 436 bp, Zea mays
  misc_feature: Ceres CLONE 362906-F
  misc_feature: Encodes the peptide sequence at SEQ ID NO. 7957
agtctaaggtgcgaaccttcgcgttcccaacctacccctgcaagccattgccctcgcctatcgcctcgtgcaagtccaagctcccacgactccaccgcgaccgggagagagtcagagagagacgcccgcctccagatcgtccggcggggatggcggcgtcggtctttccagcgctgctgctggccgtagcggcggtgcttctcctaccggtggcagaggccgtgtggctcgagctcccgccgtcggggaccaagtgcgtctccgaggagawccagcccaacgtcgtagtgctcgccgactacgctatcatgtacgagtcccaccccagctcgcatcccaccgtcgccgtcaaggttacatcaccctatggcaatactgtgcatcataatgaaaatgctacaacgggccagtttgcattcaccacttcagaagctgg

SEQ ID NO: 7957 - protein, 95 aa, Zea mays
  misc_feature: Ceres CLONE 362906-F
  misc_feature (41)..(41): Xaa is any aa, unknown, or other
MAASVFPALLLAVAAVLLLPVAEAVWLELPPSGTKCVSEEXQPNVVVLADYAIMYESHPSSHPTVAVKVTSPYGNTVHHNENATTGQFAFTTSEA

SEQ ID NO: 7958 - DNA, 425 bp, Zea mays
  misc_feature: Ceres CLONE 362937-F
  misc_feature: Encodes the peptide sequence at SEQ ID NO. 7959
gtacacataacacatctggtaagcgagcaccgagcagcaggtggtctcaacggtcgacgcgacaactttccttgtccatgcagcagatcactcgtcgtacgttccctatgctggctcctcctcggctccccctcgtcggggcgctcctgctgctcctcgccgtcgcgctcggcgcggtgccgtgcgagagcgccgcgctccgcctccgcggctccgtcgcctgcctcgactgcgacgaggaacacgatctctccggtgtggtcgtggcggtgaaatgcgccggcgacggcgacggcggcgcgggcctccacgcggcgcagaccgacgatcgcggcaacttcgacgtgaccgtgccagcagaagcgtcagcctcgggcgcgccgtgcgcggccagggtcctcggcgccacggagcagctctgcgcg

SEQ ID NO: 7959 - protein, 116 aa, Zea mays
  misc_feature: Ceres CLONE 362937-F
MQQITRRTFPMLAPPRLPLVGALLLLLAVALGAVPCESAALRLRGSVACLDCDEEHDLSGVVVAVKCAGDGDGGAGLHAAQTDDRGNFDVTVPAEASASGAPCAARVLGATEQLCA

SEQ ID NO: 7960 - DNA, 473 bp, Zea mays
  misc_feature: Ceres CLONE 362942-F
  misc_feature: Translation starting site: 68
atcacaaactcactacacgatcggctatagcgagctaacagcagctctgtcaagtactacacaggccatggccggagccctcgtcttcgtcgctgttctcctcgccgcaagcgtcggcaccacgacggctaccacgctgaccatccacaacctctgcccccacccggtgtggccgctggtgaccccgagctcgggcttcccctccatctccaccaacaccgcgcggctgggccccaacgcgctgctctccctctccttcccgcccaccttctgggccggccgcgtcgccgcgcgcacgggctgcgacgccgccgcgtccggctgctggacggggaccacgccgcccgccaccgtcgtcaggtcaccgtccacgacggcgggaacctggaccaggccacctacagcgtgtctctcgtcgacggcttcaacgtgcccatggtggtcagcccgcaggcgtcggcggcgggcagtgc

SEQ ID NO: 7961 - DNA, 462 bp, Zea mays
  misc_feature: Ceres CLONE 363019-F
  misc_feature: Encodes the peptide sequence at SEQ ID NO. 7962
gagagtgagaaacgcgaggtcacgagatatggcggacggcaagcgaggggaggattcggccgtggcgttgaagacctcgccgtcgtcggcggtgatggctgggggtttacgcggcgttagcaaccctctggaggagtggagcgggcgcgtgaaggcgattgaggccgggttccgcgcgtggatggcgaagcaacccatccaaatcgaggccgcggtgaccacggccgtgggggcggtgcagggcggggctctgggtgggctcatgggctcgctcacagctgacggcgggtcgccgttccccatcccgcagccgccgcccaacgccaacccagaggccatggcgtcgttcaagcaggcccaggctttagctggtggacccttggtgcaagcccggaactttgcagtcatgaccggcgcaaacgcaggcatatcttgtgtcatgagaaggatacgagggaaaga

SEQ ID NO: 7962 - protein, 144 aa, Zea mays
  misc_feature: Ceres CLONE 363019-F
MADGKRGEDSAVALKTSPSSAVMAGGLRGVSNPLEEWSGRVKAIEAGFRAWMAKQPIQIEAAVTTAVGAVQGGALGGLMGSLTADGGSPFPIPQPPPNANPEAMASFKQAQALAGGPLVQARNFAVMTGANAGISCVMRRIRGK

SEQ ID NO: 7963 - DNA, 472 bp, Zea mays
  misc_feature: Ceres CLONE 363030-F
  misc_feature: Encodes the peptide sequence at SEQ ID NO. 7964
atcgaacaccaatggcattcttgcattgaaggaaccttccctccacctccaccgcccgagagcgagcggccggacggggttttggttgggcatggctgccccggcratgctccaagtggtgatcctcgccgcggtcctccttctcccgttcctcagcgtgccgggcgccgaggcacagaccaagaagttctgcctcacgcagttcgccatcgctagccaggcctgcgccatcctgccacccaccagtcctgagcaccaccaccatcatcacgatgacgaggacaatgacgaggacaacgacgaagatgaggacgaagacgaggacaacgatgaagatgaagacgaggacaatgggaaggttaaggccggtggcgcctacacaatgaacactgctagtgcggtcactgtgagaagcacaatccggcgcctgcgggagcagaccgaagcatgatgcgggcagcttgaaaaggag

SEQ ID NO: 7964 - protein, 119 aa, Zea mays; identical to SEQ ID NO: 7336
  misc_feature: Ceres CLONE 363030-F

SEQ ID NO: 7965 - DNA, 513 bp, Zea mays
  misc_feature: Ceres CLONE 363073-F
  misc_feature: Encodes the peptide sequence at SEQ ID NO. 7966
tcgcacaaatcctcttcctcgagttctcctcaaccaaattcaaagtcacagcggcgaaactctcggcgatgtctggccgcggcaagggcgggaagggtctgggcaagggcggcgccaagcgccaccgcaaggtgctgcgtgacaacatccagggcatcaccaagcctcagttcgcatccacgcgcgccgccgccgcctcgcagctcgacgctcaccgcgcagccatggcggaacagactgagaaggctttcctcaagcagccaaaggttttcctcagctcaaagaaatccggcaaaggtaagaagcctggcaagggcggcaaccgattctggaagagcattggccttggcttcaagactcccagggaagcaattgaagggacctacattgacaagaaatgcccattcactggaactgtttctatcagaggcagaattattgctgggacatgccacagtgctaagatgaacagaactatcattgttcgcaggaactacctccaactttgtaaag

SEQ ID NO: 7966 - protein, 96 aa, Zea mays
  misc_feature: Ceres CLONE 363073-F
MAEQTEKAFLKQPKVFLSSKKSGKGKKPGKGGNRFWKSIGLGFKTPREAIEGTYIDKKCPFTGTVSIRGRIIAGTCHSAKMNRTIIVRRNYLQLCK

SEQ ID NO: 7967 - DNA, 833 bp, Zea mays
  misc_feature: Ceres CLONE 363085-R
  misc_feature (833)..(833): n is a, c, t, g, unknown, or other
tcgaggtcgacggtatcgataagcttttttttttttttttttaaagaatcgtcaagttctattaattatttcacaacgcacaaaacatagtctaacagaattggtagctcaagcaaatgagcatcctgcgttcaaataatcgcataaactttctatctcaaaagttgtgacacaataaggtatagacaaatcaaaatcaaacttaggccacaggattttgaaaggccagagtgtatgctaaacaatgtctctccatctttccagaatttattccagatttaattgaaggatgcaatcaatggtgatcatcatcaccatgtccatcgggtggtcaaccaggtcctaccacttcaagaacaaaatactgtgcgcacactggaatttccccccccttgtctttctcaagccaaaaccagacaacatcatgctcatcctcaccttcacctcccggggcatccgaatatcctttttatcatagaaagattttgacaaccaccaggtggcttccttttgggcccaaatggacccttcggggatgggtctaattttaaagaaaatttccttccccctcgagcttcaagcctgaaaactccctcccgcctctgtggccccattaaccgattttggcatttatgtccccccacaccttctttttttgaaccccaaaaaccatcccccccgaattggggttgtaaaaaattaaaagagccggaacaaaaaaaaaaaaaccggccaaatccttcggcggaaagccggaaaccaacataacctgggaaaaatggcccgttgggcagccgcgccggcaagcccaaaaaaaaaaacttataggtttn

SEQ ID NO: 7968 - DNA, 461 bp, Zea mays
  misc_feature: Ceres CLONE 363160-F
  misc_feature: Encodes the peptide sequence at SEQ ID NO. 7969
atatagctctccccctcctggttagcgtagtgagtgcagcgacgagtgcaacggtgagagataccgagatggctgagggaaggggcagtgcaagggccatcggcgccatggcgttcgccgttgcctgctgctgctgctgctgcgtcgccatcgccgacgcagccaccacctactacgtcggggacagcaacggctggtccttcagcagccccagctggcccaacggcaagcacttccacgccggagacactctcgtgttcaggtacatcccctggatccacaacgtggtggccgtggacgaggacgggtacaacggctgcacgacgccgccggggtcgcggacctacacgtccggcgccgacagcgtcactctcgccaggggggacaacttcttcatctgcacccggttcggccactgcaacctcggcatgaagctccgtcgtctatgccgcgtgatctgt

SEQ ID NO: 7969 - protein, 131 aa, Zea mays
  misc_feature: Ceres CLONE 363160-F
  misc_feature (43)..(121): Pfam Name: Cu_bind_like Pfam Description: Plastocyanin-like domain
MAEGRGSARAIGAMAFAVACCCCCCVAIADAATTYYVGDSNGWSFSSPSWPNGKHFHAGDTLVFRYIPWIHNVVAVDEDGYNGCTTPPGSRTYTSGADSVTLARGDNFFICTRFGHCNLGMKLRRLCRVIC

SEQ ID NO: 7970 - DNA, 468 bp, Zea mays
  misc_feature: Ceres CLONE 363173-F
  misc_feature: Encodes the peptide sequence at SEQ ID NO. 7971
agagcagagctgcctccagacgagacgaggaggacgcggcgccgttcgggcttggcagcaaccagcgtctagcgcagtgcccttctgtctcctatctccccggagtccccgctgcccagcccggtctcactttccagtctccgagactccgagtctcgctcgcaccccgtcccctgcagcctgtgctctgggttggagggaggtgagctgcgagggagcgcggagggggcgaggagatggaggcagattcggcaaggaagagacttgcattgctggccctgcttctcctggcggcgcccgtccgcccggcctcggcggctccggtggaggatggcctgctcagcaatggtgactttgagacagcaccaagtggtggttttgtaaaatctgcttctgttgctgagggtgcatcgtcaatccctggttggacgatcaacggcacggttgaactcatttcagcaggccaac

SEQ ID NO: 7971 - protein, 77 aa, Zea mays
  misc_feature: Ceres CLONE 363173-F
MEADSARKRLALLALLLLAAPVRPASAAPVEDGLLSNGDFETAPSGGFVKSASVAEGASSIPGWTINGTVELISAGQ

SEQ ID NO: 7972 - DNA, 1169 bp, Zea mays
  misc_feature: Ceres CLONE 363180
  misc_feature: Encodes the peptide sequence at SEQ ID NO. 7973
cacctcttcttcttctaccagtagttcattcattattagtacggtaccgggttggagtaattaaaaggccaccctccactcgcaccaccacactttagctcctcccactgctataggcagcccacatgcgcgcgcactcccaagtcccaagtcctaagctagccagctgagctcgctcccagtccaagcgccggcgccaccaccgcagctgctcgctggtcaccatgagcaaggagaagcaccaccgcgactggatcctccggcgctgctgtggctccctcgccgcctgcatcctgacgctggccgccgtcgtcggcttcatcgtgctcgtcatcttcctggcgctgcgcccctccaagccgtccttctacctgcaggacgtgcagctgcgctccatcgacctcagcgacccggcgctctccctcgacctccaggtgacgatcgcgtcgcggaacccgaacgagcgggtgggcgtgtactacaagacgctggacgcgttcaccacgtaccgcgacgaggcggtgacggtccccgtgtcgatgccggcgatctaccagggccacaaggacgtgtcggtgtggtcgccggtcatgtcgggcgacgcggtccccgtggcgcagtacgtggcggacgccatgaagcaggacatcgaggcgggatacgtgctgctccacgtcagggtggacggccgcgtcaagtggaaggtcggcagctgggtctcgggcagctaccacctcttcgtcaactgccccgcgctgctcgccaccagcggcagcgctgccgtcgccgccggcggcggcgtcttcgccgccagcgccgcgtccggggtcgtccccgccggcgtcaacaccaccgtctccctcaagttcacgcacccggcggactgcccgtcgacgtgtgagtcgtcgctgcgctacgacgacgaccggcgcgcgcttcgttcgtttgttttcgttcgtactggctagtgcagtgcgggggatcaacgtcgccccctcgctcgcgcggttctcgagcagttccttttccccgccagcaaatgttacttcccatatattctcgcttccgaagccggccccccccaagttagatcagctataccatacatacacatgtgtactagatttgctatatattattaccatattaacaaaaaaaaaaaaaaaaaa

SEQ ID NO: 7973 - protein, 247 aa, Zea mays
  misc_feature: Ceres CLONE 363180
  misc_feature (38)..(175): Pfam Name: Hin1 Pfam Description: Harpin-induced protein 1 (Hin1)
MSKEKHHRDWILRRCCGSLAACILTLAAVVGFIVLVIFLALRPSKPSFYLQDVQLRSIDLSDPALSLDLQVTIASRNPNERVGVYYKTLDAFTTYRDEAVTVPVSMPAIYQGHKDVSVWSPVMSGDAVPVAQYVADAMKQDIEAGYVLLHVRVDGRVKWKVGSWVSGSYHLFVNCPALLATSGSAAVAAGGGVFAASAASGVVPAGVNTTVSLKFTHPADCPSTCESSLRYDDDRRALRSFVFVRTG

SEQ ID NO: 7974 - DNA, 384 bp, Zea mays
  misc_feature: Ceres CLONE 363185-F
  misc_feature: Encodes the peptide sequence at SEQ ID NO. 7975
  misc_feature (78)..(78): n is a, c, t, g, unknown, or other
aattcacgcacctagggttttcgcgccgccgccgccgccgccgccgcagccgcaacaatgccgtcgcacaagacctyncggatcaagaagaagctggcgaagaagatgcgccagaaccgccccatcccctactggatccgcatgcgcactgacaataccatcaggtacaacgccaagcgcaggcactggcgccgcaccaagctcggcttctgagcgtcgggattggccggctgctgcgtcggaaggctagggtctaagagctatcttccttctgttttatcaatgtgtcagtgtccgttctacctttggattaggtgttggtacccctgttgttccctttggttgctcccgctatgaaacgagacgagagaagaatgagcaagg

SEQ ID NO: 7975 - protein, 51 aa, Zea mays
  misc_feature: Ceres CLONE 363185-F
  misc_feature (9)..(51): Pfam Name: Ribosomal_L39 Pfam Description: Ribosomal L39 protein
  misc_feature (7)..(7): Xaa is any aa, unknown, or other
MPSHKTXRIKKKLAKKMRQNRPIPYWIRMRTDNTIRYNAKRRHWRRTKLGF

SEQ ID NO: 7976 - DNA, 479 bp, Zea mays
  misc_feature: Ceres CLONE 363232-F
  misc_feature: Encodes the peptide sequence at SEQ ID NO. 7977
aacaccgagaatcacaatacgaaacgaattaatccccaatcaacacagcaagtcagcaacaagcaaagcagcgatccgagagatggacgcgaggatgttcgggctggagaaccccctggtggcggcgctgcatcacctgctggacgtgcccgatggcgacgccggagcgggcggcgacaaggcgggcggcggcgccacgcgcacctacgtccgcgacgcgcgcgccatggcggccaccccggccgacgtcaaggagctcgcgggagcgtacgcgttcgtggtggacatgccggggctgagcacgggcgacatcagggtgcaggtggaggacgagcgggttcttgtgatcagcggcgagcggcgccgggaggagcgcgaggacgccaagtacctgcgcatggagcggcggatgggcaagttcatgcgcaagttcgtgctgccggacaacgccgacgtggacaaggtcgccgccgtgtgca

SEQ ID NO: 7977 - protein, 132 aa, Zea mays
  misc_feature: Ceres CLONE 363232-F
  misc_feature (55)..(132): Pfam Name: HSP20 Pfam Description: Hsp20/alpha crystallin family
MDARMFGLENPLVAALHHLLDVPDGDAGAGGDKAGGGATRTYVRDARAMAATPADVKELAGAYAFVVDMPGLSTGDIRVQVEDERVLVISGERRREEREDAKYLRMERRMGKFMRKFVLPDNADVDKVAAVC

SEQ ID NO: 7978 - DNA, 478 bp, Zea mays
  misc_feature: Ceres CLONE 363263-F
  misc_feature: Encodes the peptide sequence at SEQ ID NO. 7979
aagaaaagcctccattcccgagtctccagccaaccgcatccagtccaccccatccccctcgaccccgacaaccccgagtcccgacccgatggcgcccaaggccgagaagaagccagcggagaagaagccggcggccgaggagaaggcggagaagacgaccgcaggtaagaagcccaagtccgagaagcgcctgcccgcctcgaagtcctccggcaaggagggcggcgagaagaaggggaagaagaaggccaagaagagcgtggagacctacaaaatctacatcttcaaggtcctgaagcaggtgcaccccgacatcggcatctcctccaaggccatgtccatcatgaactccttcatcaacgacatcttcgagaagctcgccggccgcaacatcaccgttaacgaggcccagtcccgcggcggccgcggaggcggcggtggcggatacggtggcsggcgccgtgatggasgcggctac

SEQ ID NO: 7979 - protein, 130 aa, Zea mays
  misc_feature: Ceres CLONE 363263-F
  misc_feature (55)..(113): Pfam Name: Histone Pfam Description: Core histone H2A/H2B/H3/H4
  misc_feature (123)..(123): Xaa is any aa, unknown, or other
  misc_feature (128)..(128): Xaa is any aa, unknown, or other
MAPKAEKKPAEKKPAAEEKAEKTTAGKKPKSEKRLPASKSSGKEGGEKKGKKKAKKSVETYKIYIFKVLKQVHPDIGISSKAMSIMNSFINDIFEKLAGRNITVNEAQSRGGRGGGGGGYGGXRRDGXGY

SEQ ID NO: 7980 - DNA, 445 bp, Zea mays
  misc_feature: Ceres CLONE 363328-F
  misc_feature: Encodes the peptide sequence at SEQ ID NO. 7981
acttcgcgggcacgcagagagccgcaagacgcacctcgctcgcaacttgttggactcgaaggggcaataggcagcaggcagggccccgaactgcgggaggagattcccaaggatcccgtcggcctggtagaggaagggacggggactggcgatggcggtggacggcggcggcggggtggactgggagagcctggcggaggccacctccggggcaatcggctcgctcgtcagcaccaccgtgctctacccgctcgacacctgcaagaccaagttccaggccgagctccagacgcaccagggcgcgcagaagtataggaacctttcagatgtcttttgggaagcgattcgtaaaaagcaatttttgtccctatatcagggcctgaacacgaagaacattcagtcttttgtctcctcgtttttttayttttatgggtatagctatttt

SEQ ID NO: 7981 - protein, 98 aa, Zea mays
  misc_feature: Ceres CLONE 363328-F
  misc_feature (12)..(98): Pfam Name: Mito_carr Pfam Description: Mitochondrial carrier protein
MAVDGGGGVDWESLAEATSGAIGSLVSTTVLYPLDTCKTKFQAELQTHQGAQKYRNLSDVFWEAIRKKQFLSLYQGLNTKNIQSFVSSFFYFYGYSYF

SEQ ID NO: 7982 - DNA, 332 bp, Zea mays
  misc_feature: Ceres CLONE 363331-F
  misc_feature: Encodes the peptide sequence at SEQ ID NO. 7983
aaaaacctcacaagcaccagaccaattaactagcttcttctagctctagctaggctcgtctgctgcaagaaggtaacagtaacagcaggcatggaggggaaggaggaggacgtccgcctgggcgccaacaagttctcggagcgccagcccatcggcacggcggcgcagggcacggacgacaaggactacaaggagcccccgccggcgccgctcttcgagcccggggagctcaagtcctggtccttctaccgcgccggcatcgccgagttcgtcgccaccttcctcttcctctacatctccatcctcaccgtcatgggcgtctccaaagtcca

SEQ ID NO: 7983 - protein, 80 aa, Zea mays
  misc_feature: Ceres CLONE 363331-F
MEGKEEDVRLGANKFSERQPIGTAAQGTDDKDYKEPPPAPLFEPGELKSWSFYRAGIAEFVATFLFLYISILTVMGVSKV

SEQ ID NO: 7984 - DNA, 408 bp, Zea mays
  misc_feature: Ceres CLONE 363379-F
  misc_feature: Translation starting site: 67
  misc_feature: Pfam Name: E1_dh Pfam Description: Dehydrogenase E1 component
  misc_feature: SWISSPROT Homolog: EC 1.2.4.1 Pyruvate dehydrogenase (acetyl-transferring)
acccacacagcaagccagcagagcagaaagcagccgcagccccagcccccacaagacgaggcaacaatggcgctagaagcagccaccgccccccgcgcactcctcgccgcgtgcctcgtcctgctggtcctcggcggcggcaccggcccgtcgtcggtgctgcgcggcgccggggcgcaggccggcgggcagtgcctgccgcagctgaaccgcctcctggcgtgccgcgcgtacctggtgcatgttgatggtatggatgtcctgaaggtcagggaggttctaaggaggcaattgagagggcaaggagaggtgaagggccaaccctagtcgagtgtgaaacatacaggttccggggtcactcccttgcagacccagatgagctcaggaagcctgatgagaaaacacact

SEQ ID NO: 7985 - DNA, 430 bp, Zea mays
  misc_feature: Ceres CLONE 363395-F
  misc_feature: Encodes the peptide sequence at SEQ ID NO. 7986
aacatcgcaagaaaaaggaaatcaaaacaaagtaaagtggggggaaaagcatggcgatagctcttctcccatccgttcgtcttcttccacaaagtctctccagaaggccaccaccaacctcgtcgccattatccgttcgccgcccacggccaagagcccttcccctccctcgcgtccactgccgcgccggccggaccccggaccccctcaccgctgctagggaggctgctgccttttgggctgggaagctcgccggcgctgtgccatggaaggccgcggtctccggcgtggtcgccctcgccgtctccttcacctgccttgttggtttggccaatgccagaactggggtaaacaaaccagaattgcttcctaaagaatttactaccgtcatcgatgttgctggttttctctcgtcaggccaggaaaaccg

SEQ ID NO: 7986 - protein, 126 aa, Zea mays
  misc_feature: Ceres CLONE 363395-F
MAIALLPSVRLLPQSLSRRPPPTSSPLSVRRPRPRALPLPRVHCRAGRTPDPLTAAREAAAFWAGKLAGAVPWKAAVSGVVALAVSFTCLVGLANARTGVNKPELLPKEFTTVIDVAGFLSSGQEN

SEQ ID NO: 7987 - DNA, 406 bp, Zea mays
  misc_feature: Ceres CLONE 363453-F
  misc_feature: Encodes the peptide sequence at SEQ ID NO. 7988
gactagtcactagccgaccgcgcgggaagcggtccggttcacgacttcacgccgctggctcccctcgccatggccggggaccgcggccgcggggccgcggagagggtggatgctgccgtgggggcggtgggatccggtggctgggagttccggaacgcgtacaggcgccagctgctggctctgtcgcggcggatccggctcctcggccccttcgccgaggagctgcgggaggcacgccgggggtccgcggagcaggaggagcaggagcgggcgctggcgcctctcgccgacgcgctggaggaggcactcgacctgctccagctcggccgcgacggcagcaggatattcctggtccttgatagggatgaagtaatgaagaagttccatgaatcaattgctcagctgg

SEQ ID NO: 7988 - protein, 112 aa, Zea mays
  misc_feature: Ceres CLONE 363453-F
MAGDRGRGAAERVDAAVGAVGSGGWEFRNAYRRQLLALSRRIRLLGPFAEELREARRGSAEQEEQERALAPLADALEEALDLLQLGRDGSRIFLVLDRDEVMKKFHESIAQL

SEQ ID NO: 7989 - DNA, 365 bp, Zea mays
  misc_feature: Ceres CLONE 363462-F
agggtgggcgaccagtctcctccgcacgcttcccaccgagctcacacactgcacactcccacactcccactcggccactcccacctgtaggttcacgggaggcgaggaccttgcccccctgcattcttcccgtatcgcggaccgatcctcgccgcgggaggcgagcggagcggggcgtttctgcgggggagaagcgcgtccctgcaatttctgagagaggggaggcggcgagtggaaaagagcagacgttgctatcctatcttgctgacacagcggcggtgtggcgaggcgcatggcgagggcgcgcggtggcgccgcgtggtgggtgctggcagcggcgtgggtgctgtgggcggcggcggctg

SEQ ID NO: 7990 - DNA, 483 bp, Zea mays
  misc_feature: Ceres CLONE 363464-F
  misc_feature: Encodes the peptide sequence at SEQ ID NO. 7991
agggtgggcgaccagtctcctccgcacgcttcccaccgagctcacacactgcacactcccacactcccactcggccactcccacctgtaggttcacgggaggcgaggaccttgcccccctgcattcttcccgtatcgcggaccgatcctcgccgcgggaggcgagcggagcggggcgtttctgcgggggagaagcgcgtccctgcaatttctgagagaggggaggcggcgagtggaaaagagcagacgttgctatcctatcttgctgacacagcggcggtgtggcgaggcgcatggcgagggcgcgcggtggcgccgcgtggtgggtgctggcagcggcgtgggtgctgtgggcggcggcggctgcggcggaggcagaggccaggtcgccgtcggcgaggagggtgcaccggcacctcaagcgcctcaacaagccggcgtcaagagcatcgagagtccagatggagacatcatcgactgcgtg

SEQ ID NO: 7991 - protein, 63 aa, Zea mays
  misc_feature: Ceres CLONE 363464-F
MARARGGAAWWVLAAAWVLWAAAAAAEAEARSPSARRVHRHLKRLNKPASRASRVQMETSSTA

SEQ ID NO: 7992 - DNA, 436 bp, Zea mays
  misc_feature: Ceres CLONE 363480-F
  misc_feature: Encodes the peptide sequence at SEQ ID NO. 7993
acaaccgagcgaacaggagggagattaccgccatggcgaggagcctgcgtcccgtggtggacctccgcgtcaccaagaatcccgagccggccgaagaccctgcgccatcgcctatcgtctggccgaacgctttggcgccctcgtcctcctcgacacctcctccgtcgcgtccagccatccatcgatccgctgaccgccgggccaccgccgccatggggtttcatcgcgccgctataacacgtcaagagcaggtaccacaggatgaggcgcgtggaggatgctgtgatgagttcgtgagtggtctaggccgtcgtctcccagtcaactttgggttgctggaccgttgtctccttataatgtaattatttattttgtatagaactcctattatatagtaaagatgtgacattcgatcctgtgccatgattcataaaaa

SEQ ID NO: 7993 - protein, 109 aa, Zea mays
  misc_feature: Ceres CLONE 363480-F
MARSLRPVVDLRVTKNPEPAEDPAPSPIVWPNALAPSSSSTPPPSRPAIHRSADRRATAAMGFHRAAITRQEQVPQDEARGGCCDEFVSGLGRRLPVNFGLLDRCLLIM

SEQ ID NO: 7994 - DNA, 416 bp, Zea mays
  misc_feature: Ceres CLONE 363512-F
  misc_feature: Encodes the peptide sequence at SEQ ID NO. 7995
ctaccgcaggccgcagcccagcaccggccgctctacgccggcacgtcctcgtttctgtccgaggtcatcgcctccgcaacttcgtggccggtgaggtcgcaccaccatggcgtcgctcctagcccggcaggcagcgcaggcgctccgcgcgaggcaaacggcgcagctcgggccggccgcgtcggcgatgcaagggcacctccgtacctacatgaacgcggggattcccaagcggttcaaagaggatgaggagaaagaacagcttgcaaaagatctcgcaaaagattggaatgctgtgtttgaaaggagcatcaatacattgtttttgactgaaatggtccgtggcttgatgctaactctcaagtacttctttgatagaaatgtcacaattaactatccgtttgagaagggtcctc

SEQ ID NO: 7995 - protein, 103 aa, Zea mays
  misc_feature: Ceres CLONE 363512-F
  misc_feature: SWISSPROT Homolog: EC 1.6.5.3 NADH dehydrogenase (ubiquinone)
MASLLARQAAQALRARQTAQLGPAASAMQGHLRTYMNAGIPKRFKEDEEKEQLAKDLAKDWNAVFERSINTLFLTEMVRGLMLTLKYFFDRNVTINYPFEKGP

SEQ ID NO: 7996 - DNA, 489 bp, Zea mays
  misc_feature: Ceres CLONE 363554-F
  misc_feature: Encodes the peptide sequence at SEQ ID NO. 7997
atacatttcgactctcaactcccaaggtccctttttttttctcgatctggaagcgccgcagtagcagccatggacgtgagcggagcaggcgggaggcgaagaagggcgcggccgggcgcaaggccggcgggccgacgaagaagtcggtgtcgcggtcctccagggccgggctgcagttccccgtcagccgcgtcgggcggtacctcaaaaagggccggtacgcgcagcgtgtaggcacgggtgcccccgtctacctcgccgccgtcctggagtacctcgcggccgaggtgctcgagctcgccggcaacgcggcaagggacaacaagaagacgcgcatcatcccgcgccaccacgatccgccggtccgcccagggcacaggcagttgctgcctgcctgccttgctgtcgtctgcccgtccggcgtccgccaggccgcccacactacttctacggccagccaccccagccacactagttgatcattgcatc

SEQ ID NO: 7997 - protein, 158 aa, Zea mays
  misc_feature: Ceres CLONE 363554-F
  misc_feature (51)..(118): Pfam Name: Histone Pfam Description: Core histone H2A/H2B/H3/H4
TFRLSTPKVPFFFSIWKRRSSSHGRERSRREAKKGAAGRKAGGPTKKSVSRSSRAGLQFPVSRVGRYLKKGRYAQRVGTGAPVYLAAVLEYLAAEVLELAGNAARDNKKTRIIPRHHDPPVRPGHRQLLPACLAVVCPSGVRQAAHTTSTASHPSHTS

SEQ ID NO: 7998 - DNA, 508 bp, Zea mays
  misc_feature: Ceres CLONE 363598-F
  misc_feature: Encodes the peptide sequence at SEQ ID NO. 7999
ctagaaaaatcacattttggcccaatcgatccctgtcttctcttcccaattcccagtccccaatcgcgttctcttcctcggcgacatggcggccgccaccggctacagcgacgccccaaccgacgagcaactgctggcgtacgctgagctgcccagacatggccgctacatggcggaggtgttcgccgtgcgcatcctcgccaccgccggaggagacccgccgccccatggcaccatcactttctacggcggccactgctgcagcgatttcatttacagctggagtccactggaagagggagaagacacctcgaagcaaacctgcgacagccagggtaacctcgtgctaactgggccatcatgggccacctcggcatacagtccaattgccttcaccctctacctccatgatggcagcccgcaagccggagaagccgctgaggacgacgaggacatcgggaggawaatctgcgactgcatcgacggtgacttctccaactacaacagg

SEQ ID NO: 7999 - protein, 141 aa, Zea mays
  misc_feature: Ceres CLONE 363598-F
  misc_feature: SWISSPROT Homolog: EC 3.2.2.22 rRNA N-glycosylase
  misc_feature (127)..(127): Xaa is any aa, unknown, or other
MAAATGYSDAPTDEQLLAYAELPRHGRYMAEVFAVRILATAGGDPPPHGTITFYGGHCCSDFIYSWSPLEEGEDTSKQTCDSQGNLVLTGPSWATSAYSPIAFTLYLHDGSPQAGEAAEDDEDIGRXICDCIDGDFSNYNR

SEQ ID NO: 8000 - DNA, 367 bp, Zea mays
  misc_feature: Ceres CLONE 363607-F
  misc_feature: Encodes the peptide sequence at SEQ ID NO. 8001
aaacacaccgatacagcacaccgtccatctctcccctccccctcgcaccgccgcgcggacacgaacacgcgagccaccgaacaggtccgggcccgatcgcaccgaccagccgcgcccgcggggcggggaggtggatccagtccaggggtgggctcctcttcaccgccgccgatggacttgggcctcagcgtcgcgggtaggaccggcagcggaggaggagggggctggagagggagcggcggcggcggcgcgtccgcggcggcgtggacccggctcgtcagctctggcgtggaggacgagctggtggccgcgtcgggaggaggaggaggaggtggtggtggacgcgctggggcgagagccggaggcc

SEQ ID NO: 8001 - protein, 65 aa, Zea mays
  misc_feature: Ceres CLONE 363607-F
MDLGLSVAGRTGSGGGGGWRGSGGGGASAAAWTRLVSSGVEDELVAASGGGGGGGGGRAGARAGG

SEQ ID NO: 8002 - DNA, 407 bp, Zea mays
  misc_feature: Ceres CLONE 363680-F
gtgcccatgtttctcgcctacgcgtacgccagttcccttcactctattcctgcgcatgaaggagttacccagatgagaagttccccaggcgctgcagcaacaggagaggaggagcacggttcgtcgtgcgcagattgcgatgtattcctgagcttcaaggagtcgacgatcaagttttggcgaccaagtgatcaggctcttcgagttttacgaggctgaagatcctgagcatctgtttagtgaaggttgtccatgttgcaaccgctgctcaggagaagatgaagccatggaggaagacttccaggagttccaagagtacgacgagttttaggcgtgggttagcggcaacccctagttggctgcctatgaaggccgcatgtatctacgtttcattttcacattttgat

SEQ ID NO: 8003 - DNA, 465 bp, Zea mays
  misc_feature: Ceres CLONE 363699-F
  misc_feature: Translation starting site: 39
aaaaagcgcagagcgcatcagcgcagagcaggacagccatggcgacggcggcggcgcagtcccattcgccatcaatggacgcgcgccggtgggacgagtcatcgtaccgccgcggcatcctccgtgcccgcgacctctcgtcccgcaccctcttccgtgccgtcttctttgaccacagcgacgacccggataccgacatcctactcgccgccgcttccagcgacggttccctcgcttccttctccctttcatcctgcatctccgcatgttccactacctcccaggtggagaccgccgccactctggtcgaccctgtctgcatcgtgcaagcgcacagcggacctgcctacgacgtcaggttctaccccgatcaacagcagccgctgctcttcagctgcggggacgatggccgcatcaagggttggaggtggcacgagatgcagagctgccttgtcccgctctccc

SEQ ID NO: 8004 - DNA, 338 bp, Zea mays
  misc_feature: Ceres CLONE 363703-F
  misc_feature: Encodes the peptide sequence at SEQ ID NO. 8005
ctcacacaaccaaactcgatcgatctcactctcagctggtcgctcactcttgcagctccacccttaatcactcagtcttagggtcttagctctaggctctagctagccgcgccactccttcgtgtagccatcagccttctcatcgccaccaatggccactgccgaggtccagaccccgaccgtcgtggcggccgaggaagcgcccgtggtggagaccccgccgccggccgtcgtgcccgaggagtctgcccccgccgaggccgaggctgaggctgaggctgaggctgctgctcctgctgctcccgaggagcttccggcggccgagcagcaggcagccg

SEQ ID NO: 8005 - protein, 62 aa, Zea mays
  misc_feature: Ceres CLONE 363703-F
MATAEVQTPTVVAAEEAPVVETPPPAVVPEESAPAEAEAEAEAEAAAPAAPEELPAAEQQAA

SEQ ID NO: 8006 - DNA, 380 bp, Zea mays
  misc_feature: Ceres CLONE 363741-F
  misc_feature: Encodes the peptide sequence at SEQ ID NO. 8007
ccgtgcattattctcaagttgggctcagcccatgtaggaggagcattccatccgggcccacttgtcatcggactgagtggcgtcttcctcctcccttcgtaactttcmagacccgaccgcagcagcgcggggcaacaagtgaaccgacggcggcgatggggatcggtgagcacttcgagggcgtcaagcagcactgggcgagcaacttcgccttcctcgactacttcaagaaggtctacggccgcgccmgagcccctccccaagtggtccgacgccgacgtcgackagttcatcgcatccgacccggtctacgggccccagctcaaggccctgcgggagtcgaggaagttcgcgctcgcsggggccctcgtcggcgccgc

SEQ ID NO: 8007 - protein, 75 aa, Zea mays
  misc_feature: Ceres CLONE 363741-F
  misc_feature (44)..(44): Xaa is any aa, unknown, or other
  misc_feature (69)..(69): Xaa is any aa, unknown, or other
MGIGEHFEGVKQHWASNFAFLDYFKKVYGRARAPPQVVRRRRRXVHRIRPGLRAPAQGPAGVEEVRARXGPRRRR

SEQ ID NO: 8008 - DNA, 451 bp, Zea mays
  misc_feature: Ceres CLONE 363749-F
  misc_feature: Encodes the peptide sequence at SEQ ID NO. 8009
aaaaaatcgagctgcccgcgcgcggcagttaagctcacacatcagctagctcaccttggacggccgaccaggtacgttgcgagcgatggcgggatacaaagcgtcgggcggcacggcgctcggcgtcgtcctggctgttgccgcgctcctcgccgcggcggcgatggcggtggacgacgagcacatgtaccactggaagtgcttcaactcgtgcacggggaaagtgccgcgacgaggacgcctttgacgacggccaccgttccggggattcgaacgtctcttccgtcgtctctggcggcaagtgcaacaacaggtgcctcagcgagtgcttcgaggacctgccggccatctgctaccaccagtgcgtcgtcagcaagtgcctctgcttcccaccctttagcaaagagaaaacgatgtgcatgaagagctgctgcaacaagtgcttccacca

SEQ ID NO: 8009 - protein, 53 aa, Zea mays
  misc_feature: Ceres CLONE 363749-F
MAGYKASGGTALGVVLAVAALLAAAAMAVDDEHMYHWKCFNSCTGKVPRRGRL

SEQ ID NO: 8010 - DNA, 456 bp, Zea mays
  misc_feature: Ceres CLONE 363768-F
  misc_feature: Encodes the peptide sequence at SEQ ID NO. 8011
aagtcatcgattcatccagcagaagcaagcatcacacaaaaccgatcaatctcgcagagggagaaccaaccaatccatcatctgtctcgactctctcgcgtctccgccggatccaaacaagaaaaaaagtgcccaccagagagctcccggtcatggcgacgacgcggccgctggagctgacgctgatctcggccaaggacctcaaggacgtgaacctgctgtccaagatggaggtctacgccgtggcgtcgctctccggcgacccccggtcgcggcagcgggtccaggccgaccgcgccggcggccgcaaccctacctggaacgccacgctccgcttcgccgtcccggcaaccggcgcctcctcctccctccacatcctcctccgcgccgagcgcgccctcggcgaccgcgacgtcggcgaggtccacatcccgctctccgagctcctctccggcg

SEQ ID NO: 8011 - protein, 101 aa, Zea mays; identical to SEQ ID NO: 6060
  misc_feature: Ceres CLONE 363768-F
  misc_feature (7)..(92): Pfam Name: C2 Pfam Description: C2 domain

SEQ ID NO: 8012 - DNA, 476 bp, Zea mays
  misc_feature: Ceres CLONE 363779-F
  misc_feature: Encodes the peptide sequence at SEQ ID NO. 8013
aagcttttggctcggcagctaacgacctgcagccaaccatctaccagcgactcagcgagcgagagcagcacacacgcagctagctaggagcagcagcagagcagcggcgatggcggcctccatgatctcctcgtcagctctggcggtggcgcctcagggcctgccgcccctcggccgccgcgcctcctccttcgccgtcgtctgctccaagaagaagatcaagaccgacaagccctacgggattgggggtggcctgaccgtcgacgtcgacgccaacgggagaaagggcaagggcaagggcgtgtaccagttcgtcgacaagtacggcgcgaacgtcgacggatacagcccttgccttgccccgcctccggtgctgtctgccgaaattcctctgtaaaaagactaaagagaaataattgttttggttttgtgctttgcttcgcttgcgaagattgttcaaaaaaaaaaaaaaaaaa

SEQ ID NO: 8013 - protein, 95 aa, Zea mays
  misc_feature: Ceres CLONE 363779-F
  misc_feature (32)..(92): Pfam Name: PsbR Pfam Description: Photosystem II 10 kDa polypeptide PsbR
MAASMISSSALAVAPQGLPPLGRRASSFAVVCSKKKIKTDKPYGIGGGLTVDVDANGRKGKGKGVYQFVDKYGANVDGYSPCLAPPPVLSAEIPL

SEQ ID NO: 8014 - DNA, 479 bp, Zea mays
  misc_feature: Ceres CLONE 363797-F
  misc_feature: Encodes the peptide sequence at SEQ ID NO. 8015
atctcgtccacgaaacgtacggacttcgggcatcggccccaacgccagcggcaccgcaccaccacgcccgtcggcgacatgaatccgcccgcagcagccgcgtccaccggcgcaggaggccacgccgcggcgcctgcggcagcccgggagtacgtgcactacccgaggctctcgccagaggaggtggccccgcccccgcccccgccttatcacgccgccaccgcggcgccgtccgcctacggaggcaacccctacatctactcccccgccggcggcgccgccacctccccgaagaatacgatggactccgtgaaggacgtgctcggcaagatggggaagaggtttggcgaggcggcccgcaagaccgagaccatcaccggcaatttctggcagcacttgaaaactggaccaagcattactgatgcagcaatgagcaggatctcacaggtcaccaaagtcattgcagaggtggtgctctc

SEQ ID NO: 8015 - protein, 133 aa, Zea mays
  misc_feature: Ceres CLONE 363797-F
MNPPAAAASTGAGGHAAAPAAAREYVHYPRLSPEEVAPPPPPPYHAATAAPSAYGGNPYIYSPAGGAATSPKNTMDSVKDVLGKMGKRFGEAARKTETITGNFWQHLKTGPSITDAAMSRISQVTKVIAEVVL

SEQ ID NO: 8016 - DNA, 472 bp, Zea mays
  misc_feature: Ceres CLONE 363817-F
  misc_feature: Encodes the peptide sequence at SEQ ID NO. 8017
agctttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcgggcggctacggcggtggcgggcgcbgtgatggcggtggcggctacggcggtgggcggcgggcta

SEQ ID NO: 8017 - protein, 111 aa, Zea mays
  misc_feature: Ceres CLONE 363817-F
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGYGGGRGGGRLRRWRA

SEQ ID NO: 8018 - DNA, 499 bp, Zea mays
  misc_feature: Ceres CLONE 363821-F
  misc_feature: Translation starting site: 246
actagaaccctagcgccccgcccgtcctgccgccgccgcagccgccatcgcacggccatgggtatcgatctcgtagccggcggccgcaacaagaagaccaagcgcacggcgcccaagtccgacgatgtctacctcaagctcctcgtcaagctctaccgcttccttgtgcgcaggacaaagagcaacttcaacgccgtgatcctcaagcgcctcttcatgagcaagaccaaccgcccccgctctcgatgcgccgcctcgtcaggttcatggaggggaagggtgatcagatcgccgtgattgtgggcaccgtgaccgacgacaagaggatcagcgaggtgccggcgatgaaggtctgcgcgctcaggttcactgagacagcgagggccaggatcatcaatgctggcggagagtgcctcaccttcgaccagctcgcgctcygtgccccacttgggcaaaacacggttctgctgaggggtcctaagaacgctagggatgggta

SEQ ID NO: 8019 - DNA, 434 bp, Zea mays
  misc_feature: Ceres CLONE 363853-F
  misc_feature: Translation starting site: 65
  misc_feature (172)..(172): n is a, c, t, g, unknown, or other
gcattagacagacacacacacacactcaacagcaacagctaaccctctcccaccagacagcaacatggctgaggaggaggccaagaaggtggaggtggaggtcaccaaggagcccgaggcggcacccgcggccgcgcggaggcggcggcgaaggaggacgtcgccgacgacnaggccgtcatccccgcgaccgacccgccgccgccgccggccgacgactccaaggccctggccatcgtcgagaaagttgcagatgaacctgctcccgagaagcctgcccctgcgaagcaagggggctccaatgacagggatctcgctcttgcaagggtggaaacwgagaagaggaactctttgatcaaagcttgggaatgagawtgtagaagacaaaagctgagaacaaggctgctaagaaagtatccgctattctttcatgg

SEQ ID NO: 8020 - DNA, 488 bp, Zea mays
  misc_feature: Ceres CLONE 363868-F
  misc_feature: Encodes the peptide sequence at SEQ ID NO. 8021
ctcaccggcccaccgcaagcgcagaagcacaaccacaacacctcgcctcgtcagatcgaccgggaagaagggagcagaagccaaccggctcgtccgcccgttgcctgtcgtcgctatggccgccgtggaggtgtgcgtgaaggccgccgcggggaaccccgacacgctcggcgattgcccgttctcgcagagggtgctgctcacgctggaggagaagaaggtcccgtacgaggtgaagctcgtcgacctcggcaacaagcccgaatggtttctgaacatcagcccagagggtaaggtgcctgtgttcaacggtggagatggcaaatgcattgctgattctgatgtaatcacccaagtcattgaggagaagttcccgactccttctctggtcacccctccagaatatgcatcagtgggatcaaagattttcccagcctttgtcaagttcttgaagagcaaggatgctagtgatgggtcagagaaggcgc

SEQ ID NO: 8021 - protein, 124 aa, Zea mays
  misc_feature: Ceres CLONE 363868-F
  misc_feature (16)..(84): Pfam Name: GST_N Pfam Description: Glutathione S-transferase, N-terminal domain
  misc_feature: SWISSPROT Homolog: EC 2.5.1.18 Glutathione transferase
MAAVEVCVKAAAGNPDTLGDCPFSQRVLLTLEEKKVPYEVKLVDLGNKPEWFLNISPEGKVPVFNGGDGKCIADSDVITQVIEEKFPTPSLVTPPEYASVGSKIFPAFVKFLKSKDASDGSEKA

SEQ ID NO: 8022 - DNA, 484 bp, Zea mays
  misc_feature: Ceres CLONE 363882-F
  misc_feature: Encodes the peptide sequence at SEQ ID NO. 8023
aataaaccctgcacctccatcgcaccctctccgccgccaagaccatcctcgcatccgggttgccagctctccttgagcccagaagcacaccgcgcgccatgcgaccaccgagagggcgaggcggtggtggccggttcggcggaggaggaggccggggccgcggcgggggccgattcagcggtggtggccgaggtggcggcgggggccgcttcggcggcgggttccgcgacgagggcccgcccgcggaggtcgtcgaggtttcgacgttcctgcacgcgtgcgagggggaggcggtgacgaagctcaccaacgagaaggtgccctacttcaacgcgcccatctatctgcagaacaagacccagatcggcaaggttgaagagatcttcggcccyatcaacgaatcctatttctctgtgaagatgatggaggggatcattgcaacatcgtacaatgaaggcgacaagttctataatcgacccaatga

SEQ ID NO: 8023 - protein, 128 aa, Zea mays
  misc_feature: Ceres CLONE 363882-F
  misc_feature (44)..(127): Pfam Name: Gar1 Pfam Description: Gar1 protein RNA binding region
MRPPRGRGGGGRFGGGGGRGRGGGRFSGGGRGGGGGRFGGGFRDEGPPAEVVEVSTFLHACEGEAVTKLTNEKVPYFNAPIYLQNKTQIGKVEEIFGPINESYFSVKMMEGIIATSYNEGDKFYNRPN

SEQ ID NO: 8024 - DNA, 724 bp, Zea mays
  misc_feature: Ceres CLONE 363904-R
cgaattgggtaccgggcccccctcgaggtcgacggtatcgatatttttttttctttttttgatttatttctttttatttctttttttttttttttttttttttttttttttttttttttttttttttttatcttttttttattttaacaaccaacttttttgaccgggcccccccctacactactaattatggggaaacaccaaaaagggggaacccggaggaccccccttttggacatcccccttataaaaacccccagaaaaacccccccccccccctggctggcccctgcccccccctcttggaaattaccaccgtacccaccccccccctcaaagaaattgcctctttttccccttggggggttttttgccctacccagaaaaaatttttccaataaaaaggtccaaggaaagggccccgggcaaatcccggcccccgggggaaccccttttttttaaacggcccccccccccggggaaccccccccttttttccccttaagggggggaaaatgcccccctgggggaaaccagggccaaagcttttcccgggggaaaatttttcccccctcaaaatcccccaaaaaaaacaacccgaaaccaaaaagggtaaacccggggggcccaaagggggcccccctccccattaattggcttgcgcccacgggccccttttccggggggaaaacatgttgggcccactgccttaaagaatcccccc

SEQ ID NO: 8025 - DNA, 520 bp, Zea mays
  misc_feature: Ceres CLONE 363912-F
  misc_feature: Encodes the peptide sequence at SEQ ID NO. 8026
atcggcccattcgtgtccatgtccatccatgcccagcggcccattcgacctccctcgacccaccccctcgtctcgtctcgtctcgtctcgtccacctccccagcggcgcgtgcgcgtgaagcttgaggcaatccccgctccgtctagcggccctgcgcaatcagtcagggttccatggccaacagcaacctcccgcgccgaatcatcaaggagacgcagcggctcctcagcgaaccagcgccggggattagcgcgtcgccgtcggaagagaacatgcggtacttcaatgtcatgatccttggccccgcacagtcaccctatgaaggtggagttttcaagcttgagctattcttgcctgaggaatatccaatggctgccccgaaagttaggtttctcaccaaaatttaccatccgaacattgacaagcttggtaggatatgcctcgacattcttaaggacaaatggagtcccgctcttcagatacgtacagttctgctcagcattcaggcacttctgagtg

SEQ ID NO: 8026 - protein, 115 aa, Zea mays
  misc_feature: Ceres CLONE 363912-F
  misc_feature (9)..(115): Pfam Name: UQ_con Pfam Description: Ubiquitin-conjugating enzyme
  misc_feature: SWISSPROT Homolog: EC 6.3.2.19 Ubiquitin--protein ligase
MANSNLPRRIIKETQRLLSEPAPGISASPSEENMRYFNVMILGPAQSPYEGGVFKLELFLPEEYPMAAPKVRFLTKIYHPNIDKLGRICLDILKDKWSPALQIRTVLLSIQALLS

SEQ ID NO: 8027 - DNA, 484 bp, Zea mays
  misc_feature: Ceres CLONE 363917-F
  misc_feature: Encodes the peptide sequence at SEQ ID NO. 8028
agaacgcgtgctccgtccgtcccccctctgcctcgcgcgcgcagggttagcgtgagctgatcgagcaacgagagctagctagctagctagctagaggacacgacacgatggccttgcaggtcaccggcggcgtgggctgctgctgccctccgggcagtgcccggcggttgccgcaagcggcggcgctgtgtcgcccgccccgcgcggtagtgtccggcgcaaccagggtggtggaggaggacgagggcaaggtgaggctgggcggctcaggcgtcgcggtcaccaagctcggcatcggcgcgtggtcctggggcgacaccacctactggaacgactccgagtgggatgataggagactgagggaagcacaggacgcgttcgatgcgagcatcgataacgggatgaccttcttcgatactgcagaagtttacggtacagcactgatgggagcagtcaattctgaaactttactaggaggattcat

SEQ ID NO: 8028 - protein, 125 aa, Zea mays
  misc_feature: Ceres CLONE 363917-F
MALQVTGGVGCCCPPGSARRLPQAAALCRPPRAVVSGATRVVEEDEGKVRLGGSGVAVTKLGIGAWSWGDTTYWNDSEWDDRRLREAQDAFDASIDNGMTFFDTAEVYGTALMGAVNSETLLGGF

SEQ ID NO: 8029 - DNA, 416 bp, Zea mays
  misc_feature: Ceres CLONE 363926-F
  misc_feature: Encodes the peptide sequence at SEQ ID NO. 8030
cttcctcatccagtgttctgtcctagcgccgccgccgccccagctcgccttgcgtgactgagagctcgtcggcttccgtccacgcgtgaagcgagagcatggacacccaggtgaagcttgctgttgtggtgaaggtgatgggcaggaccggctccaggggtcaggtgacccaggtcagagtgaagtttttggatgaccagaaccggctcatcatgaggaatgtcaaggggcccgttcgcgagggtgacatcctcaccctgctcgagtccgagagggaggccaggaggctgcgctgaagccctagcgttcttggtgggctcttgtatggtctttggtgtcttggaatttgtgctatgtttgaacttctgtgaccctgttttaagagtagtaagcctggttataagatgcagttttgc

SEQ ID NO: 8030 - protein, 65 aa, Zea mays; identical to SEQ ID NO: 5504
  misc_feature: Ceres CLONE 363926-F
  misc_feature (1)..(65): Pfam Name: Ribosomal_S28e Pfam Description: Ribosomal protein S28e

SEQ ID NO: 8031 - DNA, 380 bp, Zea mays
  misc_feature: Ceres CLONE 363984-F
atccgagcccaaaccctagtccagccagatctccgccgccgccggcgagagcacggcatcagatccgccgcgatggcggagatctggcaggaatctagggtttcgtgctccttcgattttagatgtttactcgtttttgctctagttgtgggtggtgtgcggggtgcggggttactaggttgtaaatttgatgtcggaggctggggtacacataggcattctgtaccagcggtggaaggcgccggcgacgatgacgaaccagtgtgtgttattattattagaagacaacgttgtatttctgtagctgaattgttgagttgcggatatcattgtgctgctaaggttaatgtgacgataaagttaatgccaaaaaaaaaaaa

SEQ ID NO: 8032 - DNA, 538 bp, Zea mays
  misc_feature: Ceres CLONE 364021-F
  misc_feature: Encodes the peptide sequence at SEQ ID NO. 8033
aaatcacctcacaacaagctgccccgcagcaacgaacacgaaccttggcagaacgaagctgaagtagttcgttgtgaacccagtatggcaaacgcgccgaggatcctggccctcggcctgctgctagcgctcctgtgcgctcccgccggcccggccgccgcgcagaactgcggctgccagcctaacttctgctgcagcaagttcggctactgcggcacgaccgacgactactgcggcgacgggtgccagtcgggcccgtgccgctcgggcggcggcggcggcggcggcggaggcggaggcagtggcggtgcgaacgtggctaacgtggtcagcgacgcgttcttcaacggcatcaagaaccaggccgggagcgggtgcgagggcaagaacttctacacccggagcgcgttcctgagcgccgtcaacaagtacccgggcttcgccccatggcgggacggaggtggagggcaagcscgagatcgccgccttcttcgcgcacgtcacgcacgaagaccggacatttctgctacatcagcga

SEQ ID NO: 8033 - protein, 151 aa, Zea mays
  misc_feature: Ceres CLONE 364021-F
  misc_feature (26)..(59): Pfam Name: Chitin_bind_1 Pfam Description: Chitin recognition protein
  misc_feature: SWISSPROT Homolog: EC 3.2.1.14 Chitinase
MANAPRILALGLLLALLCAPAGPAAAQNCGCQPNFCCSKFGYCGTTDDYCGDGCQSGPCRSGGGGGGGGGGGSGGANVANVVSDAFFNGIKNQAGSGCEGKNFYTRSAFLSAVNKYPGFAPWRDGGGGQARDRRLLRARHARRPDISATSA

SEQ ID NO: 8034 - DNA, 471 bp, Zea mays
  misc_feature: Ceres CLONE 364049-F
  misc_feature: Encodes the peptide sequence at SEQ ID NO. 8035
aaaaagaaaccgagagctagtgcttgattcggtcgtttttgggcaccgaacacgttcttgggaccgccgccgccgccctacttccagtcccagctgctcaggtctccatcggcctcgagccctttgccggcgacgagcactcacaacaccagggtgtaacaatgtcttcttcaatggaatcgtcataccttcctgctacaactgagtcattagcccaagctcaagaggctaaggatgcttcagagtccattcaatcctttaccgtgtcattcaggacccatcttcttctgctgatgcactgagaacaaaagaagttgcaattacaaatcttacaaactacctcactaaagaaaacagagctgaggagctgcgtaatcttttgacccagstcagaccattttttgcagttattcctaaggcaaagactgcaaaaattgtccgtggaataattgatgctgtcgcaaagatacc

SEQ ID NO: 8035 - protein, 46 aa, Zea mays; identical to SEQ ID NO: 6000
  misc_feature: Ceres CLONE 364049-F

SEQ ID NO: 8036 - DNA, 659 bp, Zea mays
  misc_feature: Ceres CLONE 364074-R
  misc_feature: Encodes the peptide sequence at SEQ ID NO. 8037
cgattgggtaccgggccccccctcgaggtcgacggtatcgataagcttttttttttttttttttacagtagcagattcacaagagcgaatctgttaatccattgataaattattacttactcaaatcacactctacaaatgccggggacaaactacctgagcaacaacaacaacaatcacagcacgcacgaggccagcgggaagggaacaaacaaacggcgactgctagccgatgcacgcgcagtcaaaaggcgaaacaccaagcaacacatggggaaagccacgtactgtgacgacgacggagacgggactggcaggggttcttataatcggctaatcaggaccgtgcttgatttgctagtgattaatttaaggctagcaatggcgacgcgaccgaactgtcgcgttcgcagctctgtggtgtgccagtgcagtgatggacggttttgttcaggaggtggcaatgcagtagggctccaggatgaagagcttcttctgccgcagctgccggcaccgccgcacgctctgcagcaggtcctgcttgtcccccctccgcgacgtgaacgacagcagcagaagctgcttggtctcggccgcggccggggcgggaaggtgcagcccgccgcactcgtcgtcgtcctccggagccggcgggacgt

SEQ ID NO: 8037 - protein, 173 aa, Zea mays
  misc_feature: Ceres CLONE 364074-R
MPGTNYLSNNNNNHSTHEASGKGTNKRRLLADARAVKRRNTKQHMGKATYCDDDGDGTGRGSYNRLIRTVLDLLVINLRLAMATRPNCRVRSSVVCQCSDGRFCSGGGNAVGLQDEELLLPQLPAPPHALQQVLLVPPPRRERQQQKLLGLGRGRGGKVQPAALVVVLRSRRD

SEQ ID NO: 8038 - DNA, 451 bp, Zea mays
  misc_feature: Ceres CLONE 364099-F
  misc_feature: Encodes the peptide sequence at SEQ ID NO. 8039
ctttccaattcgatgcctttgtagcgctgctgcctcgcccccgccgcgtcgtcgcgggtccccggcttcgcttgctgctgcgtttctaagttctagcgtcatggacgggggatccggtaatgccaacggcggcggagcggcggtgtgctgctactacgcgctcctcggcgtccgcaagagcgcctccgccaccgacatacgcactgcgtaccggaggctcgcgatgaagtggcacccggaccggtgggccagcgaccccggcgcggccggcgaggccaagcggcggttccagcggatccaggaggcctactcagttttatcggacaaggggaagaaggccatgtacgacgccgggctcttcgatcccctcgacgacgacgaccaggatttctccgacttcatgcaggagatgctggtgatgatggataacgtgaaaaacgagaagccggac

SEQ ID NO: 8039 - protein, 117 aa, Zea mays
  misc_feature: Ceres CLONE 364099-F
  misc_feature (17)..(83): Pfam Name: DnaJ Pfam Description: DnaJ domain
MDGGSGNANGGGAAVCCYYALLGVRKSASATDIRTAYRRLAMKWHPDRWASDPGAAGEAKRRFQRIQEAYSVLSDKGKKAMYDAGLFDPLDDDDQDFSDFMQEMLVMMDNVKNEKPD

SEQ ID NO: 8040 - DNA, 440 bp, Zea mays
  misc_feature: Ceres CLONE 364138-F
  misc_feature: Encodes the peptide sequence at SEQ ID NO. 8041
atattaataagaagcaattacggcggttcaagtaggtttgtcccgtcgtttcattccggccggccgccgccacaccaaagcaaccatggccttttctgccgccctcgcctgggccgccacgcaactcctccgcgggagcctccctcctgcccgcttcgccgctgccgtctcgcctctcacatacagcagcagccgccaactctgcagtacccccatcgccaacgattcctccgccgcaggaccgtgggacgaggccgagacggagatcctccgcgacgtcgagcccatcgtgaatatcgtcaaggacatcatccactcccgcaggtataaaaatggtgaatttttaagcccagatgatgaaaaggttgtaagagaaaagcttctttctcatcatcctcgtgcagaagaaaagattggttgtgggcttgatggtataatgg

SEQ ID NO: 8041 - protein, 118 aa, Zea mays
  misc_feature: Ceres CLONE 364138-F
MAFSAALAWAATQLLRGSLPPARFAAAVSPLTYSSSRQLCSTPIANDSSAAGPWDEAETEILRDVEPIVNIVKDIIHSRRYKNGEFLSPDDEKVVREKLLSHHPRAEEKIGCGLDGIM

SEQ ID NO: 8042 - DNA, 435 bp, Zea mays
  misc_feature: Ceres CLONE 364279-F
  misc_feature: Encodes the peptide sequence at SEQ ID NO. 8043
aactaaaactcggatagatctcagagcagtgcttccctgttctctccatcaagaaacagcaaagatccagtgcagagagagagaagcgccatggcactctgaacaagaaaagaaaagaaagagctagagagagatatctcactcagccagtctctcacaacacaatgccgacaaccaccaagccgatcttgctcccaagggcgtgggcagcagcgccactcctcctgctgctgctcgtcctgcacgggagaggaggccactgcgtcggcatggagacggcggagctggagatggactcggaggcgcaccggtggctgctgtgggaggcgaccacggggcggaggtacatcagctacgacgccctgcggggcgacgcggtgccgtgctccaggaccgggtggtggcgatgcagcggaggagatcccgggcacatgg

SEQ ID NO: 8043 - protein, 90 aa, Zea mays
  misc_feature: Ceres CLONE 364279-F
  misc_feature (36)..(84): Pfam Name: RALF Pfam Description: Rapid ALkalinization Factor (RALF)
MPTTTKPILLPRAWAAAPLLLLLLVLHGRGGHCVGMETAELEMDSEAHRWLLWEATTGRRYISYDALRGDAVPCSRTGWWRCSGGDPGHM

SEQ ID NO: 8044 - DNA, 99 bp, Zea mays
  misc_feature: Ceres CLONE 364306-F
ggraccccgctgttggccatgccggcgatcgcgccgtgggatctcatcgaggcgacgacggcgatgtcragggaggcggcgaggacgaggagccgggtc

SEQ ID NO: 8045 - DNA, 422 bp, Zea mays
  misc_feature: Ceres CLONE 364330-F
  misc_feature: Encodes the peptide sequence at SEQ ID NO. 8046
cgaaaaagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggggaaggccaagccggcggcggcgtccgggagcccgtggtacggccccgaccgcgtgctgtacctgggcccactgtccggcgagccgccgagctacctgacgggcgagttcccgggcgactacggctgggacaccgcggggctgtcggcggacccggagacgttcgccaagaaccgggagctggaggtgatccactcccgctgggccatgctgggcgcgctcggctgcgtcttcccgg

SEQ ID NO: 8046 - protein, 116 aa, Zea mays
  misc_feature: Ceres CLONE 364330-F
  misc_feature (65)..(116): Pfam Name: Chloroa_b-bind Pfam Description: Chlorophyll A-B binding protein
MASSTMALSSTAFAGKAVNVPSSSAFGEARVTMRKTAGKAKPAAASGSPWYGPDRVLYLGPLSGEPPSYLTGEFPGDYGWDTAGLSADPETFAKNRELEVIHSRWAMLGALGCVFP

SEQ ID NO: 8047 - DNA, 389 bp, Zea mays
  misc_feature: Ceres CLONE 364333-F
  misc_feature: Encodes the peptide sequence at SEQ ID NO. 8048
ctccgtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtg

SEQ ID NO: 8048 - protein, 95 aa, Zea mays
  misc_feature: Ceres CLONE 364333-F
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAASDVEYRCFVGGLAWATDDHSLHNAFSTYGEVLESKIILDRETQRSRGFGFVTFSTEEAMRNAIEGMNGKELDGRNITVNEAQSRGGRGGGGG

SEQ ID NO: 8049 - DNA, 519 bp, Zea mays
  misc_feature: Ceres CLONE 364407-F
atcttcgtttgattctggtttgcctctctgatccagctacgacaccctgcgcctgccgcactaggtacatttgattctggtttctgccgcacaagatccgctacctcttggacccggacatctacaccgacggcaggatctccgtgcagggcatcgacgccgtgctcttcgcgccggacgacgccaaggccacgcagaccgtcgacccgaacaggaagcctcctaccatcgtcacccacaagaagaagatcaagctccggcgagttcatctattgctcaacctcagtattggccaacgtgaaaacatggaggtgaagtgaagcaagtggtagttgagcatatgctggtggttggttgtcttcatgaacatctctttgatggctgataccattcctgggactgcaagccaacactgtcctttaacccatgacccatgagcaacaatttcttcttaacaacagagcatgatgttagagaaatttggcttcaagcgcaaaataggttgcttcgtggggagtg

SEQ ID NO: 8050 - DNA, 483 bp, Zea mays
  misc_feature: Ceres CLONE 364560-F
  misc_feature: Encodes the peptide sequence at SEQ ID NO. 8051
ctagcattcaaccacgccgagctcgccggaacaagcccaacccgagcccaatcccgctcgggccccagccgatccgacggctcctcaccagcacaatccggggtaccccgcggatgctagcctgatcgggtccccacggtcgatgggttcgcccgggtccgccaatggcagacgcggcgactatgtgaggatcccggaggaggcggaggtggcgtccaagggggagggagatgccgcggcggccgtcaaggcggccgcggcggcggagtgcctagggtgctgcggtgcagcgcgatccggtggtgggccaaggtcgccgtgctcgggatcgtccttgctggggccggagctgccgcggtcgtcttcctcggcccgctccttatcaagaaggtttagaatattaggtcagatcagacgcttatatgtataataagtcaatagcacgtgcaaggagcagctgtaagattgttgtacctattcttc

SEQ ID NO: 8051 - protein, 95 aa, Zea mays
  misc_feature: Ceres CLONE 364560-F
MGSPGSANGRRGDYVRIPEEAEVASKGEGDAAAAVKAAAAAECLGCCGAARSGGGPRSPCSGSSLLGPELPRSSSSARSLSRRFRILGQIRRLYV

SEQ ID NO: 8052 - DNA, 470 bp, Zea mays
  misc_feature: Ceres CLONE 364574-F
  misc_feature: Encodes the peptide sequence at SEQ ID NO. 8053
ctggttctccatccggtcagaccaatcaacaaagtgacgcgagcacgagcatccatcgtttccccttcttccccatcgcgtgccctcgccgcagccatcttccatggcggaccagctcacggacgagcagatcgcggagttcaaggaggccttcagcctcttcgataaggatggcgacggctgcatcactaccaaggagcttggaactgtgatgcgctcccttggccagaaccccactgaagcagagctgcaggacatgatcaacgaggttgatgctgatggcaatgggaccattgacttcccagagttcctgaacctgatggcaaggaagatgaaggacaccgactccgaggaggagcttaaggaggcctttcgcgtcttcgacaaggaccagaatggtttcatctcggctgctgagctccgccatgtgggcctggcgggaggagctcttcgccctcgccgccgcgccc

SEQ ID NO: 8053 - protein, 122 aa, Zea mays
  misc_feature: Ceres CLONE 364574-F
  misc_feature (12)..(40): Pfam Name: efhand Pfam Description: EF hand
  misc_feature (48)..(76): Pfam Name: efhand Pfam Description: EF hand
  misc_feature (85)..(113): Pfam Name: efhand Pfam Description: EF hand
  misc_feature: SWISSPROT Homolog: EC 2.7.11.1 Non-specific serine/threonine protein kinase
MADQLTDEQIAEFKEAFSLFDKDGDGCITTKELGTVMRSLGQNPTEAELQDMINEVDADGNGTIDFPEFLNLMARKMKDTDSEEELKEAFRVFDKDQNGFISAAELRHVGLAGGALRPRRRA

SEQ ID NO: 8054 - DNA, 449 bp, Zea mays
  misc_feature: Ceres CLONE 364594-F
  misc_feature: Encodes the peptide sequence at SEQ ID NO. 8055
atacgggcccgtgtctcagcgcacacctcttcgtgctcgctcccatggaggccaccccgatctccatgaagccaccggcgccggcgccggcgccacccccggtcactctggagcccatagaattgtcaacgcatgccgtcggagtgaccgagctggagcgatccagcatgaaccagctcgcaatagcgccggaccccaagcggcagagggtggaggaggctgcggatggcaacgggtgcaagcattgcgcctgcaagaagtccagatgcttgaagctctattgcccatgttttgctggaggtggttattgttccgataagtgtggctgccaaccatgtttcaacaaagaagccttttcagaaacagttcagactactcgcaaggtgttactttcaagacagaagcgcatgtcgatgaaaattaataggagacctgaggcaaatgctgaa

SEQ ID NO: 8055 - protein, 135 aa, Zea mays
  misc_feature: Ceres CLONE 364594-F
  misc_feature (63)..(104): Pfam Name: CXC Pfam Description: Tesmin/TSO1-like CXC domain
MEATPISMKPPAPAPAPPPVTLEPIELSTHAVGVTELERSSMNQLAIAPDPKRQRVEEAADGNGCKHCACKKSRCLKLYCPCFAGGGYCSDKCGCQPCFNKEAFSETVQTTRKVLLSRQKRMSMKINRRPEANAE

SEQ ID NO: 8056 - DNA, 509 bp, Zea mays
  misc_feature: Ceres CLONE 364621-F
  misc_feature: Encodes the peptide sequence at SEQ ID NO. 8057
atattctcccaaaaaacccaacactccagtggcggcaaagacctaacatttcaaaatcaatggccaagaaccccaaggcgcccgacacccgcagtggccgttctcccaccagaaggccccgaccacgccgcgccaaggcggtgccagaagcctcctccgcagctgatatcgaagacctggctccctcagtgcctggggccgctgcccctggcgctgcgcacccacggccctgcgcgcacagctgctccggtggtatgacgcgcaccgtagggacctgccgtggcgatgcgtaagcggcagcgaggaagagagggcgtacgcggtgtgggtgtccgaggtgatgctgcagcagacgcgggtgcccgtggtcgtcgcttactacgagcggtggatggcgcggtggccgaccgtacgaagcctcgccgccgctacgcaggaggaggtgaacgagatgtgggcgggtcttggctactaccgtagggctcgatttctgctggagggagcaaagc

SEQ ID NO: 8057 - protein, 56 aa, Zea mays
  misc_feature: Ceres CLONE 364621-F
MLQQTRVPVVVAYYERWMARWPTVRSLAAATQEEVNEMWAGLGYYRRARFLLEGAK

SEQ ID NO: 8058 - DNA, 491 bp, Zea mays
  misc_feature: Ceres CLONE 364686-F
  misc_feature: Encodes the peptide sequence at SEQ ID NO. 8059
gagtttcgatctcttccatccgagtgtctcctcatcctcggccgccgccgccgccgcttccgtcgtctccgcccgccgtcgccgccgcttccgtcgtctccgcccgccgtggccatgccgtcgcacaagaccttccggatcaagaagaagctggccaagaagatgcgccagaaccgccccatcccctactggatccgcatgcgcaccgacaacaccatcaggtacaacgccaagcgcaggcactggcgtcgcaccaaactcggattctgagcggtggaagaaatgctggctaaagacgcctagagggtatagggctctgcaagctaggaagctcttgtttaattttttttgcttgtgttatttgtcattgtagtaccatgttttgtctgatggttaaagaaccgcctttatgctatggtgaatttatttaaccttgcagcgcttaatcagttgatctctagccaattatttctccgaaaaaaaaaaaaaaa

SEQ ID NO: 8059 - protein, 51 aa, Zea mays; identical to SEQ ID NO: 2355
  misc_feature: Ceres CLONE 364686-F
  misc_feature (9)..(51): Pfam Name: Ribosomal_L39 Pfam Description: Ribosomal L39 protein

SEQ ID NO: 8060 - DNA, 497 bp, Zea mays
  misc_feature: Ceres CLONE 364702-F
  misc_feature: Encodes the peptide sequence at SEQ ID NO. 8061
gtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggcggcggctacggcggtggctgcagcgactttgaacaacaaaggagacaacattg

SEQ ID NO: 8061 - protein, 132 aa, Zea mays
  misc_feature: Ceres CLONE 364702-F
  misc_feature (10)..(81): Pfam Name: RRM_1 Pfam Description: RNA recognition motif. (a.k.a. RRM, RBD, or RNP domain)
  misc_feature (48)..(122): Pfam Name: GRP Pfam Description: Glycine rich protein family
  misc_feature: SWISSPROT Homolog: EC 5.2.1.8 Peptidylprolyl isomerase
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGYGGGRGGGGYGGGGRRDGGGGYGGGCSDFEQQRRQH

SEQ ID NO: 8062 - DNA, 493 bp, Zea mays
  misc_feature: Ceres CLONE 364719-F
  misc_feature: Translation starting site: 128
  misc_feature: SWISSPROT Homolog: EC 2.5.1.48 Cystathionine gamma-synthase
aaaaataggccgcaccgcatttcgaaaggccacgccaccgcacctccacctcctcgaagccgccgcgaccgatcgagcgaagcgtcccttcccgcgccgacgccgaaaccctagctcctcttacgccatggccaccgtgtcgctcactccgcaggcggtcttctccaccgagtccggcggcgccctggcttctgccaccatcctccgcttcccgccaaacttcgtacgccagctcagcaccaaggcacgacgcaactgcagcaacatcggcgtcgcgcagatcgtcgccgccgcgtggtccgactgcctcgctgcccgccgcctccgcggcggcggatgtcagcgcaattcctaacgctaaggttgcgcagccgtccgccgtcgtattggccgagcgtaacctgctcggctccgacgccagcctcgccgtccacgcgggggagaggctgggaagaaggatagccacggatgctatcaccacgccggtagtgaa

SEQ ID NO: 8063 - DNA, 489 bp, Zea mays
  misc_feature: Ceres CLONE 364754-F
  misc_feature: Encodes the peptide sequence at SEQ ID NO. 8064
ataaggtctctcctacgccgcggccacacagactccagtctcctctagccgtctcgcgcgcttcaccttccccaccccgccgccgccatcgcacgcccgcagccgcatccgctatgggtgcgtacaagtacgtctcggagctatggcggaggaagcagtccgatgtgatgcggttcgtgcagcgcgtgcgctgctgggagtacaggcagcagccggccatcgtccgcctcacaaggcccactcgccctgacaaggcgcgccgcctcggctacaaggccaagcagggttatgttgtttaccgtgtccgtgttaggcgtggtggcaggaagaggcctgtgcctaaaggtattgtctatggcaagccaaagcaccagggtatcacccagctcaagttccagaggaacaagaggtctgttgctgaggagagggctggacgaaagcttggtggactcagggttctcaactcctactgggtgaatgaggatagca

SEQ ID NO: 8064 - protein, 125 aa, Zea mays
  misc_feature: Ceres CLONE 364754-F
  misc_feature (2)..(125): Pfam Name: Ribosomal_L15e Pfam Description: Ribosomal L15
MGAYKYVSELWRRKQSDVMRFVQRVRCWEYRQQPAIVRLTRPTRPDKARRLGYKAKQGYVVYRVRVRRGGRKRPVPKGIVYGKPKHQGITQLKFQRNKRSVAEERAGRKLGGLRVLNSYWVNEDS

SEQ ID NO: 8065 - DNA, 515 bp, Zea mays
  misc_feature: Ceres CLONE 364829-F
  misc_feature: Encodes the peptide sequence at SEQ ID NO. 8066
gaaggatgttcaccgagaaaccctagttcgaacgcgccgccatcaccgtcgtctctcgctcgttccctcgcgctctccgctcgtgagtactcccacggatcggagcgagagtaggggcgtgtcggcggtgaaagcgaccgcgtcagccatggcggacgaggagcattcggagaggagagaggaggcctccgagcttgcccccttcgacccgaccaagaagaagaaaaagaagaaggttgtcatccaagaaccttctgatgaagtggacaagcttgcagagaagacagaaacactggcagtcgcagaacccgctgaacttaacttcactggaatgaagaagaaaaagaagaagccggtggatcttgattcaactcttgatgagcttggagatggggaggacactcaagatgatcaagctgtagaggaacaaggggaaggcattgtgctgggaagtgtcctacatacccttgggagggaactgatcgggattataaatatgaagagctgctggacag

SEQ ID NO: 8066 - protein, 122 aa, Zea mays
  misc_feature: Ceres CLONE 364829-F
MADEEHSERREEASELAPFDPTKKKKKKKVVIQEPSDEVDKLAEKTETLAVAEPAELNFTGMKKKKKKPVDLDSTLDELGDGEDTQDDQAVEEQGEGIVLGSVLHTLGRELIGIINMKSCWT

SEQ ID NO: 8067 - DNA, 411 bp, Zea mays
  misc_feature: Ceres CLONE 364902-F
  misc_feature: Encodes the peptide sequence at SEQ ID NO. 8068
aaaaaaaaacccaaatcaaatttcgccttcgtcgtcgtyttctcgtctcaratttgactccatgtcggcggcsctcgcggtgacggacgaggtggccctgccgatccgggcggtgggggatctggcggccgccgccgaggtctcgcgggaggaggtcgccgtcatcacccagtgcgcggcgctcggtgggaagttgccttttgaagatgcatcagttggtgcggttcttgcagtcattaaaaatgtggaaagcttgagggagcaattggttgctgaaatcaggcgggtgctgaaagctggtgraagaktattggtgcagagccctgcaccctcatccagtcagaascsgaacactgatattgagcgcaagttactgatgggtggatttgctgaagtgcaattttctgctgc

SEQ ID NO: 8068 - protein, 116 aa, Zea mays
  misc_feature: Ceres CLONE 364902-F
  misc_feature (81)..(81): Xaa is any aa, unknown, or other
  misc_feature (83)..(83): Xaa is any aa, unknown, or other
  misc_feature (95)..(95): Xaa is any aa, unknown, or other
  misc_feature (96)..(96): Xaa is any aa, unknown, or other
MSAALAVTDEVALPIRAVGDLAAAAEVSREEVAVITQCAALGGKLPFEDASVGAVLAVIKNVESLREQLVAEIRRVLKAGXRXLVQSPAPSSSQXXNTDIERKLLMGGFAEVQFSA

SEQ ID NO: 8069 - DNA, 463 bp, Zea mays
  misc_feature: Ceres CLONE 364965-F
  misc_feature: Encodes the peptide sequence at SEQ ID NO. 8070
aagacacacacgcgcgcgaacacgaacagggacacgagacagcggcggccatggcgagaggcggcggcgatcggagtcgggaggatgaccccttctccgacggcggcaccaccggaaccgactcggacgagtcctctccgcgtggggtgggggcccgcggccccggctccacctccaacccgatcctgacacgcctcgcggtgtcgcggaacccgagcccgctggctgcggccaccgcggccccaggggtctgcctcctccgcttcgcctgggagtccgccgcgggctccctcgtcggcgccgccgttggctacggtaaaggtttggttacgatgaaggggattaaaggctcatttgctgatgctgcgtcatctgctaagatatttgctgttcttgctggtgttcaaagtttagtagcctgctctttgagaaaactacgtggaaaasatgatggawtcaatgc

SEQ ID NO: 8070 - protein, 137 aa, Zea mays
  misc_feature: Ceres CLONE 364965-F
  misc_feature (133)..(133): Xaa is any aa, unknown, or other
  misc_feature (136)..(136): Xaa is any aa, unknown, or other
MARGGGDRSREDDPFSDGGTTGTDSDESSPRGVGARGPGSTSNPILTRLAVSRNPSPLAAATAAPGVCLLRFAWESAAGSLVGAAVGYGKGLVTMKGIKGSFADAASSAKIFAVLAGVQSLVACSLRKLRGKXDGXN

SEQ ID NO: 8071 - DNA, 455 bp, Zea mays
  misc_feature: Ceres CLONE 364983-F
  misc_feature: Encodes the peptide sequence at SEQ ID NO. 8072
agtcgtccgccgccaccaattgctagcgcaatcctagccctagcccagcgcccctccctgcgtcttgctcggtagcgatggcgtcgttttctgaagcgcccccggggaacccaactgctggcgagaagatcttcaagaccaagtgcgcgcagtgccacaccgtcgacaagggcgccggccacaagcaaggtcctaatttgaatggtctgtttgggaggcagtctggtacaacacctggctactcttactcttcggctaacaagaacatggctgtgatttgggaggagaacactttgtatgactacttgcttaatcccaagaagtacattcctggaaccaagatggtattccctggactgaaaaagccacaggaacgtgctgatctcattgcatacctgaagaatgccactgtctgatgaggatgctgctgtggctctaaagatgaagagcagcga

SEQ ID NO: 8072 - protein, 112 aa, Zea mays; identical to SEQ ID NO: 4641
  misc_feature: Ceres CLONE 364983-F
  misc_feature (12)..(111): Pfam Name: Cytochrom_C Pfam Description: Cytochrome c

SEQ ID NO: 8073 - DNA, 452 bp, Zea mays
  misc_feature: Ceres CLONE 364992-F
  misc_feature: Encodes the peptide sequence at SEQ ID NO. 8074
accgcagccctagcgcgccgccaccttcaccttcccaggccgccgccgccgccgcctccattgctgctaaacccgcaaccatgggtcccgtgctgaagcgcccgaccccgggcacggtgcagtgcttcgggcgcaagaagacggccgtggccgtggcctacacgaagccaggccgggggatgatcaaggtgaacggcgtcccgatcgagctgctccgtcccgagatgctgcggctcaaggccatggagcccgtgctgctggcggggcggtccaggttcaaggacatcgacatgcggatccgcgtgcgcggcggcgggaagacgtcgcagatctacgccatccgccaggccgtcgccaagggtctcgtggcctactaccagaagtacgtggacgaggcggcgaaaaaggagatcaaggacatcttcatgcgctacgagcgcacctcctcgtcg

SEQ ID NO: 8074 - protein, 124 aa, Zea mays
  misc_feature: Ceres CLONE 364992-F
  misc_feature (17)..(121): Pfam Name: Ribosomal_S9 Pfam Description: Ribosomal protein S9/S16
MGPVLKRPTPGTVQCFGRKKTAVAVAYTKPGRGMIKVNGVPIELLRPEMLRLKAMEPVLLAGRSRFKDIDMRIRVRGGGKTSQIYAIRQAVAKGLVAYYQKYVDEAAKKEIKDIFMRYERTSSS

SEQ ID NO: 8075 - DNA, 790 bp, Zea mays
  misc_feature: Ceres CLONE 365003-R
  misc_feature (1)..(1): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (31)..(31): n is a, c, t, g, unknown, or other
  misc_feature (34)..(34): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (444)..(444): n is a, c, t, g, unknown, or other
ngtgtgtttcccttccccnnnnncttacaanatnaatttattacaccacaataatnnnccaaaatgggtacgggccccccctcgaggtcgacggcatcgatattgtttttttttttttttgaaaccaagaaaaccctgaatcgatttcacttaacttcaattctcacatgacatctgccctttcttgccaaccctctcttccttcgctttccggtcaacatatgttttggcggctatctcctgataccaccactaaaagcttgcatagctacgttacgtcctctgcttggacaatgtttgctaaaaggggcctgtaggtaactttaaaggggcccagacttggacgatgtgcaaaatggcttattggaattgaaccatcacgcactggatttttccgaggtataggacaattcctgtgcgatgcatgttcgttgtcccaataancaagtcaacgatcaatatgttgccacaaccccccacccccagggaaaaaggaatcctgtggttcctttaggaccatttttatctacatttgtctcccggccgaaagataatatagcatctttaataaatcccccttgccaaaaaaaattcctcctctcctccagttagcttcaaggattgagggactattacatacaccttttcaagatttacaccagtgataaggtactattcatcgcattggggagactgacccccgccatgttaatgctgccctgcagaggcgcatacgtgggatcctttcttgcggggacactgggcacacccccgacttatctaaccacac

SEQ ID NO: 8076 - DNA, 545 bp, Zea mays
  misc_feature: Ceres CLONE 365017-F
  misc_feature: Encodes the peptide sequence at SEQ ID NO. 8077
gcgcgaaccaactgttcgtttgcttttccgtcttcgtcctctcttttgcccagggccacttgtcgctcgcccgcccgcgtcgtcgtctccgccggccggccggccggcctcccaaaccctagcgaggcgagcgagagagaaactagacgccatgttcgggtacaggaaggcggacccggacctcgaggccggcgggtcctcgctgctgtacccggggatgacggagagccccgaactgcggtgggcgttcgtccgcaagatctacgtcatcctcacggtccagctcgccatgacggcagccgtctcggccttcgtcgtcaaggtgcccgccgtctccaacttcttcgtctcctccaacgccgggatcgcgctctacatcttcctcatcgtcctgcccttcatcgtgctgtgccctctgcactactaccaccagaagcatccgatcaatctgctgctgctcggcctcttcaccgtcgccatcagcttcgccgtcggcatgacatgcgctttcmactagcggaaaaatcattttggaggctgccatt

SEQ ID NO: 8077 - protein, 120 aa, Zea mays
  misc_feature: Ceres CLONE 365017-F
MFGYRKADPDLEAGGSSLLYPGMTESPELRWAFVRKIYVILTVQLAMTAAVSAFVVKVPAVSNFFVSSNAGIALYIFLIVLPFIVLCPLHYYHQKHPINLLLLGLFTVAISFAVGMTCAF

SEQ ID NO: 8078 - DNA, 474 bp, Zea mays
  misc_feature: Ceres CLONE 365083-F
  misc_feature: Encodes the peptide sequence at SEQ ID NO. 8079
agttttcggcggcgccggcgtgctcgtgatctcaacccaaggcgtgcctccgctccggtcacccgtcgctccacgcaaccatgtcgaggaggaagaccagggagcccaaggaggagaacgtcacccttggacccactgtccgtgaaggagagtatgtctttggtgtcgctcacatctttgcatccttcaatgacaccttcattcatatcactgatttgtctgggagggaaactctggttcggatcaccggtggcatgaaggtgaaggctgaccgtgacgagtcgtcaccttacgctgctatgcttgctgctcaagacgtcgcacagcgctgcaaggagcttggcattactgcactgcacattaagcttcgcgccaccggaggcaacaagaccaagacccctggacctggtgcccagtctgccctcagggcgcttgytcgttccgggatgaaaatcggacgcattggttaggaga

SEQ ID NO: 8079 - protein, 129 aa, Zea mays
  misc_feature: Ceres CLONE 365083-F
  misc_feature (28)..(129): Pfam Name: Ribosomal_S11 Pfam Description: Ribosomal protein S11
  misc_feature (119)..(119): Xaa is any aa, unknown, or other
MSRRKTREPKEENVTLGPTVREGEYVFGVAHIFASFNDTFIHITDLSGRETLVRITGGMKVKADRDESSPYAAMLAAQDVAQRCKELGITALHIKLRATGGNKTKTPGPGAQSALRALXRSGMKIGRIG

SEQ ID NO: 8080 - DNA, 446 bp, Zea mays
  misc_feature: Ceres CLONE 365115-F
  misc_feature: Encodes the peptide sequence at SEQ ID NO. 8081
acaaccgagcgaacaggagggagattaccgccatggcgaggagcctgcgtcccgtggtggacctccgcgtcaccaagaatcccgagccggccgaagaccctgcgccatcgcctatcgtctggccgaacgctttggcgccctcgtcctcctcgacacctcctccgtcgcgtccagccatccatcgatccgctgaccgccgggccaccgccgccatggggtttcatcgcgccgctataacacgtcaagagcaggtaccacaggatgaggcgcgtggaggatgctgtgatgagttcgtgagtggtctaggccgtcgtctcccagtcaactttgggttgctggaccgttgtctccttataatgtaattatttattttgtatagaactcctattatatagtaaagatgtgacattcgatcctgtgccatgattcataaaaaaaaaaaaaaa

SEQ ID NO: 8081 - protein, 109 aa, Zea mays; identical to SEQ ID NO: 7993
  misc_feature: Ceres CLONE 365115-F

SEQ ID NO: 8082 - DNA, 396 bp, Zea mays
  misc_feature: Ceres CLONE 365117-F
  misc_feature: Encodes the peptide sequence at SEQ ID NO. 8083
  misc_feature (390)..(390): n is a, c, t, g, unknown, or other
atttttttggctctggtcgtcacaaagttgtttgtgcatcgcggcggcgacaagggggcgacgaggcaggcggagcgggcggcgactacagcggcagcagatctcacggaatggcggcgaaggcaatctcgagccccgtgccggtggagtggtacccgacgctggccgtcgtcatggtatccgtaggcctcatgttcgccgcctccttcttcatttatgaagcaacttcatcccggaggagccgtagcctgtcaaaggagatcgcaacagcagttgttgcttctgttttcttgggctttgggtctctgttcgtgcttcttgcaagtggtgtttatgtctgatgactggctatgggccgtgtgtgcttgtgttctgcatcccgagttgtangacttg

SEQ ID NO: 8083 - protein, 76 aa, Zea mays
  misc_feature: Ceres CLONE 365117-F
  misc_feature (2)..(76): Pfam Name: UPF0197 Pfam Description: Uncharacterised protein family (UPF0197)
MAAKAISSPVPVEWYPTLAVVMVSVGLMFAASFFIYEATSSRRSRSLSKEIATAVVASVFLGFGSLFVLLASGVYV

SEQ ID NO: 8084 - DNA, 476 bp, Zea mays
  misc_feature: Ceres CLONE 365135-F
  misc_feature: Encodes the peptide sequence at SEQ ID NO. 8085
aaccgtgctttctcagaggcgggttggcttctcctcccccaccggttcgtgttcaggttctggttcgtgggcgagagggaagagatggcggcgtcggacgttgagtaccgttgcttcgttggcggcctcgcctgggccaccgacgaccactccctcaacaacgccttcagcacctacggcgaggtcctcgagtcgaagatcatcctggatcgggagacgcagaggtcccgcggcttcggcttcgtcaccttctccacggaggacgcgatgcgcagcgccatcgagggcatgaacggcaaggagctcgacggccgcaacatcaccgttaacgaggcccagtcccgcggcggccgcggaggcggcggtggcggatacggtggcgggcgccgtgatggaggcggctacggcggtggcggtggcggctacggaggtggtcgtggaggctacggcggcggcggtgggggatacggtggtgg

SEQ ID NO: 8085 - protein, 130 aa, Zea mays
  misc_feature: Ceres CLONE 365135-F
  misc_feature (10)..(81): Pfam Name: RRM_1 Pfam Description: RNA recognition motif. (a.k.a. RRM, RBD, or RNP domain)
  misc_feature (48)..(130): Pfam Name: GRP Pfam Description: Glycine rich protein family
  misc_feature: SWISSPROT Homolog: EC 5.2.1.8 Peptidylprolyl isomerase
MAASDVEYRCFVGGLAWATDDHSLNNAFSTYGEVLESKIILDRETQRSRGFGFVTFSTEDAMRSAIEGMNGKELDGRNITVNEAQSRGGRGGGGGGYGGGRRDGGGYGGGGGGYGGGRGGYGGGGGGYGG

SEQ ID NO: 8086 - DNA, 469 bp, Zea mays
  misc_feature: Ceres CLONE 365148-F
  misc_feature: Translation starting site: 96
  misc_feature: SWISSPROT Homolog: EC 3.4.21.97 Assemblin
aaaaaatctcccaaagacgccgtcgccgctcttgttgtttccgatcccaaaccccaaacacgctccaccggcacctccgctcccacaccacaccgatggcccgcacgaagcaracggcgcgcaagtccaccggaggcaaggcgccgcggaagcagctggcgaccaaggcagcgcgcaagtcggccccggcaaccggcggcgtgaagaagccgcaccgcttccgcccgggcaccgtggcgctccgcgagatccgcaagtaccagaagagcacggagctgctcatccgcaagctccccttccagcgccgggtccgcgagatcgcgcaggacttcaagaccgacctccgcttccagtcctccgccgtcgccgcgctgcaggaggccgcggaggcctacctcgtcggcctcttcgaggacaccaacctctgcgccatcmacgccaagcgcgtcaccatcatgcccaaggacat

SEQ ID NO: 8087 - DNA, 478 bp, Zea mays
  misc_feature: Ceres CLONE 365150-F
  misc_feature: Encodes the peptide sequence at SEQ ID NO. 8088
aatcacccccaggtcttcctctcgcgagttgcggtctcgcgcccccctccgccgaccgccgcctcctcacaaccgcggaagctgcttccctctccattggacgcggccagcttccatctctcggtcacctccctctacatcccacggccgctaccaccttccctctacctcacacggccgccggcctctccaaggtctgcacacggaaaaaccttgccacgagtcgccgacactccatcccggaagagctaacgaggtgactccccaccgcgcccatgggtgacagccagtactccttctccctcaccaccttcagtccgtcggggaagctcgtgcagattgagcacgcgctcacggctgtcggatccgggcagacctcgctcgggatcaaagctgccaatggtgtagtcattgccactgatttctggtcatggcaaccgtaactgaggaagttgctccggtcgtcaccgtctccgag

SEQ ID NO: 8088 - protein, 55 aa, Zea mays
  misc_feature: Ceres CLONE 365150-F
  misc_feature: SWISSPROT Homolog: EC 3.4.25.1 Proteasome endopeptidase complex
MGDSQYSFSLTTFSPSGKLVQIEHALTAVGSGQTSLGIKAANGVVIATDFWSWQP

SEQ ID NO: 8089 - DNA, 440 bp, Zea mays
  misc_feature: Ceres CLONE 365212-F
  misc_feature: Encodes the peptide sequence at SEQ ID NO. 8090
aactactctgtcgtcctcttgttccactgtttcccacccccaaaatactccaccaccgcacccactagggtttccgcaccggcattgcagaacctcgccgcctccaccctcaccacaccaccggcgatgtccacagcggcggcgcagggcggcagcgacaagccggcgctccggaggcccgtcttcaccaaggtcgaccagctcaggccgggcaccaacgggcacaccctcaccgtcaaggtcgtcagcgccacccccgtgcctgggcgcgcgcgcccaggcgcacccgccgccgccccatcccgcgcgccgcgcatcgccgagtgcctcgtcggggacgagaccggcgccatcgtcttcaccgcccgcaacgaccaagttgacttgctgaagcccaatgcgacrgtgatcttgcgcaatgccaaaatagacatgttcaa

SEQ ID NO: 8090 - protein, 104 aa, Zea mays
  misc_feature: Ceres CLONE 365212-F
MSTAAAQGGSDKPALRRPVFTKVDQLRPGTNGHTLTVKVVSATPVPGRARPGAPAAAPSRAPRIAECLVGDETGAIVFTARNDQVDLLKPNATVILRNAKIDMF

SEQ ID NO: 8091 - DNA, 438 bp, Zea mays
  misc_feature: Ceres CLONE 365222-F
  misc_feature: Encodes the peptide sequence at SEQ ID NO. 8092
agccgcgtacacataacacatctggtaagcgagcaccgagcagcaggtggtctcaacggtcgacgcgacaactttccttgtccatgcagcagatcactcgtcgtacgttccctatgctggctcctcctcggctccccctcgtcggggcgctcctgctgctcctcgccgtcgcgctcggcgcggtgccgtgcgagagcgccgcgctccgcctccgcggctccgtcgcctgcctcgactgcgacgaggaacacgatctctccggtgtggtcgtggcggtgaaatgcgccggcgacggcgacggcggcgcgggcctccacgcggcgcagaccgacgatcgcggcaacttcgacgtgaccgtgccagcagaagcgtcagcctcgggcgcgccgtgcgcggccagggtcctcggcgccacggagcagctctgcgcgccgtggg

SEQ ID NO: 8092 - protein, 118 aa, Zea mays
  misc_feature: Ceres CLONE 365222-F
MQQITRRTFPMLAPPRLPLVGALLLLLAVALGAVPCESAALRLRGSVACLDCDEEHDLSGVVVAVKCAGDGDGGAGLHAAQTDDRGNFDVTVPAEASASGAPCAARVLGATEQLCAPW

SEQ ID NO: 8093 - DNA, 437 bp, Zea mays
  misc_feature: Ceres CLONE 365296-F
  misc_feature: Encodes the peptide sequence at SEQ ID NO. 8094
aaaaacatttttcttctgacgttcaccccgagtgggcgaccgccgccgccgccgccgccgccccacgccaggtgcacagatcttcgtcgggcccttggccggcgacgaacgctcagcagattatcgggtatacatgcgcacaaccatgtcctttaccgggtccgcccctgccaatgatccctgcctcgccaagatcctgtccaagcaaggggacaacaaagttctctttgcggacaaggtattaaagttcacccaatctggaaagatgaaaagacgcatcctagtgatcacggactttgctctataccttgttgaccccgaggccaacatattgaagaggaggatagcacttgcagctgtggataagctatgcattagcaacctcagtgataacttctttgcgatcattgtgccgactgagtacgattgtttaatgg

SEQ ID NO: 8094 - protein, 97 aa, Zea mays
  misc_feature: Ceres CLONE 365296-F
MSFTGSAPANDPCLAKILSKQGDNKVLFADKVLKFTQSGKMKRRILVITDFALYLVDPEANILKRRIALAAVDKLCISNLSDNFFAIIVPTEYDCLM

SEQ ID NO: 8095 - DNA, 462 bp, Zea mays
  misc_feature: Ceres CLONE 365322-F
  misc_feature: Encodes the peptide sequence at SEQ ID NO. 8096
gaaaaaacgagtctgcggcccgcagtgcgagtacaagtgagcggccagcagtgcgaggacaggcatggcggctgccgggcggacgcgcggttgcggtggcagccatggtggcggtggcggcggcgctgcctctgctcgcgtgtggcggttacgcggagtgctacgactactgcttcaaggactgcatctccaaggacaagtccatgagagactactgcagctacgcctgcgacaagacctgcgcgcccgacgcccggcggcggcgccccgcggtcgtccccatgaactgccagctcgcctgcgtcagggagtcctgccaccgtcgccgcgcggctgatggcgacgacgacacgaagacgaaggcctgctacgggcagtgctacgacgaccsgcggctgcgagaccagtgccgccctgcmgaggcctctgcgcgcaggcggcggtgctggcgttgtcgggcgg

SEQ ID NO: 8096 - protein, 153 aa, Zea mays
  misc_feature: Ceres CLONE 365322-F
  misc_feature (130)..(130): Xaa is any aa, unknown, or other
KNESAARSASTSERPAVRGQAWRLPGGRAVAVAAMVAVAAALPLLACGGYAECYDYCFKDCISKDKSMRDYCSYACDKTCAPDARRRRPAVVPMNCQLACVRESCHRRRAADGDDDTKTKACYGQCYDDXRLRDQCRPAEASARRRRCWRCRA

SEQ ID NO: 8097 - DNA, 452 bp, Zea mays
  misc_feature: Ceres CLONE 365363-F
  misc_feature: Encodes the peptide sequence at SEQ ID NO. 8098
  misc_feature (423)..(423): n is a, c, t, g, unknown, or other
gtgctttcttagaggtgggttggcttctcctccccctccggttcgggtkcgggttcgtcaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggcgcccaacgccaacgccactccagtaagccgaagcgaggaggtggagacggtcacggtgggcagagtggcacgactctcgattccgcctcgctccanattgctgtgctcgcccactcactcactca

SEQ ID NO: 8098 - protein, 117 aa, Zea mays
  misc_feature: Ceres CLONE 365363-F
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (108)..(108): Xaa is any aa, unknown, or other
MAASDVEYRCFVGGLAWATDDHSLHNAFSTYGEVLESKIILDRETQRSRGFGFVTFSTEEAMRNAIEGMNGKELDGAQRQRHSSKPKRGGGDGHGGQSGTTLDSASLXIAVLAHSLT

SEQ ID NO: 8099 - DNA, 492 bp, Zea mays
  misc_feature: Ceres CLONE 365403-F
  misc_feature: Encodes the peptide sequence at SEQ ID NO. 8100
acacaaccaagctcgatcgatctcactctcagctggtcgctcactcttgcagctccacccttcactcagtcttaggctcttagctctaggctctagctagccgcgccactccttcgtgtagccatcagccttctcatcgccaccaatggccactgcgaggtccagaccccgaccgtcgtggcggccgaggaagcgccagtggtggacaccccgccgccggccgtcgtgcccgaggagtctgcccccgccgaggccgaggctgaggctgaggctgaggctgctgctcctgctgatcccgaggagcttcccgcggccgagcagcaggcagccgccgagcccgaggccgctgctcctgctggtgccgaggagcccgcggcggccgaaccggccgctgaggcggaggctgctgctcctgctggtcccgaggagactcctgcggtcgagcaggaggcagccgccgaggaggaggctgctgctgctcctcctgctggt

SEQ ID NO: 8100 - protein, 115 aa, Zea mays
  misc_feature: Ceres CLONE 365403-F
MATARSRPRPSWRPRKRQWWTPRRRPSCPRSLPPPRPRLRLRLRLLLLLIPRSFPRPSSRQPPSPRPLLLLVPRSPRRPNRPLRRRLLLLLVPRRLLRSSRRQPPRRRLLLLLLL

SEQ ID NO: 8101 - DNA, 402 bp, Zea mays
  misc_feature: Ceres CLONE 365454-F
  misc_feature: Encodes the peptide sequence at SEQ ID NO. 8102
atcaaatttaggtgagactgtgagagagtcccgcggcgcccacgcgcgcgacctgcgcgggagacccgatcgagccgaaaccgaaagcgaccgtacgccaccaggcctaccaaaacgacgcgagcccgtgcctctcccgtccccacttcggccttcccttcgcctccccgtccgtccgcccgtccgtccatccgccgcgcgctaaacttgggggaggtgcccagctggctggttcgccgctcggcgaacggtgatcgcgtggcccgtggcgacgctggggaggacggcggggggcacgcacggcacggccggctggcatgggttccgggacgtggcgcaaggcctacggcgcgctcaaggactccaccaaggtcggcctcgccaacttcaacagcgagtaca

SEQ ID NO: 8102 - protein, 28 aa, Zea mays
  misc_feature: Ceres CLONE 365454-F
MGSGTWRKAYGALKDSTKVGLANFNSEY

SEQ ID NO: 8103 - DNA, 270 bp, Zea mays
  misc_feature: Ceres CLONE 365479-F
  misc_feature: Encodes the peptide sequence at SEQ ID NO. 8104
agcactcatccattccatcatcccttgcaagtatagtctcggcggctctagaatacgatgggcaaggacgacgtgatcgagagcggcgctggcggcgagttcgctgccaaggactacacggaccctcccccggcgccgctgatcgacgcggctgagctggggtcctggtcgctgtaccgcgccgtgatcgccgagttcatcgccacsccytggcggttcctgtacatcacggtggccaccgtgatcgggtacaagcaccagacggacgcg

SEQ ID NO: 8104 - protein, 71 aa, Zea mays
  misc_feature: Ceres CLONE 365479-F
MGKDDVIESGAGGEFAAKDYTDPPPAPLIDAAELGSWSLYRAVIAEFIATPWRFLYITVATVIGYKHQTDA

SEQ ID NO: 8105 - DNA, 468 bp, Zea mays
  misc_feature: Ceres CLONE 365555-F
  misc_feature: Encodes the peptide sequence at SEQ ID NO. 8106
acacaaccaagctcgatccatctcactctccgctggtcgctcactcttgcagctccacccttcactcagtcttagtctcttattagctctaggctctagctagccgcgccactccttcgtgtagccatcagccttctcatcgccaccaatggccactgccgaggtccagaccccgaccgtcgtggcggccgaggaagcgcccgtggtggagaccccgccgccggccgtcgtgcccgaggagtctgcccccgccgaggccgaggccgaggccgaggctgctgctcctgctgatcccgaggagcttcccgcggccgagcagcaggcagccgccgaggcggaggccgcggctcctgctggtgccgaggagcccgtcgcggccgaaccggccgccgaggcggaggctgctgctcctgctggtcccgaggagactcctgcggtcgagcaggaggcagccgccgaggaggaggc

SEQ ID NO: 8106 - protein, 106 aa, Zea mays
  misc_feature: Ceres CLONE 365555-F
MATAEVQTPTVVAAEEAPVVETPPPAVVPEESAPAEAEAEAEAAAPADPEELPAAEQQAAAEAEAAAPAGAEEPVAAEPAAEAEAAAPAGPEETPAVEQEAAAEEE

SEQ ID NO: 8107 - DNA, 459 bp, Zea mays
  misc_feature: Ceres CLONE 365578-F
  misc_feature: Encodes the peptide sequence at SEQ ID NO. 8108
atccggtcccaaaagtagaaaagggcaagcgacgagcacagcacagcacgccttccgttttgggaaggcgaggagaggggaaccccggggagagttgggggatcggcggcggaggagatggaggagcgggagaagctcgtgtgcctggccaagcttgccgagcaggcggagcggtacgacgatatggtggaattcatgaagaatcttgctaggatggacgtggatatgagtgctgaagaaaggcatttgttctcagttggtttcaagaacactattggagcaaagagagcatcatggagaatcatttgttcacatgagcaaaaggtcgcagctgatcgtcagactggtgtgatgatagatgcctataagaagaaagtagaagaggaactaaggaaggtttgcaatgaagtattgtcagtcattgctattcactgccttcccttggccagtacgggtgaa

SEQ ID NO: 8108 - protein, 114 aa, Zea mays
  misc_feature: Ceres CLONE 365578-F
MEEREKLVCLAKLAEQAERYDDMVEFMKNLARMDVDMSAEERHLFSVGFKNTIGAKRASWRIICSHEQKVAADRQTGVMIDAYKKKVEEELRKVCNEVLSVIAIHCLPLASTGE

SEQ ID NO: 8109 - DNA, 284 bp, Zea mays
  misc_feature: Ceres CLONE 365638-F
  misc_feature: Encodes the peptide sequence at SEQ ID NO. 8110
atttttttggaagcccaagtccagagcgggtccaccccagttcatcctccacctgctccgccggctgctcttcttctcccctctcgctatatccccgggggccggggacctcacagccacatctctccactgctccgtccagcgcgtccacctcccaaacccctactcccccaggaagcaatggcttcccccacccagggccaggtcatcacctgcaaagcggcggtggcgtacgagccgaacaagccactcgtgatcgaggacgtgcaggtggcgccgccgca

SEQ ID NO: 8110 - protein, 34 aa, Zea mays
  misc_feature: Ceres CLONE 365638-F
  misc_feature (1)..(34): SWISSPROT Homolog: EC 1.1.1.1 Alcohol dehydrogenase
  misc_feature (5)..(34): SWISSPROT Homolog: EC 1.1.1.2 Alcohol dehydrogenase (NADP(+))
MASPTQGQVITCKAAVAYEPNKPLVIEDVQVAPP

SEQ ID NO: 8111 - DNA, 523 bp, Zea mays
  misc_feature: Ceres CLONE 365667-F
  misc_feature: Encodes the peptide sequence at SEQ ID NO. 8112
gtgctctctcagaggtgggctggcttctcctccccctcttaccaagtcctcctcgggttagggttccttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggcggtcgcggcggcggcggctatggtggcgggcgccgtgacggcggttatggcggcggtggcggctacggcggtcggcgcgagggtggtggtggcggctacggcggcggcrgcggcggctggagggactgatgtgtggcccat

SEQ ID NO: 8112 - protein, 140 aa, Zea mays
  misc_feature: Ceres CLONE 365667-F
  misc_feature (10)..(81): Pfam Name: RRM_1 Pfam Description: RNA recognition motif. (a.k.a. RRM, RBD, or RNP domain)
  misc_feature (48)..(135): Pfam Name: GRP Pfam Description: Glycine rich protein family
  misc_feature: SWISSPROT Homolog: EC 5.2.1.8 Peptidylprolyl isomerase
  misc_feature (135)..(135): Xaa is any aa, unknown, or other
MAAADVEYRCFVGGLAWATSNESLENAFASYGEILDSKVITDRETGRSRGFGFVTFSSENSMLDAIENMNGKELDGRNITVNQAQSRGGGGGGGGYGGGRGGGGYGGGRRDGGYGGGGGYGGRREGGGGGYGGGXGGWRD

SEQ ID NO: 8113 - DNA, 500 bp, Zea mays
  misc_feature: Ceres CLONE 365793-F
  misc_feature: Encodes the peptide sequence at SEQ ID NO. 8114
gcatcgaacaccaatggcattcttgcattgaaggaaccttccctccacctccaccgcccgagagcgagcggccggacggggttttggttgggcatggctgccccggcgatgctccaagtggtgatcctcgccgcggtcctccttctcccgttcctcagcgtgccgggcgccgaggcacagaccaagaagttctgcctcacgcagttcgccatcgctagccaggcctgcgccatcctgccacccaccagtcctgagcaccaccaccatcatcacgatgacgaggacaatgacgaggacaacgacgaagatgaggacgaagacgaggacaacgatgaagatgaagacgaggacaatgacgacgatagcggcggcgctcaagcacgggctcacgccggcgtgagctggcgggcgcccggagcgggagaccgagacggccggcgcgcgcggccccgcccgggaaataacgcgtcgtctattcgttgtcgcatggctgttgcgac

SEQ ID NO: 8114 - protein, 135 aa, Zea mays
  misc_feature: Ceres CLONE 365793-F
MAAPAMLQVVILAAVLLLPFLSVPGAEAQTKKFCLTQFAIASQACAILPPTSPEHHHHHHDDEDNDEDNDEDEDEDEDNDEDEDEDNDDDSGGAQARAHAGVSWRAPGAGDRDGRRARPRPGNNASSIRCRMAVA

SEQ ID NO: 8115 - DNA, 521 bp, Zea mays
  misc_feature: Ceres CLONE 365796-F
  misc_feature: Encodes the peptide sequence at SEQ ID NO. 8116
acactgcatcacaacacacgccagccagccatcgtcacactggtgagctctgcactctgcttagctccgagcttcagtgccttcgttgtttgctccacagtccacacacacacacgtccagctagctgcactgcaccaatggccgccgtcgaggtccaggtcccgactgccgctcccgtcgaggaggctgcccagctggccgccgcctccgccgtcgagaccccgaacgaggagaccgctgctccggcggtggagaccgaggtcgtcgtcgctaaggagccggagccggtggaggccgagactgagactgagaccaaggaggccgaggccgttgctgagccgaccgaggcagagcccaaggaagcagagccggaggccgccgcgccggcagcagagacggaggtcaaggaagcagagacggaggccgccgcgccggcagcagagacggaggctgctgctgccccggtcgaggctgctgagccggaratagccgccgagaccaaagaggtggcsgctgtgga

SEQ ID NO: 8116 - protein, 127 aa, Zea mays
  misc_feature: Ceres CLONE 365796-F
MAAVEVQVPTAAPVEEAAQLAAASAVETPNEETAAPAVETEVVVAKEPEPVEAETETETKEAEAVAEPTEAEPKEAEPEAAAPAAETEVKEAETEAAAPAAETEAAAAPVEAAEPEIAAETKEVAAV

SEQ ID NO: 8117 - DNA, 467 bp, Zea mays
  misc_feature: Ceres CLONE 365832-F
  misc_feature: Encodes the peptide sequence at SEQ ID NO. 8118
agagtgtctagctgagaacatggtgacctcaagcaagggcaaggtatgtgtaaccggggcctcaggctttgttgcctcttggcttatcaaacggctcctcgagtctggatatcatgtggtagggactgtcagggacccagcccacctttggaaattacctggcgctaaagagaggctgcaaatcgtgcgagctgatctgttggaagaagggagcttcgacagcgccgtgatggcctgtgagggtgtattccacactgcatcccccgtcctcgctaaacccgactctactagcaaggaggaaacgctcgttcctgcggtgaacggtactctgaacgtgctgagatcgtgcaagaagaaccccttcctgaaaagggtcgtccttacgtcttcgtcgtctgcggtgaggatcagggacgatggtggccagtccagcagtaacatctcgctggacgaaacgacatggagct

SEQ ID NO: 8118 - protein, 149 aa, Zea mays
  misc_feature: Ceres CLONE 365832-F
  misc_feature (7)..(135): Pfam Name: adh_short Pfam Description: short chain dehydrogenase
  misc_feature: SWISSPROT Homolog: EC 1.1.1.219 Dihydrokaempferol 4-reductase
MVTSSKGKVCVTGASGFVASWLIKRLLESGYHVVGTVRDPAHLWKLPGAKERLQIVRADLLEEGSFDSAVMACEGVFHTASPVLAKPDSTSKEETLVPAVNGTLNVLRSCKKNPFLKRVVLTSSSSAVRIRDDGGQSSSNISLDETTWS

SEQ ID NO: 8119 - DNA, 486 bp, Zea mays
  misc_feature: Ceres CLONE 365870-F
  misc_feature: Encodes the peptide sequence at SEQ ID NO. 8120
actctagaaccctagcgccccgcccgtcctgccgccgccgcagccgccatcgcacggccatgggtatcgatctcgtagccggcggccgcaacaagaagaccaagcgcacggcgcccaagtccgacgatgtctacctcaagctcctcgtcaagctctaccgcttccttgtgcgcaggacaaagagcaacttcaacgccgtgatcctcaagcgcctcttcatgagcaagaccaaccgcccgccgctctcgatgcgccgcctcgtcaggttcatggaggggaagggtgatcagatcgccgtgattgtgggcaccgtgaccgacgacaagaggatcagcgaggtgccggcgatgaaggtctgcgcgctcaggttcactgagacagcgagggccaggatcatcaatgctggcggagagtgcctcaccttcgaccagctcgcgctccgtgccccacttgggcaaaacacggttctgctgaggggtcctaaga

SEQ ID NO: 8120 - protein, 142 aa, Zea mays
  misc_feature: Ceres CLONE 365870-F
  misc_feature (12)..(142): Pfam Name: Ribosomal_L18e Pfam Description: Eukaryotic ribosomal protein L18
MGIDLVAGGRNKKTKRTAPKSDDVYLKLLVKLYRFLVRRTKSNFNAVILKRLFMSKTNRPPLSMRRLVRFMEGKGDQIAVIVGTVTDDKRISEVPAMKVCALRFTETARARIINAGGECLTFDQLALRAPLGQNTVLLRGPK

SEQ ID NO: 8121 - DNA, 444 bp, Zea mays
  misc_feature: Ceres CLONE 365879-F
  misc_feature: Encodes the peptide sequence at SEQ ID NO. 8122
aacggctcagtcaccaacccactcatcactcctcactcactcactcaaaacgaaagccagctcagctcagctctgctcagctcatctgctcacacctcacacccacaggccggccgccacagcaccgcggatagcagagcggcagctaggtcggtcgtcgtcgtcgtcgtcagccatgagcaaggacaagcaccacaagcacgagcaccacctgcggcgttgctgcgggtgcatggcgtcgtgcctcctggcgctggtcctcatcgtggccttcgtctcgctggtggtgtacctggcgctgcgcccctcgaagccgtccttctacctgcaggacctgcagctgcgcaggcccatctcgctgggcgacccgtcgctgacggcgtcggcgcaggtgacgctggcctcccgcaaccccaacgaccgcgtgggcatcttctacaagcg

SEQ ID NO: 8122 - protein, 89 aa, Zea mays
  misc_feature: Ceres CLONE 365879-F
MSKDKHHKHEHHLRRCCGCMASCLLALVLIVAFVSLVVYLALRPSKPSFYLQDLQLRRPISLGDPSLTASAQVTLASRNPNDRVGIFYK

SEQ ID NO: 8123 - DNA, 425 bp, Zea mays
  misc_feature: Ceres CLONE 365905-F
  misc_feature: Encodes the peptide sequence at SEQ ID NO. 8124
acaagtggcggcgggcatggcggtggcggcgttcccttcctgcggcgccttcgcccctccttgcctagtgagtacaaggagagccttctcctcggtggtggccatggcttccgcagcccccaggaagcccttcgcccctcctcgcgaggtacaccgccccgtggcgcactcgctgcccccgcagaagcgggagatcttcgagtcgctcgagtcgtgggcggcggacaacatcctggtgctcctcaagcccgtggagaggtcctggcagccgcaggactacctgccggacgccgcctccgagtccttcgacgacgaggtccgggagctgcgagagcgcgcccgggagatccccgacgactacttcgtctgcttcgtgggcgacatggtcaccgaggaggcgctgccgacgtaccagaccatgctca

SEQ ID NO: 8124 - protein, 136 aa, Zea mays
  misc_feature: Ceres CLONE 365905-F
  misc_feature: SWISSPROT Homolog: EC 1.14.19.2 Acyl-[acyl-carrier-protein] desaturase
MAVAAFPSCGAFAPPCLVSTRRAFSSVVAMASAAPRKPFAPPREVHRPVAHSLPPQKREIFESLESWAADNILVLLKPVERSWQPQDYLPDAASESFDDEVRELRERAREIPDDYFVCFVGDMVTEEALPTYQTML

SEQ ID NO: 8125 - DNA, 512 bp, Zea mays
  misc_feature: Ceres CLONE 365911-F
  misc_feature: Encodes the peptide sequence at SEQ ID NO. 8126
gatccagctttgctttgtggttgtagttgtagcgctagcttaattggtctgagctaggtgcactactggctagtcgtgcaggaagaggaaggaatataatggctgagcgggaggtcgcagcaggcgggacgacgacgggaggcgggctgtggcggaggtatgcgccgcacgtccagatggtgctggcgtagctgtgctacacgctcatgtacttcatcaccgaggccgccttcaaccaggggctcaacccctacgtctacatcacctaccgccatctgctcgtcgctgtcctcatctggcccttcgcctactacctggagaaggggctgaggcctaaaatgacgctcatgctgttcgtggaaatattcgtgctctcccttctcggggtgagcttaactctgaacatgtacttcgcgagcctgaagtacacgtccccaacgttcgtcacttccgtggtgaacaccatcggcctcgatgacgttccgtcatcgccatcatcctcaggatggaga

SEQ ID NO: 8126 - protein, 102 aa, Zea mays
  misc_feature: Ceres CLONE 365911-F
MYFITEAAFNQGLNPYVYITYRHLLVAVLIWPFAYYLEKGLRPKMTLMLFVEIFVLSLLGVSLTLNMYFASLKYTSPTFVTSVVNTIGLDDVPSSPSSSGWR

SEQ ID NO: 8127 - DNA, 404 bp, Zea mays
  misc_feature: Ceres CLONE 365945-F
  misc_feature: Encodes the peptide sequence at SEQ ID NO. 8128
ctagccgcactgcgctcatttctgcatccccctcccgccgcgccgcctcaccgccgccggagaagatgggtcgcgtgatccgcgcgcaccgtaagggtgcggggtccgtgttcaagtcccacacccaccaccgcaagggccccgcccgcttccgctccctcgacttcggcgagcgcaacgggtacctcaagggcgtcgtcaccgacgtcatccacgaccccggccgtggcgcgccgctcgccaaggtcactttccgccacccattcaggtacaagcaccagaaggagctctttgtcgcagccgagggcatgtacacgggccagttcgtctactgcggtcgcgtccgcacaaatcccgtgctcccccgtctgaaaaccctccccacctccggcggcggcggcggc

SEQ ID NO: 8128 - protein, 113 aa, Zea mays
  misc_feature: Ceres CLONE 365945-F
  misc_feature (11)..(90): Pfam Name: Ribosomal_L2 Pfam Description: Ribosomal Proteins L2, RNA binding domain
MGRVIRAHRKGAGSVFKSHTHHRKGPARFRSLDFGERNGYLKGVVTDVIHDPGRGAPLAKVTFRHPFRYKHQKELFVAAEGMYTGQFVYCGRVRTNPVLPRLKTLPTSGGGGG

SEQ ID NO: 8129 - DNA, 1841 bp, Zea mays
  misc_feature: Ceres CLONE 366005
  misc_feature: Encodes the peptide sequence at SEQ ID NO. 8130
  misc_feature (535)..(535): n is a, c, t, g, unknown, or other
ggatttttctgcgctcagcgtcttcctctgccgcacgtcggcaatagttctcctccctccagctcgccggcgttatcctctgcgccgctttggcttacaaaaatcctggctggcggtgtttatctcctcacggcgccgccctgggactcttcaaataccctgccgtgctctctctcttcaatgttcctctcgttccctgacgagctgccatggcgtccacgtctgtcgcggtatcctggctcctcgcccaggacggcactcggccctgcccctaccccaacttcctgcacgccatggagatttcttcaagctcgctccaacgccgctccttttccccaaccgcgccaggcggtctgtctccctgtgcgctcgatttagttcggtttcttccctggacgcgcgctctgcagcttgccggagcaccctgcgtcgcgcccgtgtgctttgcttcttgctcgccgagccctccccagctcgtggatctccctcgccggcgtcctctgctcctcctggttgctgaggcctctcctatggncgcgcgccgtgttggtctccggctcgcccctgctcatcttcccttggccgcgggcccttgccatgctcgccgagctccctctgctcttctctgctcgccgagattctccctggtgtcgtgctcctccccctcaccctgctcgctagtagccgtggcagctgagcggttcttcccccagcacatcctctaccctggtcggcgttcctctctctcctcatctccatggccggagctcccatgtgccgtgcgccctggttcttgcccccacgcgcgcctgcttccctgctcggattcagtcctgcgcgcagccgcttttcatctccctgctcagctcgctgcgccaaactgcccagcgccgcgcgcctggctcggccgtctctagctcgccttgctccctgctgctcgcccggtcgagctccctgatcgccgcgccgtgaattttcctgcgcgcgcgtgtctccttgcgcacgcccagcaccctggatttccggatctcgcgcgcccctggctcctctgttggtcgcgcggttgtttcttgcttcctgcgcgcgcgagctcgccatccattttgctcgcctctgcttccacccagaattcccatggccagagctttcccctagcccggatctcacccagtcgcccagctcggctctgtccatactccagctcgccccctctgtttgttctcgctactgggtcgggtctgctcggccgctgagtgtccgacccgctcttctgcacgcagttcgccccaactcctgtctgtagtggtcgccagtcgtcgaccctgctcggattccatctcgccagctcgctccagactcgatctcgtcgtcgttccgcgcgtcatcaagaatcccatgaatcgggtgaagacaaagctagcagcgcgatattccccaagcgctcgacaattgcctggatcgaaaaatcmctaccgatctcgkggattcgagtcagctattgaaacggtaagctgataaattatccaaaatagttcgatcgttgcataaattgatgtgctagttcgaggcgcattaaggtgctcgataaattgsgtaagtcacgaacctbtcgccgacttcacagttcttgcgattgtcgagccagattgagctatggcgaattatttcgctattttagtcacttagctgaattagtggaccgagtagaattttggtaggcatgtgtgatgttaaaatattttaatcacttataaagatgtagtataatttwttaacscraaaaaaaaaaaaaaaaaaaaaaaaaaaaaaaaaaaaaaaaaaagaaaaaaaaaaaaaaaaaa

SEQ ID NO: 8130 - protein, 235 aa, Zea mays
  misc_feature: Ceres CLONE 366005
  misc_feature (109)..(109): Xaa is any aa, unknown, or other
MASTSVAVSWLLAQDGTRPCPYPNFLHAMEISSSSLQRRSFSPTAPGGLSPCALDLVRFLPWTRALQLAGAPCVAPVCFASCSPSPPQLVDLPRRRPLLLLVAEASPMXARRVGLRLAPAHLPLAAGPCHARRAPSALLCSPRFSLVSCSSPSPCSLVAVAAERFFPQHILYPGRRSSLSSSPWPELPCAVRPGSCPHARLLPCSDSVLRAAAFHLPAQLAAPNCPAPRAWLGRL

SEQ ID NO: 8131 - DNA, 717 bp, Zea mays
  misc_feature: Ceres CLONE 366008
  misc_feature: Encodes the peptide sequence at SEQ ID NO. 8132
accggataaaaccgccttgcctgcgcactggtgcctgcggaaactgcgactcctcctcggtcctcgcagacgattcaccccgcaccgcgagcgaggagaggagcctggccgcgagggcgtcgacgctgatggcggcgtggtggcggaggaagatggtgccctgcgcgcgccgcgcctgggccgccctcgccgcgcggctccgcgcgcgtaagcctggcagtggtggcattctgaagctcaacgaggacgtgcagacttgcggctacaaggacgtccaggtgatgttcgacatgttgacatcggaactcgaggcagccgctcaagcccagaagccaccgacgtcgccgccccgcaaaggaggagcgctaccgcctgcatggcccggccggtcctcgtcggcgatcactgctgcacagtaggtacctgcgaacagtaccattagagaggcgtccgccgccccctgcccttcttccgtcagaaagagcgaaaaattgcagcgagaacaataagatgaggagtaagcgagagagagagagagaggctcccaaacatcgtgtttaggtgtgtagatagaggatgatatgaaccagtgctgaacactttttttcgcccatcggaagaagagagagcaagaggggttactttcaatcccaaggtgtatttttattttgtttcaatatgatccatgctggtttctggctaaaaaaaaaaaaaaaa

SEQ ID NO: 8132 - protein, 96 aa, Zea mays
  misc_feature: Ceres CLONE 366008
MAAWWRRKMVPCARRAWAALAARLRARKPGSGGILKLNEDVQTCGYKDVQVMFDMLTSELEAAAQAQKPPTSPPRKGGALPPAWPGRSSSAITAAQ

SEQ ID NO: 8133 - DNA, 489 bp, Zea mays
  misc_feature: Ceres CLONE 366010-F
  misc_feature: Encodes the peptide sequence at SEQ ID NO. 8134
gatagctaatttcgccatcacccgccggacagacacggaggtacaggagcgagggggaaagtgggatggtagtgggggcatcatcggtgtccggcgccgcggcttccggaggtacctctggtacggctccgccgcggaaggggaagtcgtgcaagggctgcctttactactcgtcagtgctcaagtcccgcggctacaacccaatctgcgttgggatcccccgttccatcccccaagttcctaactacgtggtggatgagcctaaggaggacgcgacagcgcaggggcatgatctcaggcggttcaggtacgggtgcgcgggttactccatattcgtgaacagggacggccaaggtggtgagggcgagggcaagacgttgttgccgtattgcaggggcctcgagttattggtggacagcagattggtcgagagaaaaccatccgcagctgaacaagctccagcacatgttacaaaggatgcagcagcta

SEQ ID NO: 8134 - protein, 141 aa, Zea mays
  misc_feature: Ceres CLONE 366010-F
MVVGASSVSGAAASGGTSGTAPPRKGKSCKGCLYYSSVLKSRGYNPICVGIPRSIPQVPNYVVDEPKEDATAQGHDLRRFRYGCAGYSIFVNRDGQGGEGEGKTLLPYCRGLELLVDSRLVERKPSAAEQAPAHVTKDAAA

SEQ ID NO: 8135 - DNA, 496 bp, Zea mays
  misc_feature: Ceres CLONE 366013-F
  misc_feature (446)..(446): n is a, c, t, g, unknown, or other
aattcgtaggatccaaacaggccttacacatctttctttaagtcttataacccagtcttgtgtgtgagacacaaggttcatcgcgtacaaaagtagtcacagacatatctcccctctgttccgagaagcaaacagaggccgaagccaaagatgacgaggactacgcagctcgtcgccgccatcgcggtttccttcctgtcagcggcggccgcgtccaacaccaccacgtcactccaaagcctcgtcgccgaagtgtcgcagtggcggatatccacctgggcggcggcgcggcggcggcgcatggcgtccggccgagcaccgtcgtggcgtgggcgctctccttcctggccgcgtccgtgtcgagcgccggcggcgtgggcggcgggtcgctgttcctgcccatcctgaacctggtggcggggctgagcctgaagcgcgccactgcntactcgtccttcatggtcaccggcggcgcggcctcgaacgtgctctacaa

SEQ ID NO: 8136 - DNA, 866 bp, Zea mays
  misc_feature: Ceres CLONE 366026-R
  misc_feature (840)..(840): n is a, c, t, g, unknown, or other
cctatcgttttgatgcggcgggatcttcattgtttcagctgcaggtatgggtgacagtgtcgaatcgccgcatctataggatgcacttccagagacaagtacatgcgtcgacattgtgacttgacattcacatttttgtgcactggcgcatagatttctcagagaatgagaatattcagctactcgtgacaaggcgagtttcacatgtgttacctccatgctactctataaatcatcatctccaggtattggcgagacaaccaagtatcctctcgactactgcaagggctcatgaaccgtgtacatgtctttggttcttatgacttactactcggttgctgcaccccttactggcttcatcacacttacaacgttcctcctgactccaaacccctagactatcacccctatgagatcaacgaagctcagttgcagattcctgagcaggctatagaccgctgctgtggcctctacgcctgcatcagttcgcacacagacaggaatgggtctcgtacaaatgagcgctccggattgcgacatgattccggggtgggttgaccactcttcagggtttatctcagatctggtggtccttgtctacccctaagggcattgctcgcctcatctgatctctcacgtgttattatacgtgcactgtgaggtacaaccattcttgcgccaggaataatccttgctgctatacgtcttgcatgtcacaactgtccagtgatatcgtaccttccatgaagagctgacactagtgaaccgggacacacattgcatctagttacctagaagtgcatttactgagtccatcaagacttaacttgcacttcacancgcatatggattggcctcccgattac

SEQ ID NO: 8137 - DNA, 459 bp, Zea mays
  misc_feature: Ceres CLONE 366037-F
  misc_feature: Encodes the peptide sequence at SEQ ID NO. 8138
aagcacaagtgcacaaccaacagcaaagaagagacgacgtcgatcgatcgatatctcagcaaccaagcaggtaggtaggcatggcggccgagaaggagggcgcggtggtgaccaagggccacgacgaggggatgaaggcggcggcggcgctgctggaggagttcgggctcccgccggggctgctgccgctggaggacgtgacggaggtggggttcgtgcgggccaccggctacttctggctcgcgcagcgcaagaaggtggagcaccggttccgcaagatcggcaagcaggtgagctacgacgtcgatatcgccggctacgtccgccgccgccgcggccctcccatctcacaaccacggcgccgtctcatcctacgtctccacctcctcctacgcgctcgcagcctccgccgccttcccycgcgcccgagctgcgttcgccgtcggcaccgtcttgtcg

SEQ ID NO: 8138 - protein, 126 aa, Zea mays
  misc_feature: Ceres CLONE 366037-F
  misc_feature (1)..(123): Pfam Name: DUF538 Pfam Description: Protein of unknown function, DUF538
  misc_feature (114)..(114): Xaa is any aa, unknown, or other
MAAEKEGAVVTKGHDEGMKAAAALLEEFGLPPGLLPLEDVTEVGFVRATGYFWLAQRKKVEHRFRKIGKQVSYDVDIAGYVRRRRGPPISQPRRRLILRLHLLLRARSLRRLPXRPSCVRRRHRLV

SEQ ID NO: 8139 - DNA, 456 bp, Zea mays
  misc_feature: Ceres CLONE 366068-F
acttgtgacagtttctcatacatcacagacaatgaataccaagaagaatgttgttctttgctgccttcttttcgtgctcgttctgcatgcagatcacgctctagccaagtgtggctatacaactcctttaattccattctgcaaagcgtggatgtgcaaggcggagtgttggacggaggctaagttaactggaggcaaagtcacgcaacagaagtgcatgagaggcgggatcaagggctggtgttactgcgaattctgcatttaattttgcaaaggagaaggatcaccatttctttgcttggtcttgccttggtcaataacttagtgtaataatgctagttaagtctctaggcagactaggctagatcgagttgtttgttgttggtagctaggcattgctagcgtctgctattgttttaagatattttattgttagttgaacaattatggcmaaaa

SEQ ID NO: 8140 - DNA, 691 bp, Zea mays
  misc_feature: Ceres CLONE 366078-R
  misc_feature: Encodes the peptide sequence at SEQ ID NO. 8141
ccgattgggtaccgggccccccctcgaggtcgacggtatcgatattttaatcctacgcaggtccagcaacgagctatgggatgttcttttctactgagcatccgtgtccattgccaccggtaagcaacaaccagatactggaacacaccccacagctgaacgtcctgcagtctagggctcgaggcgacaatgaataagaagctcctgtgtttctgcggttagcgtgaattctcaaactcgatgttcctgcgtgcgcaactgggaggaacacaagctcttcgtatgaccccagccttactgctcatctgcgcgccagctctgcgaaccgcaggtgctcacctcatcaaagatggaggctgattgcgactccgacacgaaaccggtctggaactccatggtgccctggtcgggctgcgcgaccatccccgtgacggagactctgaggagaagcttcttggcctggacgcccgacagggtcgagatcgcgcccctggagagcttgccggatatggtcctctacgaaggagaccaggtgtagaccggaactgagactcaccaagttctggcccaggttggatctacgaaggtcgcccgtgggccgtagtccaaccttgtaagaaggttgacggaggtaccgggaatgagcccccttccgaaaggggttcttgggaggaatccttaaacggggttt

SEQ ID NO: 8141 - protein, 62 aa, Zea mays
  misc_feature: Ceres CLONE 366078-R
MEADCDSDTKPVWNSMVPWSGCATIPVTETLRRSFLAWTPDRVEIAPLESLPDMVLYEGDQV

SEQ ID NO: 8142 - DNA, 414 bp, Zea mays
  misc_feature: Ceres CLONE 366149-F
  misc_feature: Encodes the peptide sequence at SEQ ID NO. 8143
actgcgactgtgagcttcgttcgttcagttcatccgtgttcttgtttgcgaggtcgagagagagaggatgtcgtgctgcggaggcaactgtgggtgcggctccggctgcaagtgcggcaacggctgcggagggtgcagcgccaagggcggcagcggcttccgcacctgcgccgtctgtaacgagaacggcctcgtccgatgccccgactgctcgccgccggacgtctgactgacggtccagatccgagaggtcacgacgtgataactattagatgcttccttcttcttcctagttccaaatttgagataagaaacgagccgtgtgtagttgttaatcttaattggtagctagtgttgattggttgctaaatatgaatatggccattttgtttttctaaaaaaaaaaaaaamaaa

SEQ ID NO: 8143 - protein, 53 aa, Zea mays
  misc_feature: Ceres CLONE 366149-F
MSCCGGNCGCGSGCKCGNGCGGCSAKGGSGFRTCAVCNENGLVRCPDCSPPDV

SEQ ID NO: 8144 - DNA, 409 bp, Zea mays
  misc_feature: Ceres CLONE 366161-F
  misc_feature: Encodes the peptide sequence at SEQ ID NO. 8145
gcagcccgctcagcaccccttaccggccgcgtcccaggcgcgccactgcttcccttgcctcgtcttccgctgcccggtccgcccggatcctccgcaggtcggcggccgcgtcgtcgtcggggctggagacgctcatgccgctgcacagcgcggtggcggccgcgcggcttaggtcctgcatcgccgttgacttctcctgctggagctcgctctcacaaggccaagttcatggagctactgccttaggagcgtgtgttcattctctgacttattggctgtcagtgctaaatggcgcataccaatttggaaacttgtgaacttccatagtagtttcgattttgtataaccttttgtttctggcaacgttgacaaaatttgatcagcagggatctttatgaatgcttttcaa

SEQ ID NO: 8145 - protein, 104 aa, Zea mays; identical to SEQ ID NO: 6881
  misc_feature: Ceres CLONE 366161-F

SEQ ID NO: 8146 - DNA, 479 bp, Zea mays
  misc_feature: Ceres CLONE 366219-F
  misc_feature: Encodes the peptide sequence at SEQ ID NO. 8147
aaaaaaaccctcaccaatggcggacctcgaaaccctagccacgcccgcccctgcctctgcctctgcctccaccaagaagaagaagaaacactccaagaagcacaaggccgccagtgacgcccccaccaatgtcaccgtcgacgcatcccttatgggcggttcctcctacgtcgcggccgcccccgtggtcggctacttcccctccgggtacgacccactcactaccgctgcgggggcggagtctgcccccggcacccagctcttccggcacgagaagcwtcccacctgggtggacctcgtggtccggagccccggcggcggacacgacttcgtcggccggagctatgccggtgaggccgccgtgccgcaggtctgcgactacgcgcttggcgtcyttgacaaggcctccggcactctcaggatcgtgcccatcgctggcaaawagattctgaggctagagccacatcttgaagtgcagc

SEQ ID NO: 8147 - protein, 154 aa, Zea mays
  misc_feature: Ceres CLONE 366219-F
  misc_feature (88)..(88): Xaa is any aa, unknown, or other
  misc_feature (127)..(127): Xaa is any aa, unknown, or other
  misc_feature (143)..(143): Xaa is any aa, unknown, or other
MADLETLATPAPASASASTKKKKKHSKKHKAASDAPTNVTVDASLMGGSSYVAAAPVVGYFPSGYDPLTTAAGAESAPGTQLFRHEKXPTWVDLVVRSPGGGHDFVGRSYAGEAAVPQVCDYALGVXDKASGTLRIVPIAGKXILRLEPHLEVQ

SEQ ID NO: 8148 - DNA, 437 bp, Zea mays
  misc_feature: Ceres CLONE 366246-F
  misc_feature: Encodes the peptide sequence at SEQ ID NO. 8149
atcttctcgcccagatccacaagtttcgtgggtagaggaggcactagatactgtgccagatcggggtctggtagtggcagttgggtgattacgacggagtgggatgggcctcctcgacaagctgtgggacgacaccgtcgcgggcccgcgcccggacaccggcctcggccgcctccgcaagcagcccgcgcgccccgccgccgttaagatcagtgatccggccggggacgctgcagcgctcgtgccgccctcgccggcttcgggtagcgaggagacgccggtgaaggtgacgcgcagcatcatgatcaagcgccccgcggggtacccgtcttcgccgaggagcgcggcaagcacgccgccggcctctccacttgggactaccccgcccatctcgccgtttgccggcgctggtggtcgcttcagaaggaaatcatcat

SEQ ID NO: 8149 - protein, 111 aa, Zea mays
  misc_feature: Ceres CLONE 366246-F
  misc_feature (7)..(111): Pfam Name: Auxin_repressed Pfam Description: Dormancy/auxin associated protein
MGLLDKLWDDTVAGPRPDTGLGRLRKQPARPAAVKISDPAGDAAALVPPSPASGSEETPVKVTRSIMIKRPAGYPSSPRSAASTPPASPLGTTPPISPFAGAGGRFRRKSS

SEQ ID NO: 8150 - DNA, 492 bp, Zea mays
  misc_feature: Ceres CLONE 366252-F
  misc_feature: Encodes the peptide sequence at SEQ ID NO. 8151
acatgtgcatctcagcagcactagcagtgacaaactcgaagcttgccttctagcttgtttacaccccaaaactaaaactagagtcggcggcggcaacaagcggtacgtagaggatgaagagcaggagcagcactctgttggtgatcctagttctccaggcccttctgctctctgcggctgtggccaaaggacctgcagggccgaagaagcagtgctggtgcggcgagtgcaccagctggtcgggcgtgtggacctgcgacgacctcctcaccaagtgcgccgccacctgcaagaactgcgtccccgtctccacggacaagggcgccaccaagtacagatgccgcgacttcctccccgaaaactgcggctgcaagatccactagagactcatccaatcaaccatggccacagccgatggacccttcttccatatgcatgctctcctccgtccgtccgcctagcttgctacaagcaggcgctaataagctagca

SEQ ID NO: 8151 - protein, 89 aa, Zea mays; identical to SEQ ID NO: 3974
  misc_feature: Ceres CLONE 366252-F

SEQ ID NO: 8152 - DNA, 494 bp, Zea mays
  misc_feature: Ceres CLONE 366253-F
  misc_feature: Encodes the peptide sequence at SEQ ID NO. 8153
agcaacaagaccgcgcccaatccaatctgcgctgcgctgcgaaaggccagaagagcacacacaacacaggtacagctagcgcgcgcgggcggtgcggggctgtctggcaattacgcagccttggcagcttgcaccaccgcgcaagctagcgctgacggagggaacaagggcttgcgcgcgcacgcagggaggggagggaacgcctgccgccgatcgcctggtggatctcccggcggcgggggaagcagcagagaggggacggccagcagcgcaaccaatggcgccgccggacgcgggtgcggcagcagcgtgcggcgcgcggtgggtgaggcgggacacgctgctgggcctcgcgctgggccagttcgtctcgctgctcatcaccgccaccggcttcgcctcctccgaactcgcccgccgagggatcaacgcgcccacctcgcagtcgctcctgaactacgtcctcctcgccgtggcctacggcggcgtcctcc

SEQ ID NO: 8153 - protein, 72 aa, Zea mays
  misc_feature: Ceres CLONE 366253-F
MAPPDAGAAAACGARWVRRDTLLGLALGQFVSLLITATGFASSELARRGINAPTSQSLLNYVLLAVAYGGVL

SEQ ID NO: 8154 - DNA, 439 bp, Zea mays
  misc_feature: Ceres CLONE 366299-F
  misc_feature: Encodes the peptide sequence at SEQ ID NO. 8155
agttacatatccagcggccacccgttcctcttcctcgtccgcctccaacgaccaccatccatcgccatggctggccccaccaccacgctcctcctcctgctgctgtgctccgccgcgctcgcgtccggcgccacggcggccgacgacagcggattcacgaccttcaaggtgttcttccacgacatcgtggcggggacgagcccgacggccatccgcatcgcgcagggggcggcgtccaacacctcgtccaccagcttcggcgcgatggtggccatcgacgacccgctgacgacaggccccacgcgcgccgcgggcaccgaggtgggccgcgcccagggcacctacacgtttgcggaccagcagacgttcggcctcctcatggtgatggacttcgtgttcacggccggggagcacaagggcagcacgctctccatcctcg

SEQ ID NO: 8155 - protein, 124 aa, Zea mays
  misc_feature: Ceres CLONE 366299-F
  misc_feature (9)..(124): Pfam Name: Dirigent Pfam Description: Dirigent-like protein
MAGPTTTLLLLLLCSAALASGATAADDSGFTTFKVFFHDIVAGTSPTAIRIAQGAASNTSSTSFGAMVAIDDPLTTGPTRAAGTEVGRAQGTYTFADQQTFGLLMVMDFVFTAGEHKGSTLSIL

SEQ ID NO: 8156 - DNA, 445 bp, Zea mays
  misc_feature: Ceres CLONE 366315-F
  misc_feature: Encodes the peptide sequence at SEQ ID NO. 8157
attttcgatttgtctcctgaagcaagcgcagcaatgccagctcttcccgcttttcccctcacccgccgcccatccgatgccagacgccgcggtcgcctcgtcctttccctcgtcgtcttcgttgctgtctccgccgccgcagccctcgcctacctatctttcccctctgccgggcggacatcgcccccggcggtccggacggaggtcgactgctgcaggggtatggagggcctcgagctctggggcccggcggtcaagtggggctcagaccaccgcctgccctccgccgccgcctgctgcgccgcctgcaaggccatgtgccctcaccctaaggacggggcctgccgctgcgactcgtgggtcttctgcggtgacgagcgcaaatgcaaggacaggctcggggagtgctggctgaagaaacagaaggatgtcatggcccctgctg

SEQ ID NO: 8157 - protein, 137 aa, Zea mays
  misc_feature: Ceres CLONE 366315-F
MPALPAFPLTRRPSDARRRGRLVLSLVVFVAVSAAAALAYLSFPSAGRTSPPAVRTEVDCCRGMEGLELWGPAVKWGSDHRLPSAAACCAACKAMCPHPKDGACRCDSWVFCGDERKCKDRLGECWLKKQKDVMAPA

SEQ ID NO: 8158 - DNA, 437 bp, Zea mays
  misc_feature: Ceres CLONE 366344-F
  misc_feature: Encodes the peptide sequence at SEQ ID NO. 8159
  misc_feature (342)..(342): n is a, c, t, g, unknown, or other
agtaggtcggtaggtatacgtgcacgtctcaccaacgcaacacaccgttgcctgtgaagcagcgcagcgcggagcggaagggtccagcgaccgcgactgatggggaggagcggcggcgagacggcggggaagaggcagcagttcgggagcatggaggagttctggggcttctacctgagccagcactccaagccgggcacgcggcggtggcacttcctcggcacgctggcctcgctcgcctgcgcggtgctcgcggccgccactggccgcgccgcggtcctcctcgcgggccccgttctcgggtacggcatggcgtggtacagccacttcttcgtggagggnvaccgccccgccacgttcggccaccccgtgtggtccttcctctgcgacctccgcatgttcctgctcatcctcaccggccgtatcgacgccgagct

SEQ ID NO: 8159 - protein, 112 aa, Zea mays
  misc_feature: Ceres CLONE 366344-F
  misc_feature (82)..(82): Xaa is any aa, unknown, or other
MGRSGGETAGKRQQFGSMEEFWGFYLSQHSKPGTRRWHFLGTLASLACAVLAAATGRAAVLLAGPVLGYGMAWYSHFFVEGXRPATFGHPVWSFLCDLRMFLLILTGRIDAE

SEQ ID NO: 8160 - DNA, 468 bp, Zea mays
  misc_feature: Ceres CLONE 366350-F
  misc_feature: Encodes the peptide sequence at SEQ ID NO. 8161
gctgaccaatgatccaatagccgccgccttgtggttgtgtcatatatgggggccgaccagtggccgtgggcgacgccgccgccgccggccctgctgcttctggccgcactactgccggcgctgctgctcgcgctgtggcgcctggtgtggcaaccgcgggccgtggcgcggtcgttcgcgaggcagggcatccgggggccgccctactgtttcctggccgggtccttgtcggaggcgaagcggctggcgcgtgcywgccggagaagggttccgcagctggacgtcgcttcacatgacatcatgcccatcttgctgccaccgttccaccgatgggtcgtcgagtatgggaggacattcctgtactggatcgggccaacacctgcaatcttctccgttgatttagagttgattaaggaagtgctcacagacaggacgggcctgtttgccaaggacttcatgatccccgtt

SEQ ID NO: 8161 - protein, 141 aa, Zea mays
  misc_feature: Ceres CLONE 366350-F
  misc_feature: SWISSPROT Homolog: EC 1.3.3.9 Secologanin synthase
  misc_feature (71)..(71): Xaa is any aa, unknown, or other
MGADQWPWATPPPPALLLLAALLPALLLALWRLVWQPRAVARSFARQGIRGPPYCFLAGSLSEAKRLARAXRRRVPQLDVASHDIMPILLPPFHRWVVEYGRTFLYWIGPTPAIFSVDLELIKEVLTDRTGLFAKDFMIPV

SEQ ID NO: 8162 - DNA, 474 bp, Zea mays
  misc_feature: Ceres CLONE 366364-F
  misc_feature: Encodes the peptide sequence at SEQ ID NO. 8163
aaaaaatacgtttcttttgttgcagataaccgtctcttcatcttcctcgtgcgcttccagtcaggcaaaggcggcggcacgcccccacgatcttgcgcgcgcgctggactcgcagccttgcatcgcaagctagttctttgggggcggattccccgattgcctgccattattctggcttggttcttgcctctgtttgggtactccggcgaatcgtctgagttggggactggtcctcctcctcctcccgatggggggctggaaccggtcgcggcatgtgagatggcagcgtgaccgcccgcggcgccctccgctccctccgcctgattacggaccggagcactgctcagtcccattatgggaaagggaattctgcagctacgtcggcaacatttcttggcaaaggttctgtgaaaacaagcggtatgcttcagtagacaataccctcgagcactgggacgattcaggagctcttga

SEQ ID NO: 8163 - protein, 75 aa, Zea mays
  misc_feature: Ceres CLONE 366364-F
MGGWNRSRHVRWQRDRPRRPPLPPPDYGPEHCSVPLWEREFCSYVGNISWQRFCENKRYASVDNTLEHWDDSGAL

SEQ ID NO: 8164 - DNA, 509 bp, Zea mays
  misc_feature: Ceres CLONE 366370-F
  misc_feature: Encodes the peptide sequence at SEQ ID NO. 8165
gagacgaacaacgcccgcgcagaggccgggggtagctagctagctcctccgatggccagccgcggtggcgcattcgtggtgttcgttgtcctgtgcagctcgctgctcgggctcgcgccgcggccgagcgcggccgggaagccgctcgtgccggcgatgttcgtgttcggggactccctggtggacgtcggcaacaacaaccacctggccagcgtcaacgacagctgcaaagcgaactaccggccctacggcgtcgactaccaccccgggcagtcaccgaccggccggttcagcaacggctacaacttggcggaccatctagcacgatggctgggctttgccgggagcccgccacctttcctctccctggcgaacgcgagggcgaggcacactcggcggacgacggtgagcacgggcggcatcaacttcgcgtccggagggtcgggtctcctccctacaaccggcgattctgtgtgcggcgggccggtggtttccatggccgagcagtc

SEQ ID NO: 8165 - protein, 152 aa, Zea mays
  misc_feature: Ceres CLONE 366370-F
MASRGGAFVVFVVLCSSLLGLAPRPSAAGKPLVPAMFVFGDSLVDVGNNNHLASVNDSCKANYRPYGVDYHPGQSPTGRFSNGYNLADHLARWLGFAGSPPPFLSLANARARHTRRTTVSTGGINFASGGSGLLPTTGDSVCGGPVVSMAEQ

SEQ ID NO: 8166 - DNA, 470 bp, Zea mays
  misc_feature: Ceres CLONE 366409-F
  misc_feature: Encodes the peptide sequence at SEQ ID NO. 8167
gttcatagatgccagtcctcccctccccaaaacccagcacaagcaagggaagggagggcacctctaggctccagccatggcgcagcagctgctgctcctcctccccgccccttccagaactttcttgaaggccctcccctctccctttctctcctacctcccccggcgccaccttgtccccgttaccgccgttcccgtagcacccggcatccggcggggcctgctccggtacgcgacgaagcgttcaagcttggtcgaagaactggagattgccaaggagaagcagccgcatagcaggcgcgccaatggcatcttctggatcttgctgctcaatttcggcatctacatggccgaccacttgttccagattcggcaaataaaatcactatacctgtatcatgcattcccttcatggttccagtttgtgacatcaacattttgccatgccaactggaatcatctttcaagca

SEQ ID NO: 8167 - protein, 131 aa, Zea mays
  misc_feature: Ceres CLONE 366409-F
MAQQLLLLLPAPSRTFLKALPSPFLSYLPRRHLVPVTAVPVAPGIRRGLLRYATKRSSLVEELEIAKEKQPHSRRANGIFWILLLNFGIYMADHLFQIRQIKSLYLYHAFPSWFQFVTSTFCHANWNHLSS

SEQ ID NO: 8168 - DNA, 484 bp, Zea mays; identical to SEQ ID NO: 6813
  misc_feature: Ceres CLONE 366422-F
  misc_feature: Encodes the peptide sequence at SEQ ID NO. 8169

SEQ ID NO: 8169 - protein, 141 aa, Zea mays; identical to SEQ ID NO: 6814
  misc_feature: Ceres CLONE 366422-F
  misc_feature (46)..(141): Pfam Name: NAD_binding_2 Pfam Description: NAD binding domain of 6-phosphogluconate dehydrogenase
  misc_feature: SWISSPROT Homolog: EC 1.1.1.60 2-hydroxy-3-oxopropionate reductase

SEQ ID NO: 8170 - DNA, 484 bp, Zea mays
  misc_feature: Ceres CLONE 366434-F
ccgctaccaccttcatccatccgtggcgtcggtbtcttgccctgccccagcgccgccgctccttcccccaccccgaagcgccgcctcytctgcctccgtcgacggtggtggtgctcctgatccccgccgttgaactggccataggagagcaaagaggaaggggaggccgcgagggcgccagtagatatattcatcttcatctcggcttgcgatatttttgaattttctattccgtattgaaggcgtcgatggccttgtccgccctaatcagcaccctcctcgccgccgccatctggtgcgccgcttacctcgccgctgccatctcctccgccttctgattcccactccccaaccctaacctcccccctgtagcacaccccacctctagctttgtaggtcctactatacttgcaacctctcccgctgactcgcttcgatctacccgccctcgcgtcaccatggggtacgcgcagctcgtcatcgg

SEQ ID NO: 8171 - DNA, 407 bp, Zea mays
  misc_feature: Ceres CLONE 366444-F
  misc_feature: Encodes the peptide sequence at SEQ ID NO. 8172
gtcccttccccctctcatcgctcgccgctcgctcctctccctgtccgcgccgcccgctctcgaatcgaaatccctctccgccatgccgaagggcgccaagaagcgcgccaaactcaagaagcagcagcagcagggtcaccccgacgatggcggcaacacaaacgccagcagcggcaatggtaacggcagcgataacaacaacaacgcctcgagcggccgcgacggcgacccccacctgtgcatcctaccaaaagtttctcgcgtggatgcgagcgaggactccatggagagctccgaagagatggtgacccccagggccgccgcgtcggagccggacgaggaggagaggaaggcccccgcggccgaggggcccgtggagcgtgccgtcgaggcggacgtcgccgggt

SEQ ID NO: 8172 - protein, 108 aa, Zea mays
  misc_feature: Ceres CLONE 366444-F
MPKGAKKRAKLKKQQQQGHPDDGGNTNASSGNGNGSDNNNNASSGRDGDPHLCILPKVSRVDASEDSMESSEEMVTPRAAASEPDEEERKAPAAEGPVERAVEADVAG

SEQ ID NO: 8173 - DNA, 473 bp, Zea mays
  misc_feature: Ceres CLONE 366447-F
  misc_feature: Encodes the peptide sequence at SEQ ID NO. 8174
gcagtctcgcatatcctccagtccggtagtccagtactccagtttccacgtaacccctcgctcttcttcagacttccatactaccccgttctcctctcctcttcccccaaatctgcgtgcgccgcggcaaccctagcccccgcgatccgctcgccggagcgaaggagggagccccgccggcgtccatggaggtgaagctgttgaacgacaagcgcgagcgggagctcctggagagctacgcggacctgtacgcgatcatcaaggtcacggagaagctggaacgggcctacgtccgcgacctcgtctcagccgccgactacgaggcggagtgcctcaagctcatctcccagttcaactccctctcctcctcgctcgccggcaccgtcgccgtcccgcgcttcgtccagccgtaccgtctcgattgccccgccgcgctcaaccgcctcctccagtcgggcgtcccggccaccgtc

SEQ ID NO: 8174 - protein, 96 aa, Zea mays
  misc_feature: Ceres CLONE 366447-F
  misc_feature (18)..(96): Pfam Name: VPS28 Pfam Description: VPS28 protein
MEVKLLNDKRERELLESYADLYAIIKVTEKLERAYVRDLVSAADYEAECLKLISQFNSLSSSLAGTVAVPRFVQPYRLDCPAALNRLLQSGVPATV

SEQ ID NO: 8175 - DNA, 359 bp, Zea mays
  misc_feature: Ceres CLONE 366451-F
  misc_feature: Encodes the peptide sequence at SEQ ID NO. 8176
ttcttctcctatccgcagcccaatcacgacgaaagagaagaggaagcctccgtccctgcctccccgctctgctcctcctcctcctccctatttaacccgtctccaccggccattgctctctcccttcccgaagtcgccggagccacacgcattcccctgcctcgcccttccccctcctatttaccgcccgcgtcgtcccccaacgcacgccttcccacccccgtgcctgcctctgcctgcctgctccccgacgccggggggccccacgactgacccagccccggccccgcgcggtcacagcaagccgggacatggcgcgcggcggcatcgcccgcctactcgccacgctcctcttcttc

SEQ ID NO: 8176 - protein, 119 aa, Zea mays
  misc_feature: Ceres CLONE 366451-F
SSPIRSPITTKEKRKPPSLPPRSAPPPPPYLTRLHRPLLSPFPKSPEPHAFPCLALPPPIYRPRRPPTHAFPPPCLPLPACSPTPGGPTTDPAPAPRGHSKPGHGARRHRPPTRHAPLL

SEQ ID NO: 8177 - DNA, 496 bp, Zea mays
  misc_feature: Ceres CLONE 366465-F
  misc_feature: Encodes the peptide sequence at SEQ ID NO. 8178
gactgcaatagaacatcctggccaacaccggtgagcgaagagaaacgattccatagtcgaagcgtagatcgcagcggagcagaggcatggatggaaagagctttagcaacgaacagcaagcccaacaaaagaacccagacgcagtgacaaacagtgttccgagccaaggccaggagcccttgaacacgtttccagtttcagacgatggaaacacgaacaccggtccgttgaatggccatgcagcagctcatgtgaacatggaagctgccatctctacggaggacgtcatacgggctggcgggttcggagcgaaggatgacattggcagcctcctcccgacggcaattgattccaccgattttgaggcctcgctgcgggatgcccgtggtttcgagggcgagaaagcggcgccgtcgcatcctggactagggtggaagggggagaaagctgatggtggaaccaaactggcagatgtggcggarcagtgatcacgctt

SEQ ID NO: 8178 - protein, 133 aa, Zea mays
  misc_feature: Ceres CLONE 366465-F
MDGKSFSNEQQAQQKNPDAVTNSVPSQGQEPLNTFPVSDDGNTNTGPLNGHAAAHVNMEAAISTEDVIRAGGFGAKDDIGSLLPTAIDSTDFEASLRDARGFEGEKAAPSHPGLGWKGEKADGGTKLADVAEQ

SEQ ID NO: 8179 - DNA, 837 bp, Zea mays
  misc_feature: Ceres CLONE 366498-R
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (18)..(18): n is a, c, t, g, unknown, or other
  misc_feature (21)..(21): n is a, c, t, g, unknown, or other
  misc_feature (409)..(409): n is a, c, t, g, unknown, or other
gggtgttgggnnnnnngnaantatacccactcctccgacgggatgaatgtagtgtggtgtgccgtgggtttgcccacccccccccaatgcgtaccgggccccccctcgaggtcgacggtatcgataagctttgttttttttttttttgggcaatcaaacaaaggccgaggcataaccacatgaacccagcaaagtgcagataaaaggtctgctgcactgaagtccatattacacctgggacgaaaatgcaaaagagaagagtatgttggtggtgtacaatgctttcaagaagggtgcccatgacccaatcctgctcaaagatctgccacggtacacagcatactgaaccctaaagtgttcagtaaactgatctacttgtcagcatgtcgccgcttgtatctcttgtggncatggttaccattactaccaccaggcccctttattcttttttggagcaaaaagtaccctaactaaaaagcctgtattacaatggaagacaggcacgaagccacgccaaacccccaaacccagggaaaccaaacctaacctccctttaagttgcgcaaaagaaattttgggtaataaccaagggctccccccccaccccgccacacccattgataggctttgcgcttcaacccccctgtcgaacacccaatcgggggcatcccccccccccttgagaaaaatggagccaatatatgccaagcaacatgcctcccccctaacgggacaaggcccctccgaacgaaaacccccaacatcttctccccacccaccgccgcttcaaagcacaactcccacccccacctcgcaaccacccggaagcgcccttaa

SEQ ID NO: 8180 - DNA, 1007 bp, Zea mays
  misc_feature: Ceres CLONE 366499
  misc_feature: Encodes the peptide sequence at SEQ ID NO. 8181
aggcccgtaccgaaaatcctcccacacgctgacgctggtgcccgttgctctgtcctctgttcgaaaaatttcctcttgttgagacctggggcatctctctctctcgcccccccccccccctgctcgcggcgcagcggagccgacgcgatgccgccgaggaggaaacggcgagcaccaccggccaagtcgcagaggcagacggagccggatccgcaaccgcaagtgccccctggcgccgacgcgccgctggaagagcggctgatatggggcagccaacaagaaagcgagcgccggattactgccatcaaagccataaaagacgcggaggctgggaacatacattaccagttgcaattggcacggtcctattattccgaggagcaattggagggaaacgccatgcagtattttcaggagaacttgcacaatctgtcggttgktccgaacgaggaatatgatgtgcttgagctgaaatggaataacggcgacgaatggatgattggagactttgcagatgacaggactctacgggcttcgattgcatcattcacagctgctgatggacttcagttcccaagggattcagacttytatacgcgcactagcaatttcagtgactttgcttggagtgagcagcctgaaggccaaatggcaggagcatcagaagcttttcagacacctggggctgtgagtaaccggctatcctgtggcatgacacccaaaactgtgaggctacccaagaatggtgagatgctcctatctgkgcatggttcacctcttggggtctataaagaagaaaatttagcagccattgaagaatytggtaacggaagtgaagatgctccctgataactcactgatatcacctgatggtgccagcctttgacaataacagtaatgcactttgaaattagtgtttaggtcactctgtattttgatgaaccctattgtagcatgccgacttttattcagctgacattattgtgctttcaaaaaaaaaaaaaaaa

SEQ ID NO: 8181 - protein, 233 aa, Zea mays
  misc_feature: Ceres CLONE 366499
  misc_feature (98)..(98): Xaa is any aa, unknown, or other
  misc_feature (148)..(148): Xaa is any aa, unknown, or other
  misc_feature (206)..(206): Xaa is any aa, unknown, or other
  misc_feature (225)..(225): Xaa is any aa, unknown, or other
MPPRRKRRAPPAKSQRQTEPDPQPQVPPGADAPLEERLIWGSQQESERRITAIKAIKDAEAGNIHYQLQLARSYYSEEQLEGNAMQYFQENLHNLSVXPNEEYDVLELKWNNGDEWMIGDFADDRTLRASIASFTAADGLQFPRDSDXYTRTSNFSDFAWSEQPEGQMAGASEAFQTPGAVSNRLSCGMTPKTVRLPKNGEMLLSXHGSPLGVYKEENLAAIEEXGNGSEDAP

SEQ ID NO: 8182 - DNA, 725 bp, Zea mays
  misc_feature: Ceres CLONE 366501-R
  misc_feature: Translation starting site: 459
  misc_feature: SWISSPROT Homolog: EC 2.7.11.1 Non-specific serine/threonine protein kinase
caattgggtaccgggccccccctcgaggtcgacggtatcgataagcttttttttttttttttttgaaacaaaacgatctggaacttcactggcagcacgagctagataagctcatggtcgtgtgtgctgtgatacaatttcaaacggctcgggctctctgctctaggcctctagcatacgcagcagctaaaaattgtaactgcaccggctcgttgctcatctttgagaggatagagcggttcatttcacttcagcgcacaactacacctacaataatggtagtacgagcacagtagtccagtcaatacagagcgtgctcgttcaaggcaagaaagcagcacacggccacgcacgcagcgccgagcaggcctggtaccagcgaacccctcactcctctgctccccgagctagtgcgcgccgacgacgacatcggagtgccaccgcctcggcaggcgccgatgccccgcagggcgctccggtcgtccaggcacagcccggagttcccgctcaggtcgaggttcccgccgaggcggcgcaggaacgcgccgtcgaacggcacggccccgccgagcgcgttgttgctgaggttcaggtggtacatcctgcccagccggctgagcgccgcggggatgggtcccgtcaggttgttgtcctgcagcgagagcgtcgtcaggctcgccagcttgccgaaagcgtccggtatcgggcccgagtagccggagccg

SEQ ID NO: 8183 - DNA, 503 bp, Zea mays
  misc_feature: Ceres CLONE 366521-F
  misc_feature: Encodes the peptide sequence at SEQ ID NO. 8184
agaatttcctcaattttcacgcgagcacctgtttgtatcgccggcggatcggatatattttctcggttcctgctactcctttctttctcgcctgcatccatggtctcgctgctccctcgcgctccctcactcgccttcctcgctaagtccgcctcctcgcagcggccgcctgcgccatccatgtcgtcgcccttctccgccgcttccgtggccgcggggtcagaggcggcagccggcacgaggaagctgcctgtgctcctgttcgacgtcatggacaccctcgtccgggacccgttctaccaacacatccccggcttctttcaaatgtccatgaaggaactactagaaagcaagcatccaacggcttggtcagaatttgagaaaggactgattgatgagaatgagatggccaaaaagttcttcaaggatggcagatcgtttgatttgcaaggttagtgcatggtgagagcatatgaatacattgatggcgtcgaagatattct

SEQ ID NO: 8184 - protein, 118 aa, Zea mays
  misc_feature: Ceres CLONE 366521-F
MVSLLPRAPSLAFLAKSASSQRPPAPSMSSPFSAASVAAGSEAAAGTRKLPVLLFDVMDTLVRDPFYQHIPGFFQMSMKELLESKHPTAWSEFEKGLIDENEMAKKFFKDGRSFDLQG

SEQ ID NO: 8185 - DNA, 444 bp, Zea mays
  misc_feature: Ceres CLONE 366545-F
gatcaggagaaccaaaggggtagtgaaggtggctacagtgctggtggctatgggcaagctcctccacaagctcctccttcgtatggtggtcctgcgggtgattatgcagcacctccgagctcctatggaggcaacaatgcttatggttcagattctgcagtgccgcctcctaatagctacagtggtggcccaggctcatacccaccaagctatggtgccccgcctccacaccaatatggtggtgccccaggggggcaagggggtctgcctcctacatatgatggtggatatggtggtcggtccatgcctgggggtggaggatctgggggtgcaccaccgccttatcatggtggcggcagcggttatactggtagtgctgaccctgaaccagctggaaaagttaagcagtgcgatgaaaattgtgacgagacatgtgacaacgca

SEQ ID NO: 8186 - DNA, 502 bp, Zea mays
  misc_feature: Ceres CLONE 366549-F
  misc_feature: Encodes the peptide sequence at SEQ ID NO. 8187
agcgtttcaacagtaatctctctgtgcctgcgacgacgactaggtgggttaccgccgtcgcgccgccgccgcctccgccgtcatactacaggtgcgaggccttcatcggtatcttaacaggcgacgaacaccaaccagtctgcactctacgatggcggcgcctccggccacggctcccgcggcctcccggtgtctctccggtgccaagtcgtgctgggctgctgagcggagctccagctcgtttgccgtctcggcgccttctactgacctccggcaaagtaggagccgcatcctcagcgtccgtgccamggttgccactggcgtgcagagagccagcactgtggatgatggagcaaaaaggccgtggaagctcagtgatgctcgtcttgtcctggaagatggttcagtgtggagggccaagtcttttggcgcttcaggaacacaagtcggtgaagttgttttcaacacatcactgacaggctatcaggagattttgacagat

SEQ ID NO: 8187 - protein, 117 aa, Zea mays
  misc_feature: Ceres CLONE 366549-F
  misc_feature (75)..(117): Pfam Name: CPSase_sm_chain Pfam Description: Carbamoyl-phosphate synthase small chain, CPSase domain
  misc_feature: SWISSPROT Homolog: EC 6.3.5.5 Carbamoyl-phosphate synthase (glutamine-hydrolyzing)
  misc_feature (53)..(53): Xaa is any aa, unknown, or other
MAAPPATAPAASRCLSGAKSCWAAERSSSSFAVSAPSTDLRQSRSRILSVRAXVATGVQRASTVDDGAKRPWKLSDARLVLEDGSVWRAKSFGASGTQVGEVVFNTSLTGYQEILTD

SEQ ID NO: 8188 - DNA, 466 bp, Zea mays
  misc_feature: Ceres CLONE 366571-F
  misc_feature: Translation starting site: 103
  misc_feature: Pfam Name: RRF Pfam Description: Ribosome recycling factor
acttactttgatacggcccttcgttcttatccacatccccttttgccagccactgctcccgtcccacccgccacaccgtccaccggcacgtccaccggctccatggcgctccacgccgtctcctccgcggcggtctcctccccgttgcgcgctctctcacgcagcctcccccagcgcccaggctgtggttgtttaccaaagcagtccgtcatgatttactccacaaaatttgcaagacctcaggctggaccggtggacttcgctggcaggcctctggttcttggacgctcggacaagagagcagttttgatgcatgccactattgaagaaatcgaagcggagaaatccctcatcgaagaccaagctaaagawaagatggagaaggcaatcgaaacagtccagctaacttcaacactgtgaggacaggacgtgcaaacccggccatgcttgaccggattgaggttga

SEQ ID NO: 8189 - DNA, 487 bp, Zea mays
  misc_feature: Ceres CLONE 366598-F
  misc_feature: Encodes the peptide sequence at SEQ ID NO. 8190
cctgcgcactgcttctccccacggcgcacgcgcaccatctcctgcgcgccgccagtccggcttctcctggctcctgcgcgccgccagccgtcagcccgtcaccgattggagatctttggaaacctgcgcgccgccagcccgtcaccgcttggagacccgctcagccgcgcttccctgcgcgccgccagccgtcgccgatccgtggccgcgtccgccgccgccagctctgaggtcgcgccgtcagccagcccgtctgccgtcgtgagcattgtttcaagtggttattaggcttcatggatatgtctcaagagcaagaacaggattttggcgtactgctgaagcaaggtgcagaagggagggtatttgcttcgacatttgtgggacgaaagtgtgtaatcaaagagcgtttttcaaaaaagtaccgacacccattgttggactcgaagttgactctaaagcgcttaaatgctgaagctcggtgcatgac

SEQ ID NO: 8190 - protein, 64 aa, Zea mays
  misc_feature: Ceres CLONE 366598-F
  misc_feature: SWISSPROT Homolog: EC 2.7.11.1 Non-specific serine/threonine protein kinase
MDMSQEQEQDFGVLLKQGAEGRVFASTFVGRKCVIKERFSKKYRHPLLDSKLTLKRLNAEARCM

SEQ ID NO: 8191 - DNA, 541 bp, Zea mays
  misc_feature: Ceres CLONE 366619-F
  misc_feature: Encodes the peptide sequence at SEQ ID NO. 8192
attccacccacccatcaccccttccttcctttccattctctgtcgccttcgcccctccaaggttctctgattccagacgcaaccctgcggctgcggggtcaaggagccagagggggtgcacagcgatcgttctgccggagatcgaaaccctcagctagggtctgaggcgccgggctgcggccgccgagatgtcgacgccggcgaggaagcggctgatgcgggacttcaggcgcctgcagcaggacccgcccgccgggatcagcggcgcgccgcacgacaacaacatcatgctctggaacgccgtcatattcgggccggatgatacgccttgggacggaggcacgttcaagcttaccttgcagtttacagaagattacccaaacaagccaccaactgttcggttcgtctctaggatgtttcatccaaacatatatgctgatggaascatctgcttggatatcctacagaaccagtggagtcctatatatgatgttgctgcaatcttgacttctattcagtcctgctgtgtgatccaaacccg

SEQ ID NO: 8192 - protein, 117 aa, Zea mays
  misc_feature: Ceres CLONE 366619-F
  misc_feature (8)..(114): Pfam Name: UQ_con Pfam Description: Ubiquitin-conjugating enzyme
  misc_feature: SWISSPROT Homolog: EC 6.3.2.19 Ubiquitin--protein ligase
  misc_feature (86)..(86): Xaa is any aa, unknown, or other
MSTPARKRLMRDFRRLQQDPPAGISGAPHDNNIMLWNAVIFGPDDTPWDGGTFKLTLQFTEDYPNKPPTVRFVSRMFHPNIYADGXICLDILQNQWSPIYDVAAILTSIQSCCVIQT

SEQ ID NO: 8193 - DNA, 485 bp, Zea mays
  misc_feature: Ceres CLONE 366664-F
  misc_feature: Encodes the peptide sequence at SEQ ID NO. 8194
gatcgcttcgctgtgttgcactgctaggtagccagctcgtttcctcccccaacccaaatgggcgactccaccgccaccaacccctcctcgccgaccgcagccatggatcccgactccgaggtcgtcttcgacttcccgccctacctctgccagtacaagagcggccgcatccaccgccccggcggcgcccccaccgtcccagctggcacggacccagccaccggcgtcgtgtccaaggacatccgcgccggccccgcctccgcgcgagtctacctccctcccggcgcagccggcaagatcccggtggtcgtctacttccacggcggcgggttcgtggtcggctcgccggcgcggccgggcacgcacaactacctcaacgacctggtcgcccgctcgggcgccatcggcgtgtccgtctactaccgcctcgcgccggagcacaagctgcccgcggcgtacgacgacgcgtgggcggcgctacggtg

SEQ ID NO: 8194 - protein, 142 aa, Zea mays
  misc_feature: Ceres CLONE 366664-F
MGDSTATNPSSPTAAMDPDSEVVFDFPPYLCQYKSGRIHRPGGAPTVPAGTDPATGVVSKDIRAGPASARVYLPPGAAGKIPVVVYFHGGGFVVGSPARPGTHNYLNDLVARSGAIGVSVYYRLAPEHKLPAAYDDAWAALR

SEQ ID NO: 8195 - DNA, 402 bp, Zea mays
  misc_feature: Ceres CLONE 366680-F
  misc_feature: Encodes the peptide sequence at SEQ ID NO. 8196
aaaaaaggagtaccggagacatcgtcaacgccatggccggaggaggtgcaacggtgtgcgtgaccggagccggcgggttcatcgcctcgtgggtagtgaagctcctgctctcccgcgggtacaccgtgcacggcaccgtccgccacctcagtgacgagaagacaggccacctgaagcgcctggagaatgctgccggaaaccttaggatcttcaaggctgacctgctggactacgacgccatggcagctgcggtcgtcgggtgccagggggttttccatgtggccactcctgtgccttcggaggacctgactgacccagagctacaaatgctgggtcctgctgttaccggcaccacgaatgtgctcaaagctgcytccagcgcgaacgtccagcgagtggtgg

SEQ ID NO: 8196 - protein, 123 aa, Zea mays
  misc_feature: Ceres CLONE 366680-F
  misc_feature: SWISSPROT Homolog: EC 1.1.1.219 Dihydrokaempferol 4-reductase
MAGGGATVCVTGAGGFIASWVVKLLLSRGYTVHGTVRHLSDEKTGHLKRLENAAGNLRIFKADLLDYDAMAAAVVGCQGVFHVATPVPSEDLTDPELQMLGPAVTGTTNVLKAASSANVQRVV

SEQ ID NO: 8197 - DNA, 658 bp, Zea mays
  misc_feature: Ceres CLONE 366690-R
  misc_feature: Pfam Name: ABC2_membrane Pfam Description: ABC-2 type transporter
  misc_feature (658)..(658): n is a, c, t, g, unknown, or other
cgaattgggtaccgggccccccctcgaggtcgacggtatcgataagcttttttttttttttttttatctcccaaacatatacatatatatattcgtatccaacctaattcgaatcgatgtttcgtggagaaaatcacgaaaaggaaggaggagaatgaggtgaaattcaaacgagcggagtactatttgcagtttgcttgcatgccaatggccgccactggcatggtttcccgcctttctcccgtactcacctccccgtgcggtggcacctgaaggagaggatgacgaagcagagcaccctgtacccgaccacgaagccgagcatgacgcccaggttgctccaccgcatgccctccctcatcccctgctgccgcagcagccccgcgccgtcgagcacgcagagtccccccgcgccgccggccgaggcgaggcactccctggctccgcgcgcgccgccgtactcgttcaccaccagggcctcgaacgggtacttgaacaggctggcgtagtgcatgaacacccagtagcgcgggatgttcttgctcgccacgaagtatccggagaagaggaagaagcagccgatgagccccgcgacgatggagttccccacgatgtagttgggcgccagcgcgctgaggcaggcgacgaaggagttggn

SEQ ID NO: 8198 - DNA, 495 bp, Zea mays
  misc_feature: Ceres CLONE 366706-F
  misc_feature: Encodes the peptide sequence at SEQ ID NO. 8199
acacttcactcccaccgatttgatttctccctcatcctccgcccgcctcgccgcggccaccgcttcctccatgtccgcgcccgtgggccggcttctactgctggtctccgctgtcgcggtaggcctggcgctccccgtggcggccgagatcaagaaggagtccttcagggaggacccgcgctcgtccatcatgttcgagaaattcggcttctccaggtccggcgaggtccggatcaccgtgtcgggcgcctcagtatcctcccccgtcgcgcgggccgacctcaagcagctcgggttcttcctcctctccgacgagtccctcctccacgccatcgacgaggcgcgggaggaggggccgacgccggagaagctcgtcgcggcgagcgacgacgaccccgacgatggtgccgggtgcgtgctcgacagccccagcccctacgtgaggaagctcttcaccttcaagaacatgaagggcggccacyacaacaggtcctt

SEQ ID NO: 8199 - protein, 141 aa, Zea mays
  misc_feature: Ceres CLONE 366706-F
  misc_feature (138)..(138): Xaa is any aa, unknown, or other
MSAPVGRLLLLVSAVAVGLALPVAAEIKKESFREDPRSSIMFEKFGFSRSGEVRITVSGASVSSPVARADLKQLGFFLLSDESLLHAIDEAREEGPTPEKLVAASDDDPDDGAGCVLDSPSPYVRKLFTFKNMKGGHXNRS

SEQ ID NO: 8200 - DNA, 367 bp, Zea mays
  misc_feature: Ceres CLONE 366742-F
acaccaaatggggcgaccgcctgccgccggggagcattcaatcgtcggcggcacaccgtcccccattcttcccgttccccaacgtgaagtggcaccatggtcgccactcgccacgctctcgccgcaggagcaggagcagcgactgcgggccagccagcctccggttgggtagctgttctgcgcaacagtccgaggggcgcggatggaggagggaccaaacaggagcggaggggaaggcgggcggtacaactgatgagccggtacctgttctacgatggcggtcgcttcagacacgaaagawgttcttgcgagggacatgctgatcatcgccttcgagtaagatgctccaaccatgagggagcatagg

SEQ ID NO: 8201 - DNA, 484 bp, Zea mays
  misc_feature: Ceres CLONE 366756-F
  misc_feature: Encodes the peptide sequence at SEQ ID NO. 8202
acgagcctcaccagcgccggcgctgtagtgtgcagccctcgctccttctggatctctgcacccttcgccacacttcgggggcgcgcgcgcggacatggaggtcgaataccacgaggagtacgtgcggagctcgagaggcgtgcagctcttcacctgcggctggctgcccgctgccgcatcgcccaaggcgctcgtcttcctctgccacggctacggcatggagtgcagtggcttcatgagagaatgcggcgtgcggctggcggcggccgggtacggcgtgttcgggatggactacgagggccacggcaagtcgatgggcgcgcgctgctacatccgcagtttccgccgcctcgtcgacgactgcggccatttcttcaagtccgtctgcgagcttgaggagtaccggggcaagagccggttcctgtacggcgagtccatgggtggcgcggtggcgctgctgctgcacaccgaggacccgccttct

SEQ ID NO: 8202 - protein, 130 aa, Zea mays
  misc_feature: Ceres CLONE 366756-F
  misc_feature: SWISSPROT Homolog: EC 3.1.1.23 Acylglycerol lipase
MEVEYHEEYVRSSRGVQLFTCGWLPAAASPKALVFLCHGYGMECSGFMRECGVRLAAAGYGVFGMDYEGHGKSMGARCYIRSFRRLVDDCGHFFKSVCELEEYRGKSRFLYGESMGGAVALLLHTEDPPS

SEQ ID NO: 8203 - DNA, 509 bp, Zea mays
  misc_feature: Ceres CLONE 366764-F
  misc_feature: Encodes the peptide sequence at SEQ ID NO. 8204
acaggaaaagaaagggcatatcgaggaggtttttagggtggtggtggtgttgtgaggagctgctgccgctgctctccagtctccaccgatggcgatcaagaacatgacggtggcggcgacgacgcggtcgctggacgcggacatgacggtggacgagttcaaggagtggctgcggcggttcgacacggaccaggacgggcgcatcagccgcgacgagctgcggcgcgccctgcgtgccatccgctcccggttcacggggtggaggagcaggcagggcatcagttacgccgacgctgacggcgacggctacatcgacgacagcgaggtcgatggcctcatcgagttcgcgcagaagaacctcggcctcaagatcgtcgcctactgatctcacatggggcgcggcgcgcggcggtcggggggtgggacgcactagctcgccatgagctagctatagcgacaatgcaactcaccatcactctctccggctaaaataagagctgcttgatctg

SEQ ID NO: 8204 - protein, 98 aa, Zea mays; identical to SEQ ID NO: 7295
  misc_feature: Ceres CLONE 366764-F
  misc_feature (23)..(51): Pfam Name: efhand Pfam Description: EF hand

SEQ ID NO: 8205 - DNA, 489 bp, Zea mays
  misc_feature: Ceres CLONE 366781-F
  misc_feature: Encodes the peptide sequence at SEQ ID NO. 8206
agaaacgaaattaggaaagggtaagagaagaaaaaggaaggagattagacgtacacgacaaagagacgaagacagtgtggaggggaggcagggtagcccccgcggcgcgctccgctcgaaatccccaaaaaggcaagatcaaatcaaatcagatctctccacccccagcccatccatggcgatcgtgtacgccctggtcgcgcggggcacggtggtgctggccgagttcgccgccgtctcgggcaacgccggcgccgtggcccgtcggatcctcgagaagctgccgcccgacgccgagtccaggctgtgcttcgcgcaggaccggtacatcttccacgtcctccgatccgacgccgccggcatcaccttcctctgtatggccaacgacaccttcggaagaaggatcccctttctctacctggaggacatccaaatgaggttcatgaaaaactacggcagagtcgccactctgcgctggcttacgccatg

SEQ ID NO: 8206 - protein, 104 aa, Zea mays
  misc_feature: Ceres CLONE 366781-F
MAIVYALVARGTVVLAEFAAVSGNAGAVARRILEKLPPDAESRLCFAQDRYIFHVLRSDAAGITFLCMANDTFGRRIPFLYLEDIQMRFMKNYGRVATLRWLTP

SEQ ID NO: 8207 - DNA, 223 bp, Zea mays
  misc_feature: Ceres CLONE 366796-F
  misc_feature: Encodes the peptide sequence at SEQ ID NO. 8208
  misc_feature (157)..(157): n is a, c, t, g, unknown, or other
agcacccctattcctcgagactgccccctcccctccacgaattctccttccaaatgcatatacaccgccacgatttcgtaccaccacgaccacccatctcaccgatctcctgctcatggacgccgacgatccctccgccgccaccgcttcctcctcngacgaaaccttcttcgatgyccttgactcgctccsctccccgtcgccttcgccttccccttccctt

SEQ ID NO: 8208 - protein, 36 aa, Zea mays
  misc_feature: Ceres CLONE 366796-F
  misc_feature (21)..(21): Xaa is any aa, unknown, or other
  misc_feature (26)..(26): Xaa is any aa, unknown, or other
MDADDPSAATASSSDETFFDXLDSLXSPSPSPSPSL

SEQ ID NO: 8209 - DNA, 476 bp, Zea mays
  misc_feature: Ceres CLONE 366888-F
  misc_feature: Encodes the peptide sequence at SEQ ID NO. 8210
gccacgccacgcacttggtccacacgtcgtattcggatgaagcatgagagagaagagcaagaaagacttcgtcacgtcaggtcgacggcgaaagacgcggaggttggtgaaggagtgaaggaagaaagagaacgaaaggcggcctctcactcgcagtcgcagtagcaggttctagaccaccaaacccagcggctcccgctcatctcagttcggcttcggccttcgcattcctctacagatttcgcagttttgctgggggtaactacggaatggggggcggatccggatctttcctcaaggtcttggtcaacaacatggatgtcctcgcggggcctttggtttcacttgcgtatcctctgtatgcctctgttagagcaattgaaacaaaatctgctgtggatgatcagcaatggctcacgtactgggtgctgtactcatttatcactctattcgagctcacctttgctccggtactc

SEQ ID NO: 8210 - protein, 69 aa, Zea mays
  misc_feature: Ceres CLONE 366888-F
  misc_feature (9)..(69): Pfam Name: TB2_DP1_HVA22 Pfam Description: TB2/DP1, HVA22 family
MGGGSGSFLKVLVNNMDVLAGPLVSLAYPLYASVRAIETKSAVDDQQWLTYWVLYSFITLFELTFAPVL

SEQ ID NO: 8211 - DNA, 751 bp, Zea mays
  misc_feature: Ceres CLONE 366894-R
  misc_feature (38)..(38): n is a, c, t, g, unknown, or other
  misc_feature (39)..(39): n is a, c, t, g, unknown, or other
  misc_feature (44)..(44): n is a, c, t, g, unknown, or other
  misc_feature (75)..(75): n is a, c, t, g, unknown, or other
  misc_feature (76)..(76): n is a, c, t, g, unknown, or other
aggggccccccactatcccccacccccccataaaatannaacanggttgggggtggggtgggtttgcccccaaannatacaaatgttaatgggtttctttcgagtcgacgttttccataaggttttttttttttttttttttccccatataattgaggtgtatatataataatacagataaaatttttattataaacttagtataacataccaccaacgtgttaattaaccaatttgatcgatgggtccaaataaagtatgaccggaccacttgaaaaaaagtggggaataacgaacgaatatgcatgcagacacaaggagagtgtgccttgttttttgggtgatatctgaggactgccccccccctattagtagaattgaatgaaaagtgcatctgtgtgtgtttctcgatagagtgttaaaagagagttggatgacgatttgtactaccgacctcctgcccccaccccccctgtttggttaattgtaagttacaagaattccccggtgaactcattctccaatgccccaccgtagatgcccccatcccccccccccctcacttcccccgagacctccacccacatacgccacaaccgataaccaccgtcctcccaaatcatataacccttgtaaaccctcaacactacaatataacgcattttcctggtgctttgcaactctggcggcgattgttcgaggctacctgcggacccggccagttcactcctctccttgtctactctccctg

SEQ ID NO: 8212 - DNA, 884 bp, Zea mays
  misc_feature: Ceres CLONE 366894-R2
tcgaggtcgacggtatcgataagcttttttttttttttttttcccatgaatataattgaggtgtatatataataatacagataaaacccttattataaacacagtataacataccaccaacgtgttaattaaccaacttgatcgatgggtccaaataaagtatgaccggaccacatgaaaagaagtggggaataacgaacgaatatgcctgcagacacaaggagagtgtgtcttgttttttgggcgatctctgaggactgaggtaatagtagcagtagtagtgaatgaaaagtgtatctgtgtgtgtctgtcgatcgagtgtcgagtgagtgttggacgacgacatgcaccaacgacctcctggccgtacgtcgcgcgtcggcgtagtcgtacgtcagaggaagtcgacgctgaactcgttctccagcgcgctgcgggcgaggtcgaagcaggaacccggcaggtcccgcgacatggacccgtatcgggaagcccgcaataccgccgccgacgttgtgatcatggagccctccccgccgggtggtgctgccaggggctgtaccttggccgcgtcgacaaactgatacgcccgccgcctcggtggcatcccggcccaaacatggccccgtgaggggggcatcggttccgcgccgctgccagcccaggtgcccgtgccctttctgttgctggaattgtctcccccggcgccccccatctgtgtcggggcgcttgtaccccatgggcgcgcacctagacacactcaaccccccccgcccccgaatccccaaagcggcccccgcccttaccgtaaccaacctaaagaccccctctgcatttcccggcggacctttctgtaccgacactgggtctaaaattgggcgtcg

SEQ ID NO: 8213 - DNA, 467 bp, Zea mays
  misc_feature: Ceres CLONE 366918-F
  misc_feature: Encodes the peptide sequence at SEQ ID NO. 8214
cacacagctcaacaaaggagcgcggcggccctcattccttcctcccacttctctcgcgctgcgctcgcttacctcgcttcgcattccgttcgagcaggggagcggccgtgagaagggaagggagggaattaaggcaagatgttcatcgagagcttccgcgtcgagagcccccacgtgcggtacggcccgacggagatcgagtcggagtaccggtacgacacgacggagctggtgcacgaggccaaggacggcgcctcccgctgggtcgtccgccccaagtccgtcaagtacaacttccggaccascaccgccgtccccaagctcggggtcatgcttgtggggtggggaggcaacaacgggtccacgctgacggctggggtcattgccaacagggaggggatctcatgggcgaccaaggacaaggtgcagcaagccaactactacggctccctcacccaggcttccac

SEQ ID NO: 8214 - protein, 109 aa, Zea mays
  misc_feature: Ceres CLONE 366918-F
  misc_feature: SWISSPROT Homolog: EC 5.5.1.4 Inositol-3-phosphate synthase
  misc_feature (56)..(56): Xaa is any aa, unknown, or other
MFIESFRVESPHVRYGPTEIESEYRYDTTELVHEAKDGASRWVVRPKSVKYNFRTXTAVPKLGVMLVGWGGNNGSTLTAGVIANREGISWATKDKVQQANYYGSLTQAS

SEQ ID NO: 8215 - DNA, 715 bp, Zea mays
  misc_feature: Ceres CLONE 366920
  misc_feature: Encodes the peptide sequence at SEQ ID NO. 8216
actggcgaccacctccaccccgctacggatacgcgacatcccggccgcggctgctgcgtcggaaggcggcggcactcgcgccacgcatgtggggcgaaactattaaaagggcgggcggggttccgtgaggtggggagaaagggcgggtggggagggaccggatccggtggcgcttgcgagaagggtggggggagggagttaatggcggcaatcgcgcggagtttcccttcaccttctccttctccttcgcccagtgaaggctggagggggacctcgcgggcggcggtggatgacgatgagcgccgaggggttgtggtcaggtcgtggaacctgaaggcgatctggctacacggcgcggcgggcgagggcggagcagtagatcagacggatgaaagaacagcggtggagacgaatgttcagtctgggcattattggtgtggtgtgtggacacatgtgatgatatgtgatggcgatagtaggtgcgctaatccgtggttgtttactggagtaggcagtgtgttttattgttagaaataatctgcacatcggttgctcttgttggataagcaagcgcgtagatgttgatgtgatgtacaagttggacttttttgcgagtgtccctttccagtgaggttagaggtgatatatcagcgtattgagaattgagatgtactaatcgatttaatctcggtattcactaaaaaaaaaaaaaaaa

SEQ ID NO: 8216 - protein, 109 aa, Zea mays
  misc_feature: Ceres CLONE 366920
MAAIARSFPSPSPSPSPSEGWRGTSRAAVDDDERRGVVVRSWNLKAIWLHGAAGEGGAVDQTDERTAVETNVQSGHYWCGVWTHVMICDGDSRCANPWLFTGVGSVFYC

SEQ ID NO: 8217 - DNA, 383 bp, Zea mays
  misc_feature: Ceres CLONE 366933-F
  misc_feature: Encodes the peptide sequence at SEQ ID NO. 8218
atataaggcccagcccaccgatcctcctcttctgtcttctcccctgcgtcaaagacgacgcaagcccttgcctctccctactccaaaccctcgccgactcagatccagcttcctcgcaccgccgtcgccatgccgttcactccaggcccctactctggcgtcagcaccctcgcccttgtggcgagggcgtcggcctttggtgtcggtgtcgtctacgggagcatcaagctctcaatcctcaaggtcacaaaacctaaaaaggaggaagtgcatgatcatcactaaggatgacagggctgctacatgttaattcccatatatgcaaggatgttataaaattggcagtgcaccccttatccatacgtgcaatttcgtttatgatt

SEQ ID NO: 8218 - protein, 51 aa, Zea mays
  misc_feature: Ceres CLONE 366933-F
MPFTPGPYSGVSTLALVARASAFGVGVVYGSIKLSILKVTKPKKEEVHDHH

SEQ ID NO: 8219 - DNA, 466 bp, Zea mays
  misc_feature: Ceres CLONE 366950-F
  misc_feature: Encodes the peptide sequence at SEQ ID NO. 8220
gggattttcgcaggaccctggccgcgtcggctgtgatgggtcgaagcgccttggcggttcggttggcttcccttcttgcgtttggtttggtgctcgtctccgtcgaggccagcctcggggatgttgatccgcgctacagaacttgcgtgagggagtgtcaagctacagggattgttggggagaatgtcatcagccattgtcagtccaaagagaactacacttctgttggagtctcttggtataaccaggagcaaatttacatccagtggaaggaactgaactgtaggacagactgtcgctatttttgcatgatgcagagagaaggggaacgacagtcacttggtctgagccctgttaaatatcatggaaagtggccattcttacgtgtttctgtgttccaggaacccctttcaactgcactatctgctgtcaacctacttgatgcacttcactggctggctttcat

SEQ ID NO: 8220 - protein, 143 aa, Zea mays
  misc_feature: Ceres CLONE 366950-F
MGRSALAVRLASLLAFGLVLVSVEASLGDVDPRYRTCVRECQATGIVGENVISHCQSKENYTSVGVSWYNQEQIYIQWKELNCRTDCRYFCMMQREGERQSLGLSPVKYHGKWPFLRVSVFQEPLSTALSAVNLLDALHWLAF

SEQ ID NO: 8221 - DNA, 434 bp, Zea mays
  misc_feature: Ceres CLONE 366991-F
  misc_feature: Encodes the peptide sequence at SEQ ID NO. 8222
acgtaacccaattacccaacgcatcgaggagcgcacgaaggcaaccgccttcccatcccaccgggcatcggcccatctgatccgatcaggctagatcctgccggtgccggtcttcgcgccgcctatggccgaaggcgacgcgcccgcccccgccgcggctgcagcggcggcgtccccgcggtcgcccatgccgcaggagacgccggcgatgcagaagcggaggcagcgggggctcgtgtcgcgggtgtggaagggcatcttcggcggccgcgaggacgtcgagaagctgctgcaggcgctgtccaaggaggaggaggccgtgcgggcgcgccttcgccgccgggcccgcgcctcccgccagtccgcgcacaacgtcctcgccctcgccgccgcgctcgagattgttgccgttggatacgccatcatgaccacga

SEQ ID NO: 8222 - protein, 103 aa, Zea mays
  misc_feature: Ceres CLONE 366991-F
MAEGDAPAPAAAAAAASPRSPMPQETPAMQKRRQRGLVSRVWKGIFGGREDVEKLLQALSKEEEAVRARLRRRARASRQSAHNVLALAAALEIVAVGYAIMTT

SEQ ID NO: 8223 - DNA, 459 bp, Zea mays
  misc_feature: Ceres CLONE 367036-F
  misc_feature: Encodes the peptide sequence at SEQ ID NO. 8224
actgacatcccatatcgccaagtccccttcgtcgtccccttccctcgcctcgcgttaggtagcctgcttccgacccgcacatctccctccggttctcgccatgggcgccggcgccaacaaccacgaggagtcgagccccctcatcccagctgcggttgccgcccccgcggacgagaagcccccgcaggctccggcgccggaggccgccaattactatgccgacggggtcccggtcgtgatgggcgagcccgtgtcggcccacgccttcggcggcgtcccgcgggagagctggaactccgggatcctctcctgcctcggccgcaacgacgagttctgcagcagcgacgtcgaagtgtgtcttcttggaacggtagcaccatgtgtgctctatggtagcaatgttgagaggcttgctgctggacaaggcacatttgcaaacagctgtttgccwtacactgg

SEQ ID NO: 8224 - protein, 119 aa, Zea mays
  misc_feature: Ceres CLONE 367036-F
MGAGANNHEESSPLIPAAVAAPADEKPPQAPAPEAANYYADGVPVVMGEPVSAHAFGGVPRESWNSGILSCLGRNDEFCSSDVEVCLLGTVAPCVLYGSNVERLAAGQGTFANSCLPYT

SEQ ID NO: 8225 - DNA, 471 bp, Zea mays
  misc_feature: Ceres CLONE 367047-F
  misc_feature: Translation starting site: 193
  misc_feature: SWISSPROT Homolog: EC 2.7.11.1 Non-specific serine/threonine protein kinase
ggaggacaggaaggaaaaacaaggcgaaaaaggaggttcggggcgggttccatggcgctgccttcctagcccagccgcctcaccaacctccctcctcaccgaggagagaccgaggcgccaagagagaacaggacactacgagaagaggaggttcatttccgcgtcgtctccgccagcagccccacccaccacatggcagccatgccgggtggggcccacgccgccggcgccgcggaccagatgcaggtggaccagccgctccccgctgcggccgcactcggccccgcggacgccaagcatgctggttctatgattgaagggaatgatccagtcacgggtcatataatctcaacaaccattggagggaagaatggagagcctaaaaagactatcagctacatggcagagagagtgtgggaactggatcattcggaatcgtcttccaggcaaaatgtctggagactggtgaga

SEQ ID NO: 8226 - DNA, 445 bp, Zea mays
  misc_feature: Ceres CLONE 367056-F
  misc_feature: Encodes the peptide sequence at SEQ ID NO. 8227
acgacccacgatgcagtgcagtggggcagccagatccagttcctgggcgtcctcctcctcctccattccggccctctcgcccgtccgtctcctgcccccgtccctggtcggaccacgagagccccggactgcgttcacctctgccttttgttcacccctcttgtctcgtgcgtgcgacaacaactgggcgaccgccgccgccgccctacgccaggtgcgcaggtcttcgtcggatccttcgccggcgaggcgacgagcacccaccaggtgatgcccccggcttaattgaatgggctctcttctcaccaggactggcatcctgccatggctccaggccaagatcgttgatcccgtgctgcaggtcatcagaaggggagcagaacccaagcaactggccttctctgctgcctcggtgtcacgattgggatctttccgatatgtggga

SEQ ID NO: 8227 - protein, 52 aa, Zea mays
  misc_feature: Ceres CLONE 367056-F
MGSLLTRTGILPWLQAKIVDPVLQVIRRGAEPKQLAFSAASVSRLGSFRYVG

SEQ ID NO: 8228 - DNA, 1020 bp, Zea mays
  misc_feature: Ceres CLONE 367065-R
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (217)..(217): n is a, c, t, g, unknown, or other
  misc_feature (587)..(587): n is a, c, t, g, unknown, or other
  misc_feature (588)..(588): n is a, c, t, g, unknown, or other
  misc_feature (748)..(748): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (764)..(764): n is a, c, t, g, unknown, or other
  misc_feature (765)..(765): n is a, c, t, g, unknown, or other
  misc_feature (767)..(767): n is a, c, t, g, unknown, or other
  misc_feature (787)..(787): n is a, c, t, g, unknown, or other
  misc_feature (788)..(788): n is a, c, t, g, unknown, or other
  misc_feature (855)..(855): n is a, c, t, g, unknown, or other
  misc_feature (856)..(856): n is a, c, t, g, unknown, or other
  misc_feature (864)..(864): n is a, c, t, g, unknown, or other
  misc_feature (875)..(875): n is a, c, t, g, unknown, or other
  misc_feature (876)..(876): n is a, c, t, g, unknown, or other
  misc_feature (877)..(877): n is a, c, t, g, unknown, or other
  misc_feature (878)..(878): n is a, c, t, g, unknown, or other
  misc_feature (885)..(885): n is a, c, t, g, unknown, or other
  misc_feature (906)..(906): n is a, c, t, g, unknown, or other
  misc_feature (907)..(907): n is a, c, t, g, unknown, or other
  misc_feature (909)..(909): n is a, c, t, g, unknown, or other
  misc_feature (910)..(910): n is a, c, t, g, unknown, or other
  misc_feature (929)..(929): n is a, c, t, g, unknown, or other
  misc_feature (930)..(930): n is a, c, t, g, unknown, or other
  misc_feature (931)..(931): n is a, c, t, g, unknown, or other
  misc_feature (932)..(932): n is a, c, t, g, unknown, or other
  misc_feature (933)..(933): n is a, c, t, g, unknown, or other
  misc_feature (934)..(934): n is a, c, t, g, unknown, or other
  misc_feature (936)..(936): n is a, c, t, g, unknown, or other
  misc_feature (939)..(939): n is a, c, t, g, unknown, or other
  misc_feature (1000)..(1000): n is a, c, t, g, unknown, or other
  misc_feature (1001)..(1001): n is a, c, t, g, unknown, or other
  misc_feature (1002)..(1002): n is a, c, t, g, unknown, or other
nnnnnnnnnnnnnnnnnnnnnnnnnnnnnnnnnnnnnnnnnnnnnnnnnnnnnnnnnngggggggnnnnnnnngnnnnngnnnnnnnnnnnnnnttttttnnnnnnnnccaattgggtacgggcccccctcaagtcgacgtatcgataagcttttttttttttttttttaaagaatcgtcaagttctattaattatttcacaacgcacaaaacatangtctaacagaaaattgggtagctcaagcaaaaatgagcattcctgcgttcaaataatcgcataaactttctatctcaaaagttgtgacacaataaggtatagacaaatcaaaatccaacttaggcccacagggatttttgaaaagggccaaaatggatttgctaaacaaatggtttcttccatcttttcccaaaaatttttttcccggaaattaaattttaaaagggatgccaatcccaagggggggggattatttcaatccccccctttggtcccccattcggggggggggggggccccccacccccaaagggggggggccctaaaaaacaaacttttttttttgggggggaaaaaccccccaaaattnntcccccccccggggggggggtggggggaaagaaaaaaaaaaaagggtgggggggggaaaaaaaaaataattttttttctcccaggggggggggggggggggggggcccgctccccctttttgggggggcggggccccccctttttttttttttttttttnccccnnnccccccccnngncggggggggggggccgcccnnaaaacaaaaaaaaaaaaaaaacaatccccccgccgggggggggggggggagaaaaaaaaaaaaaacnncccccctnccccccccccnnnnttgggtntgggggggggggggggggggnngnnaaaataaaaatataaaaannnnnncnccnccccccacaaaaaaaaaaaaaaaaaatttatttttttttttttttttttttttaaaaaaannncccccccttcttttttgg

SEQ ID NO: 8229 - DNA, 471 bp, Zea mays
  misc_feature: Ceres CLONE 367099-F
  misc_feature: Encodes the peptide sequence at SEQ ID NO. 8230
gttacatatccagcggccacccgttcctcttcctcgtccgcctccaacgaccaccatccatcgccatggctggccccaccaccacgctcctcctcctgctgctgtgctccgccgcgctcgcgtccggcgccacggcggccgacgacagcggattcacgaccttcaaggtgttcttccacgacatcgtggcggggacgagcccgacggccatccgcatcgcgcagggggcggcgtccaacacctcgtccaccagcttcggcgcgatggtggccatcgacgacccgctgacgacaggccccacgcgcgccgcgtgcaccgaggtgggccgcgcccagggcacctacacgtttgcggaccagcagacgttcggcctcctcatggtgatggacttcgtgttcacggccggggagcacaagggcagcacgctctccatcctcggccgcaacgaggtactcagcgacgtcccgcgag

SEQ ID NO: 8230 - protein, 135 aa, Zea mays
  misc_feature: Ceres CLONE 367099-F
  misc_feature (9)..(135): Pfam Name: Dirigent Pfam Description: Dirigent-like protein
MAGPTTTLLLLLLCSAALASGATAADDSGFTTFKVFFHDIVAGTSPTAIRIAQGAASNTSSTSFGAMVAIDDPLTTGPTRAACTEVGRAQGTYTFADQQTFGLLMVMDFVFTAGEHKGSTLSILGRNEVLSDVPR

SEQ ID NO: 8231 - DNA, 472 bp, Zea mays
  misc_feature: Ceres CLONE 367100-F
  misc_feature: Encodes the peptide sequence at SEQ ID NO. 8232
cgaaaaacgggtagattgctgatgagaaaaacaagctggcataaatgaataattcgcaattggcatcttgcaggtgaaaggactgttgaaggagaagaaggtggagatgctgctggacccagatctgcagaaagcctacgaggaggtcgaggtggagagccttattcaggtggcactcctctgcacgcagggctcccccctggaccgtccaaagatgtcggaggtggtgaggatgctcgaaggtgacgggctggcagagcgttgggacgaatggcagaaagtagaggtggtgaggcaggaggctgagtcggcaccgctccgcaatgactggatcgtcgattccacgtacaaccttcgtgccgtggagctgtccggcccaaggtagccactccacgactccgatgaaagaaaacactgaattggccaagattcagtctaattgctgcttgtgtatatgaaaggtagcctttgg

SEQ ID NO: 8232 - protein, 92 aa, Zea mays
  misc_feature: Ceres CLONE 367100-F
  misc_feature: SWISSPROT Homolog: EC 2.7.11.1 Non-specific serine/threonine protein kinase
MLLDPDLQKAYEEVEVESLIQVALLCTQGSPLDRPKMSEVVRMLEGDGLAERWDEWQKVEVVRQEAESAPLRNDWIVDSTYNLRAVELSGPR

SEQ ID NO: 8233 - DNA, 473 bp, Zea mays
  misc_feature: Ceres CLONE 367107-F
  misc_feature: Encodes the peptide sequence at SEQ ID NO. 8234
agcgcggcccccccgttctatcttctccagctccaaatggcgccatcgcggcggccgggttatcttgtccagacgtgcatcatatcctccgtgtgatccattcatccccgcgccgtgctagcttgctagttgcaagcaccagccgaccaccaaacggtagcgcacgcggacaatttaacagcatcaggtttaggccctgctgccgtcgtcgagcgcccgggccaccgcacacctgaaagcaatggagatcgtcgccacgcgctccccggcttgctgcgccgccgtgtccttctcccagtcgtacaggcccaaggcgtccaggccgccgaccacgttctacggcgagtcggtgcgggtgaacacagcgcggccgctctcggcgaggaggcagtccaaggcggccagccgcgcggccctcagtgcccggtgcgagatcggagacagcctggaggagttcctgaccaaggcgacgc

SEQ ID NO: 8234 - protein, 77 aa, Zea mays
  misc_feature: Ceres CLONE 367107-F
  misc_feature: SWISSPROT Homolog: EC 3.1.3.37 Sedoheptulose-bisphosphatase
MEIVATRSPACCAAVSFSQSYRPKASRPPTTFYGESVRVNTARPLSARRQSKAASRAALSARCEIGDSLEEFLTKAT

SEQ ID NO: 8235 - DNA, 476 bp, Zea mays
  misc_feature: Ceres CLONE 367179-F
  misc_feature: Encodes the peptide sequence at SEQ ID NO. 8236
gaacaacgcccgcgcagaggccgggggtagctagctagctcctccgatggccagccgcggtggcgcattcgtggtgttcgttgtcctgtgcagctcgctgctcgggctcgcgccgcggccgagcgcggccgggaagccgctcgtgccggcgatgttcgtgttcggggactccctggtggacgtcggcaacaacaaccacctggccagcgtcaacgacagctgcaaagcgaactaccggccctacggcgtcgactaccaccccgggcagtcaccgaccggccggttcagcaacggctacaacttggcggaccatctagcacgatggctgggctttgccgggagcccgccacctttcctctccctggcgaacgcgagggcgaggcacactcggcggacgacggtgagcacgggcggcatcaacttcgcgtccggagggtcgggtctcctccctacaaccggcgattctgtgtgcggcg

SEQ ID NO: 8236 - protein, 143 aa, Zea mays
  misc_feature: Ceres CLONE 367179-F
MASRGGAFVVFVVLCSSLLGLAPRPSAAGKPLVPAMFVFGDSLVDVGNNNHLASVNDSCKANYRPYGVDYHPGQSPTGRFSNGYNLADHLARWLGFAGSPPPFLSLANARARHTRRTTVSTGGINFASGGSGLLPTTGDSVCG

SEQ ID NO: 8237 - DNA, 670 bp, Zea mays
  misc_feature: Ceres CLONE 367203-R
  misc_feature: Pfam Name: Na_H_Exchanger Pfam Description: Sodium/hydrogen exchanger family
cgattgggaccgggccccccctcgaggtcgacggtatcgataaaacactttacagagcttgtaaactccagccatacaaaaaaagtagcttgcagtgtgccatgaagtcatgagtcatgtgagccttggactatcagatttatgcgcttgccgctatcaatgcggaggacatcattttttaagcccagctccacctgattggtgtcgacagaaaaccatctcaaaagaaccccgaggtggaccactgctgggatcattttgaatagcaaaggggttgtcaccaaactgagtgccgtggttccaagaagaagcaagtatagcttgccctcgatgagatggatacttgaagcacggcttacgagaacaaaagcaaactctcctatttgtgcaagagacatgccgacaagaagagatgttttgctgctatacccaaaccctcttacgacaatagcaacaataaatgtctttacggtgatcaccaaaattaccgctgcaaggagtatatccacatggctccacaagaaatggacattaattagcatcccaatgctggcaaggaaaagagcaccgaataagttgcggataggttcgatttgttcaagactatgttgcgcaaggtctgttgttgatatcattactccaactgcacatgaacccaactcgagactca

SEQ ID NO: 8238 - DNA, 2037 bp, Zea mays
  misc_feature: Ceres CLONE 367265
  misc_feature: Encodes the peptide sequence at SEQ ID NO. 8239
aaaaaacacgaacccactagccctctctgcttcctctccgtttctcctccactcaccactcccgattgctgtcgagtctcgatctgccagcgcgcggcgcgatggccgacaaggcggcgtccccggagaagaagtcatgggccgacgtcgaagaggaggaggaggccaaggccaaggcgaccgcggcgtcctcttcctcctccatcaccgagccggcggtggaggagcaggccaagcagatcgaggcgctctccctcgccccgtcggtggacgacgccgcaggcgaagagggcccgcccctcctcgatgactccgacgactcgcaaatccaagccgtgatttcgggtggcacagtgtacgagtcggccaccacgttcgaggatctgaagctgtcgcccgagctgcttaaggggctgcacgacgagatggggttcagccgcccgagcaagatccaggcgatcaccctgcccatgatcctcacgccgccctacaaggacctcgtcgcgcaggcgcacaacggttctggcaagaccacctgtttcgtcctcggcatgctcagccgcgtcgacccgcaacacaagataccccaggctatctgcatttgccccaccagggagcttgcgcagcagaataaggcagttctcatgaggatgggcaagtttactggcattacatgcgcctgtgcaatcccgccagctcaaaaagactacatgccgatctcaaaaatggctccgatcactgaccagatcgttatcggcacatctggtacgctcatcaaatggattacccataagaagctggccacaagggacatcaagatacttgtgtttgatgaggcagatcatatgcttgctgaggatggctttaggagtgactctgaaaggatgatgagggatatacaaagaagcgctggtggttgtcaggtgcttctcttttctgcgaccttcaatgatagggtgaaggattttgttacaaaggtcattagggatggaaatcagatatttgtgaagaaggaagagcttactttggaaaaagttaagcagtacaaagttcaagtacctgatgaatcggcaaaaatagaggttataagggacaagatatttgaatttggacagaaagttggccaggttatcatatttgttagaacaaagcaaagtactaagaatgttcacaatgctttgacgagggaggactatgtgtgctcctcaattcaaggatcccttgaccaatcagagagggaaaagataatacaggaattcaaagatggctacaccaaggttcttatatcaaccgatgttcttgctcgaggttttgaccaagcacaggttaaccttgtcatcaactacgacatgccaatcaaatttggtacaagagatgaacctgattatgaggtgtacttgcacagaattggcagagctgggcgctttggccggaaaggtgctgtgttcaacttgctgtgtggtcaaaccgataatgttgtgatgaagaagatcgaggactatttccagcacagtgtgcctgaggttcggaattggcaacgtgaagaagattttgaggctgctctcaaggatgcaggtttactttaaagtaaccacggaaacttgtggtgagcagcgctctccggctcgggacaattgaccggtgattttttttgctgagcctgctgcacaacgttattgtgctctttctgctctcctgttggcagcactgattttcaccggtgatttttttttcgctgagcgtgctgcacagcgttgctgtgctcttatgttcatcctgttgtcagcactgattgttttgcagcagagttgtggattatgttaaaagactagaacagctattgtgttgtgagctttatatgaagcagagggtcgttaagaggtgttcatttggcaatatgcttgtagcgcagttacgagcattaccatttggaactgtaaatctttttactagagagtagactttatttgccgtggagacgcttgtgttactatcttttttacagtgaatgtgttttatataaaaaaaaaaaaaaaa

SEQ ID NO: 8239 - protein, 494 aa, Zea mays
  misc_feature: Ceres CLONE 367265
  misc_feature (115)..(289): Pfam Name: DEAD Pfam Description: DEAD/DEAH box helicase
  misc_feature (359)..(443): Pfam Name: Helicase_C Pfam Description: Helicase conserved C-terminal domain
MADKAASPEKKSWADVEEEEEAKAKATAASSSSSITEPAVEEQAKQIEALSLAPSVDDAAGEEGPPLLDDSDDSQIQAVISGGTVYESATTFEDLKLSPELLKGLHDEMGFSRPSKIQAITLPMILTPPYKDLVAQAHNGSGKTTCFVLGMLSRVDPQHKIPQAICICPTRELAQQNKAVLMRMGKFTGITCACAIPPAQKDYMPISKMAPITDQIVIGTSGTLIKWITHKKLATRDIKILVFDEADHMLAEDGFRSDSERMMRDIQRSAGGCQVLLFSATFNDRVKDFVTKVIRDGNQIFVKKEELTLEKVKQYKVQVPDESAKIEVIRDKIFEFGQKVGQVIIFVRTKQSTKNVHNALTREDYVCSSIQGSLDQSEREKIIQEFKDGYTKVLISTDVLARGFDQAQVNLVINYDMPIKFGTRDEPDYEVYLHRIGRAGRFGRKGAVFNLLCGQTDNVVMKKIEDYFQHSVPEVRNWQREEDFEAALKDAGLL

SEQ ID NO: 8240 - DNA, 472 bp, Zea mays
  misc_feature: Ceres CLONE 367330-F
  misc_feature: Encodes the peptide sequence at SEQ ID NO. 8241
gcacctacccggctacccctgcggccttgccggggagtcggggacggggaaggaaacggcaacgagcctgcagctccagctaccccgaaaccccgtccaacgtccatggcaatccacctccgggcccacgtcttcgcggccaacccgctgcgtggcgtctctgccgccaccaccgccatgtccccctccgcggccgccgaggcactccgctacctcctcgaccccagctccgccgccgccgccgccaatcccagccagtacctctccaagatccttcctttccgccggggccgcccgctcgcgcgctccacggaccctcccgcggcgccggcctggcgcctcgcgtggctcccgccgtcccgcgtccccggggtggctccggacgccttcgtcttcctgggcgcgctcgtcgagggggacggcacggaggccgccgcgtactgggcggtcgacgtcagcgagggcgagggag

SEQ ID NO: 8241 - protein, 122 aa, Zea mays
  misc_feature: Ceres CLONE 367330-F
MAIHLRAHVFAANPLRGVSAATTAMSPSAAAEALRYLLDPSSAAAAANPSQYLSKILPFRRGRPLARSTDPPAAPAWRLAWLPPSRVPGVAPDAFVFLGALVEGDGTEAAAYWAVDVSEGEG

SEQ ID NO: 8242 - DNA, 468 bp, Zea mays
  misc_feature: Ceres CLONE 367342-F
aataggaatagatgtgtattcgacagtgagcaactagaggtccatgaagttccccaggaggttgtagacaagggtagtgtttgggtgagggctgatactgtagctttggggcagctaacacatcagtagacagtagtctcaggactcaggagtgatgtgcagctctcttgcatattcgagaaaaaaatcaagaggagtttgaaaagaaaaacaagtatggagctgtttcatcttcacgggggctttgatcgataaggattcaggagtgctggaagaagatttggagcaagagctgtcgctgtccggcgtctggcggtctgggggagaccagtgattttcctacgcacgcctgccaaaagtgggatggagttgaacgcaaaatgtgttgtttgtcattgggtagatggaggaggacacctcgtttatacgcgcggaggargtgtagtgcgactgtgcgagttgaaattg

SEQ ID NO: 8243 - DNA, 478 bp, Zea mays
  misc_feature: Ceres CLONE 367343-F
gcctacgcgtacgccagttcccttcactctattcctgcgcatgaaggagttacccagatgagaagttccccaggcgctgcagcaacaggagaggaggagcacggttcgtcgtgcgcagattgcgatgtattcctgagcttcaaggagtcgacgatcaagttttggcgaccaagtgatcaggctcttcgagttttacgaggctgaagatcctgagcatctgtttagtgaaggttgtccatgttgcaaccgctgctcaggagaagatgaagccatggaggaagacttccaggagttccaagagtacgacgagttttaggcgtgggttagcggcaacccctagttggctgcctatgaaggccgcatgtatctacgtttcattttcacattttgattattgttaaagactatgtggatgtctcagacatcatgatgtaatcgactagtactatcttttatgttaaaaaaaaaaaaaaaaarg

SEQ ID NO: 8244 - DNA, 620 bp, Zea mays
  misc_feature: Ceres CLONE 367363-R
  misc_feature: Pfam Name: LACT Pfam Description: Lecithin:cholesterol acyltransferase
  misc_feature: SWISSPROT Homolog: EC 2.3.1.43 Phosphatidylcholine--sterol O-acyltransferase
acgattgggtaccgggccccccctcgaggtcgacggtatcgataagcttttttttttttttttttggttttttttttttttttttttttttttttttttccccaaaaaaatttattcataacgattaaaaaatacgaagagaactctaataggccccagctaaagcaaatcccgataatccttacagaaaaaacaataaacttttttccaaaaaaaaaaaactagctgctggcgccgatttaagggaaaagaaatcatcgttagttgtctacaaaagcaaaactttctaaaaggaaggaggatagctcggggggttcaggtggaaaaaatcgaggatccttatgatcggctccagggcgctcttgtcgctgagcatgccggaaggggacaccttgggcagctccaccacctcgacgaccggggccggggagtccgaccacgccttgatcgggcctatgagggtggccaggttcaccgtcccgtcgccgtcgccataaaccaccttctcgggggcctcgtcaaagccgcggtcgccgaacacgaggctctccaccgggtcaacgccggggcccacgaggcacgtcaggggcacgccgggctccgggagggcctcgacgagg

SEQ ID NO: 8245 - DNA, 444 bp, Zea mays
  misc_feature: Ceres CLONE 367396-F
  misc_feature: Encodes the peptide sequence at SEQ ID NO. 8246
aatcgagtgatcgaccaacgccgtcccttatcgtcgagtttcgacctctcggtaccggctaaaccctagcggcgtcacgtgggcgacggcgaccggtgggcggtggagggttaggcgcgcaaccggcgaagggattcagcggtccccttcccccgtccgaggcgcggcggcgccctgcagattattattggttttgttgcaaaatggatacagaagcgactttaaacaagtctggtggttctgaatctgtaatgtcattactggaacagcttgctgaagtatttggaaacttgaaatcccacaccgaagcatttctgcaattgcagaatggcatcaatgggaagatatcaaagggcatttcctcagccttgataagtcgtatggaagcaagtttgatgaattggtagagaagcagaaggcattagaagaaaagaaagctgaagc

SEQ ID NO: 8246 - protein, 67 aa, Zea mays
  misc_feature: Ceres CLONE 367396-F
MDTEATLNKSGGSESVMSLLEQLAEVFGNLKSHTEAFLQLQNGINGKISKGISSALISRMEASLMNW

SEQ ID NO: 8247 - DNA, 510 bp, Zea mays
  misc_feature: Ceres CLONE 367417-F
  misc_feature: Encodes the peptide sequence at SEQ ID NO. 8248
  misc_feature (94)..(94): n is a, c, t, g, unknown, or other
  misc_feature (108)..(108): n is a, c, t, g, unknown, or other
gtttttacccaccttaccttatcattattagctcctccaagcaagtcgcacacgacacatcatcatcaacagcctgacatggccggcgacgacngggcgcacggcgcnwcggcgcggctggagggcgtgctgacggacgcgtcgaccccgtgggcgcggcgcgcgtggggcgcggccgccatcgagctgccgctgctgacgcggctggcggcgccggcggtggtgatgtacatgatcaactacctcatgtccatgtcgacgcagatcttctcgggccacctcggcaacctggagctcgccgccgcctcgctcggcaacaccggcgtgcagatgttcgcctacggactcatgctgggcatgggcagcgcggtggagacgctgtgcgggcaggcgtacggcgcccacaagtacgagatgctgggcatctacctgcagcggtcggccgtgctgctgtgcgccacgggcgtgccgctggccgtgatctacggcttctccgagccgatcctggtg

SEQ ID NO: 8248 - protein, 144 aa, Zea mays
  misc_feature: Ceres CLONE 367417-F
  misc_feature (6)..(6): Xaa is any aa, unknown, or other
  misc_feature (11)..(11): Xaa is any aa, unknown, or other
MAGDDXAHGAXARLEGVLTDASTPWARRAWGAAAIELPLLTRLAAPAVVMYMINYLMSMSTQIFSGHLGNLELAAASLGNTGVQMFAYGLMLGMGSAVETLCGQAYGAHKYEMLGIYLQRSAVLLCATGVPLAVIYGFSEPILV

SEQ ID NO: 8249 - DNA, 739 bp, Zea mays
  misc_feature: Ceres CLONE 367422-R
  misc_feature (739)..(739): n is a, c, t, g, unknown, or other
ttttttgtttgaaatatattatatttttaatccggtaaacacggaattggtttaccaattgggtacgggccccccctcgtcgtgatcggaatgaatatgcaccgcagagatttatcgagcagttcgcgagtcagtttaaaaaagttatctcgtagatgaatgctttcgctgacggacatgtatccttttgccttcctcagtcgcccgtatgcggcgaggtcaacgcgtgcgtcgatcaaccggttcagcagatcgattcgctgtctgtcaacgaacatacttcgatcctcatcttcccaggcttgttgcatttaaatagcatggctattttttgagcaaaatgctgtccaggatcaattcttcacgccgaattaacgaaatatacatttccttcgcctccgccaccggatgagattgcgatacaaatttgagccacaactctgtacaatccctgcaatgacctttcctgtaactgaatatttttataatctactgaggaaagtatctcctccaagccgaacagcggctctgtttcccttagactgtaccaaaaccccctgttaatccggagcgtattcttcacatagctcagcactggggggtaacaaacacggacacccaagctttgtcctatttaggaacatcgggcgacccgcaaaaactccctgccggcatattacccgaaagatcaccgggttacaaaaaatatcttgtggtaataggtccctatataataaan

SEQ ID NO: 8250 - DNA, 521 bp, Zea mays
  misc_feature: Ceres CLONE 367442-F
  misc_feature: Encodes the peptide sequence at SEQ ID NO. 8251
aaatcagctcaacggccaaaccgaccaaccatcgcgccgtccgcgcacagacgacgacgacaggcaacaggagagcgagggcatgggtccagctcgccacctccgcggcctcaccgcgctcttgctctccgccgccctcttgctctccgccgccatcccggccgccagaggccaggaggaaacggaggacgaggaggagttcaactacattcccggcgacgcgaacgggccggagaactggggcagccgttgaggagtgcgacgtgatcagcaatgtcggcggcaaggccatggctctcagggttcgcgggtgcggtcggttcggcgcttactgctcgcgggagccggcgaggttctattggactcggcggaagtggagttcagctacgatgccgacaccggcctcgtgtccgtcgacctgcccgtgccagagcaggagctatatcggtggacgctggagattatggtcttaggccgtgacgctgtgcgctgacgccattctgagccgggacgacatgtca

SEQ ID NO: 8251 - protein, 156 aa, Zea mays
  misc_feature: Ceres CLONE 367442-F
ISSTAKPTNHRAVRAQTTTTGNRRARAWVQLATSAASPRSCSPPPSCSPPPSRPPEARRKRRTRRSSTTFPATRTGRRTGAAVEECDVISNVGGKAMALRVRGCGRFGAYCSREPARFYWTRRKWSSATMPTPASCPSTCPCQSRSYIGGRWRLWS

SEQ ID NO: 8252 - DNA, 528 bp, Zea mays
  misc_feature: Ceres CLONE 367480-F
  misc_feature: Encodes the peptide sequence at SEQ ID NO. 8253
ccgttcacaaccttgtcgcacgagtctcttattcggttttggccataactacatcacacatcacaccacatgagccggaaagtcattgaaaccctcttattaaaaaaaactgaagcaatgttgccaccaccgccatgccattgccgccacagccagtccgtcgctcttgccctatcctgttagccgtcaacgacacctgtggtgtgacgaggatggcatcaacatgtgcggcaagggtaccgtctctgcggtgggcgccacaacgtggctgggtgggttcgtgggtttcagtacgcccagcgaaatgcaggacatcggtaggacatgccgttgtgtgcgctgctgttagcttcagaccatgcattgacattcacaagggaaaagttaaacagattgttggctctactcttcgggatttagcaaatgatagcatggaacttgtgacaaactttgaatcagacaaatctcctgcagaatttgctaaattttataaagcagatgaacctctaggaggacatgttataatgc

SEQ ID NO: 8253 - protein, 131 aa, Zea mays
  misc_feature: Ceres CLONE 367480-F
  misc_feature: SWISSPROT Homolog: EC 5.3.1.16 1-(5-phosphoribosyl)-5-((5- phosphoribosylamino)methylideneamino)imidazole-4-carboxamide isomerase
MPLPPQPVRRSCPILLAVNDTCGVTRMASTCAARVPSLRWAPQRGWVGSWVSVRPAKCRTSVGHAVVCAAVSFRPCIDIHKGKVKQIVGSTLRDLANDSMELVTNFESDKSPAEFAKFYKADEPLGGHVIM

SEQ ID NO: 8254 - DNA, 933 bp, Zea mays
  misc_feature: Ceres CLONE 367523
  misc_feature: Encodes the peptide sequence at SEQ ID NO. 8255
agtactcgcctccgctttccgctcgcctcgctccctcatttctctactgcagcacactaacgccatggacggacgacggaagctccctgctacctccaaatccctgccctcagtagccgattgcttaaattgagtttgccatcacctccccctcgccacgtcgatccgttcgaacccttcctcgagtgcagccatgaccggcgatgcccgcgccattgccgcagcaggctgccaccgcgggctcgcgtggccaggccacctggggctgccgtcggcccagccaactccttggctgtgcgcgccctccaccagggacggctcggctggccccgccgcgctcggccgacaccggcgagccccggccaggaaaggccgatcccctttccctgtacgttccaaggaagaagacgatggaccaatctgcaaattccagaacagcaggggggaccgagagatgctgatcgtgcacgtgatgtggggccaaccacaagatgcagctggtggacaacccaaggaaggatggacataaccagtgaatgctcgccaagcgagtgccacccgacaaacactatytaagtgtcaaattaaagactgtaatcttgctgacggagagtacatcctcgtgccggagcaaggagctgctcaggaggttgccccagacccagcaccagagcctgcaccagaggacctgcctgccactgctttggaaggaaccctggaggacatggttgctggagtgacttggccgtccaccttaccaccgggttggactgttaagtgggaccctgcctcggctgaggaggagcatgaggagtgatgggacaggcttcccatctctctgtttaattatcgttagttttattccgctgcacttcgaacaatgatgggtacttttgcaaaaactccgatgatgaaggaaaaaaaaaaaaaaaa

SEQ ID NO: 8255 - protein, 111 aa, Zea mays
  misc_feature: Ceres CLONE 367523
MTGDARAIAAAGCHRGLAWPGHLGLPSAQPTPWLCAPSTRDGSAGPAALGRHRRAPARKGRSPFPVRSKEEDDGPICKFQNSRGDREMLIVHVMWGQPQDAAGGQPKEGWT

SEQ ID NO: 8256 - DNA, 499 bp, Zea mays
  misc_feature: Ceres CLONE 367549-F
  misc_feature: Encodes the peptide sequence at SEQ ID NO. 8257
ccccattcattaccggaagagaaaaaaataactcggaaaagaaggagacgccgaaaattcgaaaggggaggggaaagcaaagctgatggcggaggaccaggggaaagcaaagcaaatggcggaggccccgagcaagatcgaatccatgaggaagtgggtcgtcgagcacaagctccgagccgtaggttgcctctggctaggtgggatcagcagttcgatcgcctacaactggtcgcggcccaatatgaagcctagcgtcaagatcatccacgcaaggttgcatgctcaagctctaaccctggctgcattagttggttctgcatgcgtggagtactatgatcagaagtatggttcttctgggccaaaggtggacaaatacacaagccaatacctggcccattcgcataaagattaaaggtcgccatgttggttcctgcatgccggattaattttgggctcatctcgggttgctcatgacccgcccatggatgctggatgt

SEQ ID NO: 8257 - protein, 109 aa, Zea mays
  misc_feature: Ceres CLONE 367549-F
  misc_feature (14)..(81): Pfam Name: HIG_1_N Pfam Description: Hypoxia induced protein conserved region
MAEDQGKAKQMAEAPSKIESMRKWVVEHKLRAVGCLWLGGISSSIAYNWSRPNMKPSVKIIHARLHAQALTLAALVGSACVEYYDQKYGSSGPKVDKYTSQYLAHSHKD

SEQ ID NO: 8258 - DNA, 442 bp, Zea mays
  misc_feature: Ceres CLONE 367558-F
  misc_feature: Encodes the peptide sequence at SEQ ID NO. 8259
atttttcatcagcagcattacccatcgctcgccaacgtgcagactaaggaagcactgaccggccggtcatggcgaggatccacctctacgtcgtcgccgcggcctgcgccgtcgccctcgcgctcgccggcgacccggacatgctccaggacgtctgcgtggctgactacgcttccccggtcaagctgaacgggttcccgtgcaaggcgaacatctcggcggacgacttcttcttcgacgggctgaggagcccgggcaacaccaacaacccggcgggctccgcggtgacggcggccaacgtggacaagttcccgggggtgaacacgctgggcgtctccatggcgcgcatcgactacgcgccgggcggccagaacccgccgcacacgcacccgcgcgccaccgagatcatcttcgtcctcgagggcacgctcgaggtcggctt

SEQ ID NO: 8259 - protein, 124 aa, Zea mays
  misc_feature: Ceres CLONE 367558-F
  misc_feature: SWISSPROT Homolog: EC 1.15.1.1 Superoxide dismutase
MARIHLYVVAAACAVALALAGDPDMLQDVCVADYASPVKLNGFPCKANISADDFFFDGLRSPGNTNNPAGSAVTAANVDKFPGVNTLGVSMARIDYAPGGQNPPHTHPRATEIIFVLEGTLEVG

SEQ ID NO: 8260 - DNA, 480 bp, Zea mays
  misc_feature: Ceres CLONE 367564-F
  misc_feature: Encodes the peptide sequence at SEQ ID NO. 8261
accgtccccgtctcaccgcactgcttaccccctcctctcgtctgcctcgcttagcttagccgccgctgctacgcactctcgccgtccttgttcccgcgtcgctctgctcgcgatggcgtcccgcgttgcagtgctgctcgtggccgtggcggccgtgctgttcgccgcggcgtcggcgcaggagatggacctgggcgtgccgcccgcgccggcgcccgtcacgggcgcggcagcggggaccgcggcatcggccctggccgtggcttgctctgccgtcttctccatcctcgtcgccggtcgcctcgtgcagtaggcgctgccgtcgacgtggttcggggtccggcggagccctgttcgatcgttttcgccttagctagtagtagaagtagcagtcatgggctgtgttgattgtttccctgtctcccacctggtgggcgttgtgaccttgtgctattgcttattctttttgtaccatactgc

SEQ ID NO: 8261 - protein, 66 aa, Zea mays
  misc_feature: Ceres CLONE 367564-F
MASRVAVLLVAVAAVLFAAASAQEMDLGVPPAPAPVTGAAAGTAASALAVACSAVFSILVAGRLVQ

SEQ ID NO: 8262 - DNA, 774 bp, Zea mays
  misc_feature: Ceres CLONE 367572
  misc_feature: Encodes the peptide sequence at SEQ ID NO. 8263
ggatcgatcggtcacgctcgcctcgcctcctctcgcttcgcttcctttccttgctcagctagcttgtgctcctaaagctttgtcatggcggcgtcccgctcgcccaaggtcgcgagggaggcggccgccgtggacgccaacaccacgttcgtgcaggccgacccggcgacgttccgcgcgctcgtgcagaagctcacgggcgccgcgccagcagcaggcgggacgacgacagcgacagcgacagcgcccaagcaggaggacgacgacgacgcggctgcggtgaccgtcgcgcacgcgccgaggcggccgaagctgcaggagaggcggcgcgcggcgccggccaggctggagctgtcgccggcgtcggcgtcgttgtactgctaccaccaccactcccgctacggccacgggctcatcatgcactcgccagtgtcgcccatggacgcctacatggtgctggcggcctccgcgtcgccgtcgccgtcgccgtcgccgtcgagcggcggcgcggtggtgacgataagcagggaggaggaggagcgggaggagaaggccatcgcctccaagggcttctacctgcacgcgtcgccaaggggtggtgacggcgaccggcccaggctgctgccgctgttccccgtccactcgcccaggatcagtgaactccggcgaggctagcaagctagtcatgtgtggacatggtgcacatatctggtgcacatggaacaatggtgcacatggtgcacatattaaatcatcaaaaaaaaaaaaaaaaaa

SEQ ID NO: 8263 - protein, 196 aa, Zea mays
  misc_feature: Ceres CLONE 367572
  misc_feature (16)..(46): Pfam Name: VQ Pfam Description: VQ motif
MAASRSPKVAREAAAVDANTTFVQADPATFRALVQKLTGAAPAAGGTTTATATAPKQEDDDDAAAVTVAHAPRRPKLQERRRAAPARLELSPASASLYCYHHHSRYGHGLIMHSPVSPMDAYMVLAASASPSPSPSPSSGGAVVTISREEEEREEKAIASKGFYLHASPRGGDGDRPRLLPLFPVHSPRISELRRG

SEQ ID NO: 8264 - DNA, 470 bp, Zea mays
  misc_feature: Ceres CLONE 367587-F
  misc_feature: Encodes the peptide sequence at SEQ ID NO. 8265
agtccactcacaagcgacaagatatatcagccattttaagtttgataatggatccaagatatgttactttattcatcttagtacttgccttacatggagatactactttggcagaaacttgcaggcagtttgttaaagtgcatccattctgctttaaagcaatgtgcaaggcaaattgtgctatagagggaaaattctctgatggttcctatgtaaaggattacagatgtgaatcaggtggatttcactcagtgtgcgtttgcattttgtgcaaacattagttatctaaagacaagcggagatatcttcttgtattcctatatgttatttaggagtattgtccaaataattatacggtagcttagttaactagctagtttgtttatttatagacatatgtagcactagttaactagttgttgtttcttaaattctcagctatataccagtaaacatgttttcagcgcttc

SEQ ID NO: 8265 - protein, 77 aa, Zea mays; identical to SEQ ID NO: 1262
  misc_feature: Ceres CLONE 367587-F

SEQ ID NO: 8266 - DNA, 473 bp, Zea mays
  misc_feature: Ceres CLONE 367606-F
  misc_feature: Encodes the peptide sequence at SEQ ID NO. 8267
gcggtgcagtgcaggtgcgggatctctgaatcgctgacgcccagcctcctctgtcatctccctcctcggacctcgccacctcacgcggaaggaggggaagaggaagcgcggagactggaaatcggaccccaaatccgcttcggtctctcgatcggcgaggcatgatttatacaaccggctaggatggcctcaaaagctataaaaagaaggcctatcagcgctgagactgataaaacaggggaaaatcaaatggatacagcactgtcagatcctgtaacagaacctcttctaggaaacactcctcaggaagagaaatccaagacatatgagcctattacaaggtcaggtttctgggatgcgacgacacaggagtgtcttcgttggacacatgcttttagcagcttttgttgctcaatctgcaagaaaaatagtaaatgttctttctgaatttggatatttgctagcaagactct

SEQ ID NO: 8267 - protein, 87 aa, Zea mays
  misc_feature: Ceres CLONE 367606-F
MASKAIKRRPISAETDKTGENQMDTALSDPVTEPLLGNTPQEEKSKTYEPITRSGFWDATTQECLRWTHAFSSFCCSICKKNSKCSF

SEQ ID NO: 8268 - DNA, 468 bp, Zea mays
  misc_feature: Ceres CLONE 367618-F
  misc_feature: Encodes the peptide sequence at SEQ ID NO. 8269
aggatgagcaaggaggatgtgctcaaggtgcagactttgatgctgagagtgaacatacactgtgacgggtgcgagaagaaggtcaagaagaccctccacaagatcgacggtgtctatcagagcagcatcgacgcggaacaggggaaggtgacggtgtccggcctgctggatccggacaccatcatcaggaagctcaacaaggccggcaagccggcccagctgtggggctccaagcctggcgtccctcagaacggccatggcggcggcaaaggccagcctaaggacgccggcggtggcaagggccattccaaggatgccggcggtggcaaggcccaaaagggcggtgcgggtggcggcggtcacaagggtgccggtgccaggtggggccaaggatcctaagatggtgatgccgcagccgacgcygcagcagctccagcagcagttgcagatgaaggggctgaagctccc

SEQ ID NO: 8269 - protein, 131 aa, Zea mays
  misc_feature: Ceres CLONE 367618-F
  misc_feature (13)..(73): Pfam Name: HMA Pfam Description: Heavy-metal-associated domain
MSKEDVLKVQTLMLRVNIHCDGCEKKVKKTLHKIDGVYQSSIDAEQGKVTVSGLLDPDTIIRKLNKAGKPAQLWGSKPGVPQNGHGGGKGQPKDAGGGKGHSKDAGGGKAQKGGAGGGGHKGAGARWGQGS

SEQ ID NO: 8270 - DNA, 466 bp, Zea mays
  misc_feature: Ceres CLONE 367653-F
atcctggcgtcggtgtcttgccctgccccagcgccgccgctccttcccccaccccgaagcgccgcctcttctgcctccgtcgacggtggtggtgctcctgatccccgccgttgaactggccataggagagcaaagaggaaggggaggccgcgagggcgccagtagatatattcatcttcatctcggcttgcgatatttttgaattttctattccgtattgaaggcgtcgatggccttgtccgccctaatcagcaccctcctcgccgccgccatctggtgcgccgcttacctcgccgctgccatctcctccgccttctgattcccactccccaaccctaacctcccccctgtagcacaccccacctctagctttgtaggtcctactatacttgcaacctctcccgctgactcgcttcgatctacccgccctcgcgtcaccatggggtacgcgcagctcgtcatcggc

SEQ ID NO: 8271 - DNA, 455 bp, Zea mays
  misc_feature: Ceres CLONE 367674-F
  misc_feature: Encodes the peptide sequence at SEQ ID NO. 8272
ctcacctgcagtcccgctccccaccccgccaccaccgacgctgggatgaaggccgtgccagccgacagcgccgcgcccccggtgccgatgccgatgccgatgccggcgaccaagatcaccattcccgtttccgcggtgggcggcacggaggcggcgctcctcgggaaggggcggtacaaggtctgggccttggccgccatcgcgctcctcgcgctctggtccatgtccgccgcctccgtctcactccgctggtcctcctcgggtgacctcgcctccgtctacggggacctggacgtcccgctcgccgacgacctcgattcccttgagatggaggagagggagaaattagtgggacgaatgtgggacatgtacacacggaccagtgatgaggtccgtgatgcagctatctctgagattgcccgaatgtcagcccacaaacttgagctcgagcagac

SEQ ID NO: 8272 - protein, 136 aa, Zea mays
  misc_feature: Ceres CLONE 367674-F
  misc_feature (6)..(136): Pfam Name: DUF1195 Pfam Description: Protein of unknown function (DUF1195)
MKAVPADSAAPPVPMPMPMPATKITIPVSAVGGTEAALLGKGRYKVWALAAIALLALWSMSAASVSLRWSSSGDLASVYGDLDVPLADDLDSLEMEEREKLVGRMWDMYTRTSDEVRDAAISEIARMSAHKLELEQ

SEQ ID NO: 8273 - DNA, 475 bp, Zea mays
  misc_feature: Ceres CLONE 367677-F
  misc_feature: Encodes the peptide sequence at SEQ ID NO. 8274
gcaaacccacgtttcaaaaaaaagagaggaaagcaaagttccttcttccctcggaaaaaaaatcagtctcgcaatggagagcagcgtaggcatagagaaggccgcagcggtggcggttggtgcaggtgtgggcggtggaggagggtacggctgcggcgggtgggagacgccgaagcgcgaggagtgccgcatcccggcgacgctgccgtgccccgcggcgccgaggaaggccgtgccggacttcgggaagcggcgcagcccgcccaagaacggctacttccagccgccggacctggaggcgctcttcgcgctcgcgccgcgccgccaggccttctgcgcgtgacttggcgcggactcgatttttggggagggagttgtagatagcttgccggtctcgctctgttgtactctttctagtgggggtgtttagtggccgcgggtgtattagggaggcagtagggtggttttagggagt

SEQ ID NO: 8274 - protein, 89 aa, Zea mays; identical to SEQ ID NO: 6918
  misc_feature: Ceres CLONE 367677-F

SEQ ID NO: 8275 - DNA, 184 bp, Zea mays
  misc_feature: Ceres CLONE 367696-F
  misc_feature: Encodes the peptide sequence at SEQ ID NO. 8276
agtggctacatcgcgaatggcggcwaggcagatccagggcgatcatggcttacgtcgagagaggtgttctgaaagacaaacggactatatggcgactgagcataatctscagacttcttctggagccattgtgagctttatcagaattcttctttgacacactgttctcattggaccaaactga

SEQ ID NO: 8276 - protein, 29 aa, Zea mays
  misc_feature: Ceres CLONE 367696-F
  misc_feature (22)..(22): Xaa is any aa, unknown, or other
MAYVERGVLKDKRTIWRLSIIXRLLLEPL

SEQ ID NO: 8277 - DNA, 413 bp, Zea mays
  misc_feature: Ceres CLONE 367708-F
  misc_feature: Encodes the peptide sequence at SEQ ID NO. 8278
aacacatctggtaagcgagcaccgagcagcaggtggtctcaacggtcgacgcgacaactttccttgtccatgcagcagatcactcgtcgtacgttccctatgctggctcctcctcggctccccctcgtcggggcgctcctgctgctcctcgccgtcgcgctcggcgcggtgccgtgcgagagcgccgcgctccgcctccgcggctccgtcgcctgcctcgactgcgacgaggaacacgatctctccggtgtggtcgtggcggtgaaatgcgccggcgacggcgacggcggcgcgggcctccacgcggcgcagaccgacgatcgcggcaacttcgacgtgaccgtgccagcagaagcgtcagcctcgggcgcgccgtgcgcggccagggtcctcggcgccacggarcagctctg

SEQ ID NO: 8278 - protein, 114 aa, Zea mays
  misc_feature: Ceres CLONE 367708-F
MQQITRRTFPMLAPPRLPLVGALLLLLAVALGAVPCESAALRLRGSVACLDCDEEHDLSGVVVAVKCAGDGDGGAGLHAAQTDDRGNFDVTVPAEASASGAPCAARVLGATEQL

SEQ ID NO: 8279 - DNA, 1155 bp, Zea mays
  misc_feature: Ceres CLONE 367734
  misc_feature: Encodes the peptide sequence at SEQ ID NO. 8280
agaacttgcaaattcgatattgagaatttgcgatacccgataccgatctaggagaagagaaaggcgtcatgtcgtcgttcggacgcaattcatggtgtatcctcgtgctggcctccgtgctcctcctgtcctgcctcgccgagacggccgtggccaaccgaacaggcgagctcaccgtcttctggggccggaacaaggaggagggcaccctgcgtgaggcctgcgacacaggactctacaacaccgtcatcatctccttctacagcgtcttcggccacggccgctacgccctcgacctctccggccacccgctggacggcgtcggcgccgacatcaagcactgccagtcccagggcatcccggtcttcctctccatcggcggcgggggaaaccactactccatcccttcctccgcgtccgcggaggccgtcgcggacaacctgtggaacgcgttcctcggcggcggcaacagcgacgtgccccgccccttcggtgacgcggcggtcaacggcatcgacttctacatcgacgaccacagcgcaccgggcgaccactacgacgagctcgcgcgccgtctcgactacttcaacagcatgtactaccacgccacgacgaagtacgtacggctgacggcgacgccgcggtgcgcgttcccgcccgacgaccccatggcgcgggcgctgcggacggggctgttcgagcgcatccacgtccgcttctacggcgacgccgacaagtgctcgtacaagaacggcgacgtgtccggcgtcgtggaccagtggagcaagtggacggcgaggtaccccaagagccagctttacgtggggctcgccgcggccgagagcggcgtgccggaccacgcgccgccccccgttgaggtctacctcaaatacctctactacgatctgctgcccaaggtgcagaaggcgcccaactatggtggcgtcatggtctggaataggttcaccgacaacaggaccggatacagcggcgccgtcaagggctgggcggcttgcagctatgctggctgtgttaactaagtgcatagcgcatgtataaaccacgtaaataattcgtataaggtgcaagtataaataaacacaagagactttcgtgataatcgaatgtttctttatgtctaaaaaaaaaaaaaaa

SEQ ID NO: 8280 - protein, 323 aa, Zea mays
  misc_feature: Ceres CLONE 367734
  misc_feature (33)..(301): Pfam Name: Glyco_hydro_18 Pfam Description: Glycosyl hydrolases family 18
  misc_feature: SWISSPROT Homolog: EC 3.2.1.14 Chitinase
MSSFGRNSWCILVLASVLLLSCLAETAVANRTGELTVFWGRNKEEGTLREACDTGLYNTVIISFYSVFGHGRYALDLSGHPLDGVGADIKHCQSQGIPVFLSIGGGGNHYSIPSSASAEAVADNLWNAFLGGGNSDVPRPFGDAAVNGIDFYIDDHSAPGDHYDELARRLDYFNSMYYHATTKYVRLTATPRCAFPPDDPMARALRTGLFERIHVRFYGDADKCSYKNGDVSGVVDQWSKWTARYPKSQLYVGLAAAESGVPDHAPPPVEVYLKYLYYDLLPKVQKAPNYGGVMVWNRFTDNRTGYSGAVKGWAACSYAGCVN

SEQ ID NO: 8281 - DNA, 359 bp, Zea mays
  misc_feature: Ceres CLONE 367746-F
actaatttctttgtgtgccgattcgattcgatgtgatggattgattccatccatggtttctgttcgtccttttcctcgtattgctactccggattgagccaaaccctaggccgtggggggctgacggagggcgcggtgagcggggtctccactatcgatagcatgcgtggcgggtactctggccgctgtggcttcgctggcggccggcatagcagcagccgcagcaacgatggcaggggataccacgggaacccttgcttgacgatgcaccaaccgtgggcgtccctgctggtgcacggcatcaagcgtgtcgagggccgctcatggccatccccaatcacaggccgcctgtggattca

SEQ ID NO: 8282 - DNA, 481 bp, Zea mays
  misc_feature: Ceres CLONE 367756-F
  misc_feature: Encodes the peptide sequence at SEQ ID NO. 8283
gatcaggagaaccaaaggggtagtgaaggtggctacagtgctggtggctatgggcaagctcctccacaagctcctccttcgtatggtggtcctgcgggtgattatgcagcacctccgagctcctatggaggcaacaatgcttatggttcagattctgcagtgccgcctcctaatagctacagtggtggcccaggctcatacccaccaagctatggtgccccgcctccacaccaatatggtggtgccccaggggggcaagggggtctgcctcctacatatgatggtggatatggtggtcggtccatgcctgggggtggaggatctgggggtgcaccaccgccttatcatggtggcggcagcggttatactggtagtgctgaccctgaaccagctggaaaagttaagcagtgcgatgaaaattgtgacgagacatgtgacaacgcaaggatttacatctcaaatttgcctcctgatgtcactg

SEQ ID NO: 8283 - protein, 160 aa, Zea mays
  misc_feature: Ceres CLONE 367756-F
DQENQRGSEGGYSAGGYGQAPPQAPPSYGGPAGDYAAPPSSYGGNNAYGSDSAVPPPNSYSGGPGSYPPSYGAPPPHQYGGAPGGQGGLPPTYDGGYGGRSMPGGGGSGGAPPPYHGGGSGYTGSADPEPAGKVKQCDENCDETCDNARIYISNLPPDVT

SEQ ID NO: 8284 - DNA, 448 bp, Zea mays
  misc_feature: Ceres CLONE 367766-F
  misc_feature: Encodes the peptide sequence at SEQ ID NO. 8285
aagcacaagtgcacaaccaacagcaaagaagagacgacgtcgatcgatcgatatctcagcaaccaagcaggtaggtaggcatggcggccgagaaggagggcgcggtggtgaccaagggccacgacgaggggatgaaggcggcggcggcgctgctggaggagttcgggctcccgccggggctgctgccgctggaggacgtgacggaggtggggttcgtgcgggccaccggctacttctggctcgcgcagcgcaagaaggtggagcaccggttccgcaagatcggcaagcaggtgagctacgacgtcgatatcgccggctacgtccgccgccgccgcggccctcccatctcacaaccacggcgccgtctcatcctacgtctccacctcctcctacgcgctcgcagcctccgccgccttcccccgcgcccgagctgcgttcgccgtcggca

SEQ ID NO: 8285 - protein, 122 aa, Zea mays
  misc_feature: Ceres CLONE 367766-F
  misc_feature (1)..(122): Pfam Name: DUF538 Pfam Description: Protein of unknown function, DUF538
MAAEKEGAVVTKGHDEGMKAAAALLEEFGLPPGLLPLEDVTEVGFVRATGYFWLAQRKKVEHRFRKIGKQVSYDVDIAGYVRRRRGPPISQPRRRLILRLHLLLRARSLRRLPPRPSCVRRR

SEQ ID NO: 8286 - DNA, 488 bp, Zea mays
  misc_feature: Ceres CLONE 367843-F
  misc_feature: Encodes the peptide sequence at SEQ ID NO. 8287
  misc_feature (436)..(436): n is a, c, t, g, unknown, or other
actagagagtgtgcgacacttattacacgcagctctgggttttgacagcccgcccgcccgcccgccgcgcctccctcgtccagtggggagctgccacattcctctacccggatcaccttgcgtgtccggctggcacctgcggccttccccctccccgcgcgttgcattggctagctccggtccgatccatcctgctggttctggcttccatgagaccctgacctgaggcgcggtacgtacggtagcagcagcctggtcaattagttagctagcccgagccccatggacaggaggatggacaggctcctcgcctcctgtataccgggcatggaggcggcggaacgggaagacgaggggctggagctcagcctctcgctgcacccgttgccgtcgtcgccgcccaggttccaggcggtcttcgcctgctgctactgcnccaggaagttccgcagctcgcaggcgctcggcggccaccagaacgcgcacaa

SEQ ID NO: 8287 - protein, 68 aa, Zea mays
  misc_feature: Ceres CLONE 367843-F
  misc_feature (52)..(52): Xaa is any aa, unknown, or other
MDRRMDRLLASCIPGMEAAEREDEGLELSLSLHPLPSSPPRFQAVFACCYCXRKFRSSQALGGHQNAH

SEQ ID NO: 8288 - DNA, 488 bp, Zea mays
  misc_feature: Ceres CLONE 367861-F
  misc_feature: Translation starting site: 148
  misc_feature (103)..(103): n is a, c, t, g, unknown, or other
attccattccctgtgctagcccggcgcccgctcgccctgcctgccactcccgccgcgtgctgcctaccagcaggccaggcsaggcacccctgccctgtccgcnaccagmacaaccgcgtgcgccaggtccggtcggcacatgccaggatggagaccccttcgtcgacgtgcgacgagggctccgagctcgacgcgcgctcgcactccgactacgccgacttcgacgacctggacctcccgccgcggggctgccaccgcgggacccgtcctccgacgcgtcctccgagtgcagcggggagcccgggagcccgtacgcctcctcgccgtacccgcgctggccggtgtgcacgcttcctgcgagggtgctgccgcctggccgcgccgctgctcaagaggctcggcacgacgcggcgcggcgcccgtgtcggcgcgtgtgacgggaaggccggcgacggcgagctgcagctgatcaaggagaggttctccaa

SEQ ID NO: 8289 - DNA, 441 bp, Zea mays
  misc_feature: Ceres CLONE 367863-F
  misc_feature: Encodes the peptide sequence at SEQ ID NO. 8290
gagcgcagcagatgtcgtgcggtgcagtgcaggtgcgggatctctgaatcgctgacgcccagcctcctctgtcatctccctcctcggacctcgccacctcacgcggaaggaggggaagaggaagcgcggagactggaaatcggaccccaaatccgcttcggtctctcgatcggcgaggcatgatttatacaaccggctaggatggcctcaaaagctataaaaagaaggcctatcagcgctgagactgataaaacaggggaaaatcaaatggatacagcactgtcagatcctgtaacagaacctcttctaggaaacactcctcaggaagagaaatccaagacatatgagcctattacaaggtcaggtttctgggatgcgacgacacaggagtgtcttcgttggacacatcttttagcagcttttgttgctcaatctgcaaga

SEQ ID NO: 8290 - protein, 80 aa, Zea mays
  misc_feature: Ceres CLONE 367863-F
MASKAIKRRPISAETDKTGENQMDTALSDPVTEPLLGNTPQEEKSKTYEPITRSGFWDATTQECLRWTHLLAAFVAQSAR

SEQ ID NO: 8291 - DNA, 482 bp, Zea mays
  misc_feature: Ceres CLONE 367887-F
acacacattcctcactcccatcccagccgccacacggtggacgctgcagccgctgcggcctgcagacagctgctgctcgccctctccctgtctcctctctctttcccagccacggtttctccttcccccgtccgcacgctagggcacgaggcaaatctgtggccctctcctagtctcctgaagttcgactcagccgtctcccatctcccactcgctcgaactcgggttggggaggcacggagtcactgaccccttcgcgttaggcggtgcccctgcaccggctcttcgtctaaggtgtagtcaagctgcaggccacgcccggcacccccctgatccagtacaaggccttctccgagatccagtacaaggtcgtctccaagatccagtacaaggtcgtctcctccaagatctgaccccgacgctagtggggagggaagagagggtggacgaagtgggggaggatgagcgaggagaggccggtg

SEQ ID NO: 8292 - DNA, 240 bp, Zea mays
  misc_feature: Ceres CLONE 367896-F
  misc_feature: Encodes the peptide sequence at SEQ ID NO. 8293
atcccaaacacaacacactactaccctacccgtccgcctctctcgaaggcgcagcaccagcgagcatgtcgcctgtcaccgcactcctggcgggcacggtggtgccgccggcctcggccccggccccgtcgccggcgaggcacgcccgccattactccgtcggcttctccccgctccacggcggcgggcgcgcggcgctggcggtggagtgctcgtcgcggccgcagaagaaggggacca

SEQ ID NO: 8293 - protein, 58 aa, Zea mays
  misc_feature: Ceres CLONE 367896-F
MSPVTALLAGTVVPPASAPAPSPARHARHYSVGFSPLHGGGRAALAVECSSRPQKKGT

SEQ ID NO: 8294 - DNA, 961 bp, Zea mays
  misc_feature: Ceres CLONE 367907-R
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
attttttgtgtttttttgcccccccccaaaaaaaaatattatttataaacattannnnnnnnccaattgggtacgggcaccccctccaggccacccctcgagaacgaggtatcgataagcttttttattattcttttaggaaaagcctttgaaaaaaatattgtctgctggtggcaacaagtcgttttacaacaactgtgaaacgatatataaaatgctaaccgaaaactagatagatccacacaccatataattgtttgtgcgtaacacagctagatcggtcatgttagcctggaccaattttggggatgtcgtattggtcgctgagcttagctaggtactggttgaagtcctgcatgcggtccttgtgcgacttgttggcgactttggctatcttctgcatgtcgatcttctgcttttgttccatgaaacggcactctgctgatgtgagatggcccccccccaacacgtgagttttcttcatctccattcttatcagattcagtctgagacgactcctcacgctggtacctccccttactttcctttattccaccatctctaacatcctagccctttaaaccttttgctttcaaccatcctcttaacgtacaccttttgaaactccaaacatctttgcctctaacctaccaattccccactaaagttggtaaaagaagacttacctttttatacaccaagaagatggagactttcaggagcgttttttccggattatcgaaagatcctaagggtatatgaggttttcttctcaaaatttcctgcacgctccccgaggggattctccataggtttttgtagtaaccggtctatctaaacacactagattggaagcttcaccacctttttagtcttcccctttttcctgtaaggggtctaatttgtccacagacctttggggcgcgaatccaatagtctccactaaccctattttatctct

SEQ ID NO: 8295 - DNA, 673 bp, Zea mays
  misc_feature: Ceres CLONE 367956-R
cgattgggtaccgggccccccctcgaggtcgacggtatcgataagcttttttttttttttttttgacctcagaagtgttttaccagcatacagtgccttttgtttagcgtgagagaggacactcaaattttgacagtagcttaaagccatcttttgttaatacaagtagatagaaggtctaactacaaaactaccagaatttagtgcatgctataaacgatggctcctcttgcgcaatgctaagcaatatctttatcgatgggctgaatatgtcaatcccatgcccagctcagttattcaatcgtcaccaaaggcgattctcgatcacagctacaatgatatccttcagtgttacctgagaatgatctttcagacccagagaaataaccaatgaccgagctgagccactgccacttcgtcttgacaacaggcacgaagatgaagttggaaacttcagtcttacgattcgaatacgaagctattgaccagttggatggaggcttttgactggccagatgaagggaaatccataatgcttgttcaacacatctataaggaaaaagacgacaatgcctttagtggattttgtagtttgtatatataggaaatgagggcatgattgtaatttcatatgaagttgtacgccagatcgtcactatcaatagaggcatag

SEQ ID NO: 8296 - DNA, 759 bp, Zea mays
  misc_feature: Ceres CLONE 367986-R
ttaatttggtataatttattaatattaatttattgtgttgtaagcaagattgttgggttgcaattgggtaccgggccccccctcgaggtcgacggtatcgataagcttttttttttttttttttgaaacaagcccttgaaaataaatattgtactgctggtggcaacaagtcagttttacaacaactgtaaaacagatatatcaaatgcttacagaaaactacatagacccacacagcatataattgtttgtgcgtaacacaactagattggtcatgttagccaggaccaactttggggatgtcgtaatggacgctgaacttacctaggtactggttaaaatcccgcatgcggtccttgtgtgacttgttgccgactttgactatcttctgacatgtcgatcttctgcattctgttgcatgcatcgccattctgctggtgtgagcatggccataggcaacatgtgatttttcttcacctccattcttatcatattcaagctcagacaacaccccgcgcaggtacttcatcctctgtgactttactccaccatctttaacctccaagcgttttaacccttcaggttcataccgtcccccaaccgaccctttttgggattcccaaccttctttgctggagaacaagaaaaaatccaggtaggaggctggtagaaggagaactggaccgatcaaaaccacgaatggatgaactgaaaaatacccccgtttggtgtgttcttttcgaaacttgaaaaaaatag

SEQ ID NO: 8297 - DNA, 1226 bp, Zea mays
  misc_feature: Ceres CLONE 368006
  misc_feature: Encodes the peptide sequence at SEQ ID NO. 8298
acaagggtgcacgttcaggaggagctctcgtggcgtcctagtctgtggaaggtccaaagaagaagatggacggcgagatggacgaggacgtgctcacggagatcctcgcgaggctgccgtgcaggtcgctggcgcggttccagtgcgtgtccacgtcgtggcggcgcatcatctccagcgactacctccgccgccggctgccgctcatcacgtcgggcgtgctctaccacgatggtggcaggaggcagcagtcgtacacgtacgcgtgcgcgtcaggcggcggcggcggcgccacggcggaggccgcggacatgcgcttcttcccgcgccacgagacgtccaccatcatcgacggctgcaacggcctgctgctctactacgcgtcccgcccggcggcgttccacgtcgtgagcccgaccacgcggcggtgggcggagctgccggcgccgcgcgccatgacgctgctctccgtgctggccttcgacccccgcgcctcgccgcgctaccgggtggtgtgcttcaccggctggctgccccggggcgccaccgtcgaggtgttcgactccgagcgcggcgcgtggcggggccacgagctcgacttcggcctcggcaccgacgccatgtccgcctccatgcactacgccgccggcgcgctccacgtgctggcctactcgggccacgtcgtccgcgtcgacctcgacaccatggcgtgcgcggtcaccccgctcccggcgcccgtcagctgccgcgcgcgcgccgggcactgccgcggccgactgcggttcgcgtccagcgacggccagcgcctcaggatctgggagctccgggacgccgccgcgggcgagtgggcgctcaagcacgagatcggggtcagcgacgtcgtccccggcgccgcggcgtcacagcccatcacgttcctgttcatggcgttccaccccgaccgggagctggtgtacctgtggtcgccgtggaagctgctggcgttcgacttggtcgagaggcgcgtccaggaatgggtgttcgggtccgagaaagaaggcacgcatctcatacaggtttggctgttcccgttctcgcgccatttggccaacgcgctggcctgatcaggccggcttgccgacgagccaaaaaaacacatggggcgcaaatgttcgttgcctatccagtatccacactgctctgcttgcttaaacattgataaaatatcaagaaaaaaaaaaaaaaaa

SEQ ID NO: 8298 - protein, 345 aa, Zea mays
  misc_feature: Ceres CLONE 368006
  misc_feature (4)..(47): Pfam Name: F-box Pfam Description: F-box domain
MDGEMDEDVLTEILARLPCRSLARFQCVSTSWRRIISSDYLRRRLPLITSGVLYHDGGRRQQSYTYACASGGGGGATAEAADMRFFPRHETSTIIDGCNGLLLYYASRPAAFHVVSPTTRRWAELPAPRAMTLLSVLAFDPRASPRYRVVCFTGWLPRGATVEVFDSERGAWRGHELDFGLGTDAMSASMHYAAGALHVLAYSGHVVRVDLDTMACAVTPLPAPVSCRARAGHCRGRLRFASSDGQRLRIWELRDAAAGEWALKHEIGVSDVVPGAAASQPITFLFMAFHPDRELVYLWSPWKLLAFDLVERRVQEWVFGSEKEGTHLIQVWLFPFSRHLANALA

SEQ ID NO: 8299 - DNA, 455 bp, Zea mays
  misc_feature: Ceres CLONE 368012-F
  misc_feature: Encodes the peptide sequence at SEQ ID NO. 8300
aacatcctaatcgaaaaatcccatatcgccaagtccccttcgtcgtccccttccctcgcctcgcgttaggtagcctgcttccgacccgcacatctccctccggttctcgccatgggcgccggcgccaacaaccacgaggagtcgagccccctcatcccagctgcggttgccgcccccgcggacgagaagcccccgcaggctccggcgccggaggccgccaattactatgccgacggggtcccggtcgtgatgggcgagcccgtgtcggcccacgccttcggcggcgtcccgcgggagagctggaactccgggatcctctcctgcctcggccgcaacgacgagttctgcagcagcgacgtcgaagtgtgtcttcttggaacggtagcaccatgtgtgctctatggtagcaatgttgagaggcttgctgctggacaaggcacatttgcaaacagctg

SEQ ID NO: 8300 - protein, 114 aa, Zea mays
  misc_feature: Ceres CLONE 368012-F
MGAGANNHEESSPLIPAAVAAPADEKPPQAPAPEAANYYADGVPVVMGEPVSAHAFGGVPRESWNSGILSCLGRNDEFCSSDVEVCLLGTVAPCVLYGSNVERLAAGQGTFANS

SEQ ID NO: 8301 - DNA, 484 bp, Zea mays
  misc_feature: Ceres CLONE 368019-F
  misc_feature: Encodes the peptide sequence at SEQ ID NO. 8302
cacttcaaagagatctttacttgaggattgcaacagagctgcatttgaaaaggatgttggttggaggacttgagaaagtctatgagattgggagaatattccggaatgaaggcatttctactcgtcataatcctgaatttaccactattgaaatgtatgaagcatattcagactatgaaagcatgatgaatatggccgaagaaattgttactcgatgtgctatggctactcatggcaagcttaaggttgactatgagggaactgaaatctctctcgwkaagaccatggaggagggagaccatgcattctcttgtcaaagaagcaactggaatcgactttaacagctttggacaagacgttgaatctgctaaaagagctgtgaggggactgccaggtttcgttgtagggaacagtgaaagtacttcactgcaagcctgttcatctgttggacatgttctcaatgaggtgtttgaaacaatttgtt

SEQ ID NO: 8302 - protein, 112 aa, Zea mays
  misc_feature: Ceres CLONE 368019-F
  misc_feature (1)..(111): Pfam Name: tRNA-synt_2 Pfam Description: tRNA synthetases class II (D, K and N)
  misc_feature: SWISSPROT Homolog: EC 6.1.1.6 Lysine--tRNA ligase
  misc_feature (92)..(92): Xaa is any aa, unknown, or other
LQRDLYLRIATELHLKRMLVGGLEKVYEIGRIFRNEGISTRHNPEFTTIEMYEAYSDYESMMNMAEEIVTRCAMATHGKLKVDYEGTEISLXKTMEEGDHAFSCQRSNWNRL

SEQ ID NO: 8303 - DNA, 239 bp, Zea mays
  misc_feature: Ceres CLONE 368075-F
  misc_feature: Encodes the peptide sequence at SEQ ID NO. 8304
aacacagcaagccagcagagcagaaagcagccgcagccccagcccccacaagacgaggcaacaatggcgctagaagcagccaccgccccccgcgcactcctcgccgcgtgcctcgtcctgctggggctggggctgggacgttggtgtaatgtggtgaataagcgagtgcatgcaacgcaattggaacttaagacacttttggtaaaacactctttcgtattgaaaaaaaaaaaaaaaaa

SEQ ID NO: 8304 - protein, 48 aa, Zea mays
  misc_feature: Ceres CLONE 368075-F
HSKPAEQKAAAAPAPTRRGNNGARSSHRPPRTPRRVPRPAGAGAGTLV

SEQ ID NO: 8305 - DNA, 435 bp, Zea mays
  misc_feature: Ceres CLONE 368080-F
  misc_feature: Encodes the peptide sequence at SEQ ID NO. 8306
gttccgtctcgcagtggtagcaccgcagcagagagaagagagatcttctagcctagtagtagcatctacttactagtgagtgagtaggagtacttggctaggacgggggggccgtgacgacggtagcagcatgagctgcaacgggtgccgggtgctgcgcaaaggctgcagcgaggcctgcgtgctgcgcccctgcctccagtggatcgacgccgccgaggcgcagggccacgccaccgtgttcgtcgccaagttcttcggccgcgcgggcctgctctccttcatctccgctgtcccggacgcgcagcggcccggcttactgtggtccatggcacctcctcgcagccctgttccagtcgctgctgtacgaggcggcggggcggacatcaacccggtgcacggcgcggtggggctgctgggcacggggaactggca

SEQ ID NO: 8306 - protein, 101 aa, Zea mays
  misc_feature: Ceres CLONE 368080-F
  misc_feature (2)..(101): Pfam Name: DUF260 Pfam Description: Protein of unknown function DUF260
MSCNGCRVLRKGCSEACVLRPCLQWIDAAEAQGHATVFVAKFFGRAGLLSFISAVPDAQRPGLLWSMAPPRSPVPVAAVRGGGADINPVHGAVGLLGTGNW

SEQ ID NO: 8307 - DNA, 448 bp, Zea mays
  misc_feature: Ceres CLONE 368084-F
  misc_feature: Encodes the peptide sequence at SEQ ID NO. 8308
  misc_feature (26)..(26): n is a, c, t, g, unknown, or other
aggaaatctccagcgtccagcactcnagcccatagtgaatctcccggagtcgcccaaaccacagcgacawccatggccgccgccgcctgctattcgccagcgcgcatcatcatctcctgctcagccaccaccacctccccatcgtcgtcagcgcgcacgctgcgcgtygccgtagtggggaggtgagccccgcgggcgcgtcggctgccgabscgctggcctcggcgggggccggacgttcctcctcgagcgcagccccgcaggcgccaagccctgcggcggcgccatcccactctgtatgctggacgagttcgccatcccgcgggacctcgttgaccgccgcgtcacccggatgcgcktgctctccccctccaacctcgcagccgacttctcccgcgcgctgccccccggggcgcacatccccatgctccgccgcgagggtgctcga

SEQ ID NO: 8308 - protein, 50 aa, Zea mays
  misc_feature: Ceres CLONE 368084-F
  misc_feature (21)..(21): Xaa is any aa, unknown, or other
MLDEFAIPRDLVDRRVTRMRXLSPSNLAADFSRALPPGAHIPMLRREGAR

SEQ ID NO: 8309 - DNA, 503 bp, Zea mays
  misc_feature: Ceres CLONE 368098-F
  misc_feature: Encodes the peptide sequence at SEQ ID NO. 8310
aaaagcgcagagcgcatcagcgcagagcaggacagccatggcgacggcggcggcgcagtcccattcgccatcaatggacgcgcgccggtgggacgagtcatcgtaccgccgcggcatcctccgtgcccgcgacctctcgtcccgcaccctcttccgtgccgtcttctttgaccacagcgacgacccggataccgacatcctactcgccgccgcctccagcgacggttccctcgcttccttctccctttcatcctgcatctccgcatgttccactacctcccaggtggagaccgccgccactctggtcgaccctgtctgcatcgtgcaagcgcacagcggacctgcctacgacgtcaggttctaccccgatcaacagcagccgctgctcttcagctgcggggacgatggccgcatcaagggttggaggtggcacgagatgcagagctgccttgtcccgctctccctgcaaggggatcatctagaacccagcacttgacttggtc

SEQ ID NO: 8310 - protein, 152 aa, Zea mays
  misc_feature: Ceres CLONE 368098-F
  misc_feature (90)..(130): Pfam Name: WD40 Pfam Description: WD domain, G-beta repeat
MATAAAQSHSPSMDARRWDESSYRRGILRARDLSSRTLFRAVFFDHSDDPDTDILLAAASSDGSLASFSLSSCISACSTTSQVETAATLVDPVCIVQAHSGPAYDVRFYPDQQQPLLFSCGDDGRIKGWRWHEMQSCLVPLSLQGDHLEPST

SEQ ID NO: 8311 - DNA, 505 bp, Zea mays
  misc_feature: Ceres CLONE 368154-F
  misc_feature: Encodes the peptide sequence at SEQ ID NO. 8312
agctgcaatgctgaacgctgcacacctgtaaaagatagagctatcccctccctccccatcccttggagccagcaactccactcctgagtcctcacctcgtgctgcccgcgccatttccacctcccactgtcctttcgtccagtccccagccctgcagcccaaccgtggaggttctggaaggcggtgtatcccttctagaaccttctcgagatgcagagcgccgcggctttccggccatgccccactcggctgctggtgagcagcccttgtcgccccctcctctcggcccgcccgcttcgtgcctccgccgctggcgccgtcgctaccagaagcagcgccgtgggccctcgcggtctggggctcgggctgctgccagcctcgcccgatcgggatggcaagtgccgccagcgacaggtgtcatgcagcgcggccggggatgctgtggcggcccgaaggcggaaagaaggaggcgggctcatgaagacgctgtggctcggctcgctct

SEQ ID NO: 8312 - protein, 98 aa, Zea mays
  misc_feature: Ceres CLONE 368154-F
MQSAAAFRPCPTRLLVSSPCRPLLSARPLRASAAGAVATRSSAVGPRGLGLGLLPASPDRDGKCRQRQVSCSAAGDAVAARRRKEGGGLMKTLWLGSL

SEQ ID NO: 8313 - DNA, 469 bp, Zea mays
  misc_feature: Ceres CLONE 368164-F
  misc_feature: Encodes the peptide sequence at SEQ ID NO. 8314
ttacaacccgtagacagtcgcgcaaatgttgcgagcggccgcgtcgaggtgcgcccgcggcgccgtccggcggctgtcgtcgtctgcggtgatggaggcttcaccagtcgccgtggggtcgcggtggcagtctctccttgacgagggtgactggtcgtaccatcgggagtggtggggcgaggaggacggccccggcgagggcgtgcagaccgtcttccgccgccactccgagtgcggcaacggcgtcgtctccgtctccgcctaccctgcttcccttccggctagtgagcattggccagccatggagagatggcttcaagagagtaattcaagactatacccagaatcagccagctctgaccagtttaaggtactaggctaccagtggcgagtgatgcgttttaatgaccatacacggcaaagcactgcaaaagtgatgacatgttataggacttcgggtcagagatca

SEQ ID NO: 8314 - protein, 148 aa, Zea mays
  misc_feature: Ceres CLONE 368164-F
MLRAAASRCARGAVRRLSSSAVMEASPVAVGSRWQSLLDEGDWSYHREWWGEEDGPGEGVQTVFRRHSECGNGVVSVSAYPASLPASEHWPAMERWLQESNSRLYPESASSDQFKVLGYQWRVMRFNDHTRQSTAKVMTCYRTSGQRS

SEQ ID NO: 8315 - DNA, 411 bp, Zea mays
  misc_feature: Ceres CLONE 368172-F
  misc_feature: Encodes the peptide sequence at SEQ ID NO. 8316
  misc_feature (58)..(58): n is a, c, t, g, unknown, or other
  misc_feature (59)..(59): n is a, c, t, g, unknown, or other
  misc_feature (137)..(137): n is a, c, t, g, unknown, or other
  misc_feature (138)..(138): n is a, c, t, g, unknown, or other
  misc_feature (202)..(202): n is a, c, t, g, unknown, or other
  misc_feature (373)..(373): n is a, c, t, g, unknown, or other
ctgttcccctcccaagaaaccccacatttgcatgggcaagcacctacctgccgccgcnnccgccgccgccgccgccgcgttcgctcatacgcccgcagccttcgcgtcccatccgataccgccgcatccgccggganngcagataagacgccgtctgccccgctggatacgcccaggaaatccgctgccgccgctgccgcgncagctccgggcgggccgaggtgcgggatttggcggcggcgtgcgggctagaggcggacgagagggttccgctcgcgaggtggtgtcggactgcacgaggcggtggttccaggacgcactcaaggaggcgcgcgccgccgacatcaccatgcaggtgctcgtcggccagatntaccgcagcggatacggtgtcaacaagaacgagcacaa

SEQ ID NO: 8316 - protein, 126 aa, Zea mays
  misc_feature: Ceres CLONE 368172-F
  misc_feature (10)..(10): Xaa is any aa, unknown, or other
  misc_feature (36)..(36): Xaa is any aa, unknown, or other
  misc_feature (114)..(114): Xaa is any aa, unknown, or other
MGKHLPAAAXAAAAAAFAHTPAAFASHPIPPHPPGXQIRRRLPRWIRPGNPLPPLPRQLRAGRGAGFGGGVRARGGREGSAREVVSDCTRRWFQDALKEARAADITMQVLVGQXYRSGYGVNKNEH

SEQ ID NO: 8317 - DNA, 453 bp, Zea mays
  misc_feature: Ceres CLONE 368200-F
  misc_feature: Encodes the peptide sequence at SEQ ID NO. 8318
aaaaaacacaagacctcctattcaccatgccgaccgaagagggttccgacggcggtggcggcgccggagccggagccggggagaagaagagctcgcaggcgcccgcaaagcctggagcgtgcggcgccgcaaagttcctcgcggggttgccgtcgcgcggcaacttctcttccggctccgccccctccaatctgggagggttcagggtttacgtctgcgagcacagcacagatcccccagaaggacaagttataaagacggattcaacgaatattttaatcaggcatctccagttgaacaagcagaagactgagggcaaagatgtggattccagaactgtcggcgaaaacaacagagggaaaagatctgctgccagaagtttggatgtcaacaattcagcaaagaaggctaacttgggtacttcatctggatcatcagcctatgaggaaattt

SEQ ID NO: 8318 - protein, 142 aa, Zea mays
  misc_feature: Ceres CLONE 368200-F
MPTEEGSDGGGGAGAGAGEKKSSQAPAKPGACGAAKFLAGLPSRGNFSSGSAPSNLGGFRVYVCEHSTDPPEGQVIKTDSTNILIRHLQLNKQKTEGKDVDSRTVGENNRGKRSAARSLDVNNSAKKANLGTSSGSSAYEEI

SEQ ID NO: 8319 - DNA, 822 bp, Zea mays
  misc_feature: Ceres CLONE 368212-R
  misc_feature (14)..(14): n is a, c, t, g, unknown, or other
  misc_feature (82)..(82): n is a, c, t, g, unknown, or other
ccaattgggtacgnggccccccctcgaggtcgacggtatcgataagcttttttttttttttttttacgcatcgaatcatgantggtgtgttttattcatatatatataacaatcagggagtcgatacaagccagtcaaactgacaatcaggcagtcgataggtagatgtatgtagcccgcggcagcaggcgtgccggcggcagccgcgatcggtcaggactcaggcggcggtgacggcgatcttcatgccggactggcagtggccggggatgctgcagatgaagtagttggtgcccgcgggccagcgtgacgcggtcgtttgcggacgtgtacacctttggcaccccgcggcgccgaagcagccttttgtaccccgggccgcgtttaaccgcaaccacgtttgtgccccgtccaagtcgaacctgtaaaactggacccgggccggccggggggggccccaaccccccccccccaaaaagtcccaaaaaaattcccaatctaaaaaatctccaaaccccgtgggcggggtggaattttttgtgttgtgtaaaaaaaggccccccaaaaaccctataaaaaggggaaaaacgcggacccccctttttaaaaacccccccccgggcggccaaaggggtgtttttttgaaaccctttttttaaaaagaggggcccacccgcgggggacacggggtggggggggggtgaaaaaaaaaaagaaagggggcgcccgccaaaaaaaaaattctctccggggcggcggggttataaaaagagggggtagaaaaaaattttcttccccccccccccccccccccttgtgtta

SEQ ID NO: 8320 - DNA, 442 bp, Zea mays
  misc_feature: Ceres CLONE 368247-F
  misc_feature: Encodes the peptide sequence at SEQ ID NO. 8321
attaggcaggggcgagagagtagtcggcagatctaccgtagcaatggcagagacggtcgggtccatcgtcgtcggcgaggtggtgaaccggacctcctccttcawtctcagcaagcacagggagcgtctgagcacgcgcgaaggcatcgagcgcctggagatggcgtacgtaaagatggaggccgcgctggagctgtccagccgccccggccgttggcagcagcaggccaccgccaccgccaccgacgcgtctctgctccgctggcgccgcaractgcggcgcgccgcggacgagtgcgacgccgcgctgcgccggttgaagctgcgcgagctgcaggaggaggacgcccgggcgaggctggcgcgggcgccgctcccgcgccgcgtcgcgcgcgcgctcctgtgcctcgcgtcggcgctcctgctgctcgcccgcggcggc

SEQ ID NO: 8321 - protein, 133 aa, Zea mays
  misc_feature: Ceres CLONE 368247-F
  misc_feature (21)..(21): Xaa is any aa, unknown, or other
  misc_feature (77)..(77): Xaa is any aa, unknown, or other
MAETVGSIVVGEVVNRTSSFXLSKHRERLSTREGIERLEMAYVKMEAALELSSRPGRWQQQATATATDASLLRWRRXLRRAADECDAALRRLKLRELQEEDARARLARAPLPRRVARALLCLASALLLLARGG

SEQ ID NO: 8322 - DNA, 403 bp, Zea mays
  misc_feature: Ceres CLONE 368283-F
  misc_feature: Encodes the peptide sequence at SEQ ID NO. 8323
aaactttcactatcttctgcgcagcagcctcttcttccccgatcccgactccaactctccctctctccttcgcctcggcggcacggcagcctgcttcttcaccggggtggctgcttcttcaccggcgcggcggcctgcttcttcacccgcgcggcggcctacttcttcgacgacgcggaggcctgcggcggacgcgacgcggcggccttccgggcggtcggatccgcggacgaacggatctccggcgcctgtcagatcttcgaacgcggcgcggtggcctaccgggcggacggatccacggatgaacggatctccggcgtcacggcttgcttcttcaccggcgccgcggcctgattcttcgacggcacagcggcctgccggtcttctccaggcgggcggacgc

SEQ ID NO: 8323 - protein, 134 aa, Zea mays
  misc_feature: Ceres CLONE 368283-F
NFHYLLRSSLFFPDPDSNSPSLLRLGGTAACFFTGVAASSPARRPASSPARRPTSSTTRRPAADATRRPSGRSDPRTNGSPAPVRSSNAARWPTGRTDPRMNGSPASRLASSPAPRPDSSTAQRPAGLLQAGGR

SEQ ID NO: 8324 - DNA, 415 bp, Zea mays
  misc_feature: Ceres CLONE 368296-F
  misc_feature: Encodes the peptide sequence at SEQ ID NO. 8325
aagttaccaaattgccacttccgtacccagacccggacgtgtggaaacagaaacagcaatggcggagaggctggtgccgagcacgaagaaggcgatggagcaccgggaggagaagcccaaggtgccgtctagcgacccgggccccgaccccgacctggtgcagctggtggccgggcagcagccgcagctgcagcgggagcagcagccgcccaacatctcggagatgaagccgctgacgcgggaggcgtacggcggcgggatgtacgcggccgaggaggagggcggccgtcggaggggccccgcgcggccgcgcgcgagcgccacgctakagcgccgacgggcccgaggagcagcgcgctggcgcgaggcccagccacccgccgccgccgtccaccggcgaccgcgacctcgacat

SEQ ID NO: 8325 - protein, 119 aa, Zea mays
  misc_feature: Ceres CLONE 368296-F
  misc_feature (91)..(91): Xaa is any aa, unknown, or other
MAERLVPSTKKAMEHREEKPKVPSSDPGPDPDLVQLVAGQQPQLQREQQPPNISEMKPLTREAYGGGMYAAEEEGGRRRGPARPRASATLXRRRARGAARWREAQPPAAAVHRRPRPRH

SEQ ID NO: 8326 - DNA, 908 bp, Zea mays
  misc_feature: Ceres CLONE 368300
  misc_feature: Encodes the peptide sequence at SEQ ID NO. 8327
aatgaacccctgtccgccgccgcctcgtgtggccgttcccgttccgtctcccaggagcgagacccgaagtttctagagccttcgggccgagatggtcgtgttgcacgtgaagttggcgccacccgctgccgccgccgcctcctctcccatgcaggacgtggacgaggagacggagttcctgtacgagtgcgccgcctctgcggtcgtcgcggacgtcgcggccgccctgggcgcgctcgcgggcctccaggccgccatcctctccctctgccgccgccttcgagcgaggtgtgctggtgcgatgggcgagctcgagagggcgctggacgaggccgaggcctacgcttctaaggagcaggtgcagcgcaacagattcctgtctcctcgtgctctaagggaacatatcaagaacatcgagaagaaatgcgctaatagtctacaagaacctctggaggcgttgtctctgcaagagtcatcatcagacaacaagcatgagagaatacagatttggtgggctgggaaagagctagccatggaccagaagctatccgactatatcggtgttaatgataaaaccaagattgtcgtcaggctaattgaagctcgtgatgagtgttgattgtgctcctacctcttcattgatatcgcagagttggtttcctcttcgataatattagtatatatggatactggtcctcagtccctgtaagatagttttaattcccttgaacaacattcttgtcaactgtattatctgacaataggtataagtggtttgacttcttgtaccagttgcttgtacaatatatcctcagtcctcacagaggcttacttttggggtgttatgtgccagttatcccctttcaataagctggtataaattttaagcgaaaaaaaaaaaaaaaaaa

SEQ ID NO: 8327 - protein, 175 aa, Zea mays
  misc_feature: Ceres CLONE 368300
MVVLHVKLAPPAAAAASSPMQDVDEETEFLYECAASAVVADVAAALGALAGLQAAILSLCRRLRARCAGAMGELERALDEAEAYASKEQVQRNRFLSPRALREHIKNIEKKCANSLQEPLEALSLQESSSDNKHERIQIWWAGKELAMDQKLSDYIGVNDKTKIVVRLIEARDEC

SEQ ID NO: 8328 - DNA, 456 bp, Zea mays
  misc_feature: Ceres CLONE 368346-F
  misc_feature: Encodes the peptide sequence at SEQ ID NO. 8329
gagaaaaagtaatccgacggaaacgacaagggcgcggcgagggcggggacgggaaggccctgggcgcggaggcgccgagcacatggcatcgtcgagggtgataccratcgtcctcgccgtcgcacacggcctcggatctcgcgcgcctagcgcaggccgccagcaggcccggcggcgggggcagcgggccgggctccatgaacgtcgaggagctcctccgcggcatctacagcgacatgcccaccccggcgccgcccgcgtcggaacccggacgcccgatgcccccggccccggcgccggtgagcgccacgcggaagacggcggaggaggtgtggaaggagatcactggcggaggtggcagtggggaagccgtggctcccgtggcggctcaggctgtcgctcccgatggtggcgctggcacaggcggcccggaggtgacgctggaggacttcctgg

SEQ ID NO: 8329 - protein, 86 aa, Zea mays
  misc_feature: Ceres CLONE 368346-F
MNVEELLRGIYSDMPTPAPPASEPGRPMPPAPAPVSATRKTAEEVWKEITGGGGSGEAVAPVAAQAVAPDGGAGTGGPEVTLEDFL

SEQ ID NO: 8330 - DNA, 425 bp, Zea mays
  misc_feature: Ceres CLONE 368378-F
  misc_feature: Encodes the peptide sequence at SEQ ID NO. 8331
aaaaaaaggagtacggagtaccggagacatcgtcaacgccatggccggaggaggtgcaacggtgtgcgtgaccggagccggcgggttcatcgcctcgtgggtagtgaagctcctgctctcccgcgggtacaccgtgcacggcaccgtccgccacctcagtgacgagaagacaggccacctgaagcgcctggagaatgctgccggaaaccttaggatcttcaaggctgacctgctggactacgacgccatggcagctgcggtcgtcgggtgccagggggttttccatgtggccactcctgtgccttcggaggacctgactgacccagagctacaaatgctgggtcctgctgttaccggcaccacgaatgtgctcaaagctgcctccagcgcgaacgtccagcgagtggtggtggtgtcgtccatgg

SEQ ID NO: 8331 - protein, 128 aa, Zea mays
  misc_feature: Ceres CLONE 368378-F
  misc_feature: SWISSPROT Homolog: EC 1.1.1.219 Dihydrokaempferol 4-reductase
MAGGGATVCVTGAGGFIASWVVKLLLSRGYTVHGTVRHLSDEKTGHLKRLENAAGNLRIFKADLLDYDAMAAAVVGCQGVFHVATPVPSEDLTDPELQMLGPAVTGTTNVLKAASSANVQRVVVVSSM

SEQ ID NO: 8332 - DNA, 313 bp, Zea mays
  misc_feature: Ceres CLONE 368389-F
  misc_feature: Encodes the peptide sequence at SEQ ID NO. 8333
  misc_feature (71)..(71): n is a, c, t, g, unknown, or other
  misc_feature (176)..(176): n is a, c, t, g, unknown, or other
  misc_feature (255)..(255): n is a, c, t, g, unknown, or other
awagggagaatgctgcaactccgcgggtkacacgggcggcgactccgcaccaccacaacacccgccgyttnctccttcctccagcctcgccgtcgccagakcagacagccgggagtccgtgcagatgckaggttggcggcaskggggccatggccgcgggacctcgcccccgcgtncccctgcttggyttggccgccgcgcttggtaccagatccggtggcgcgcktkctccgtgggatgtgggccacgccagcnttggagctgcctctattcgtggggcgtggtgcgacatggagttggccgctgccggtgg

SEQ ID NO: 8333 - protein, 54 aa, Zea mays
  misc_feature: Ceres CLONE 368389-F
  misc_feature (26)..(26): Xaa is any aa, unknown, or other
  misc_feature (27)..(27): Xaa is any aa, unknown, or other
  misc_feature (36)..(36): Xaa is any aa, unknown, or other
MAAGPRPRVPLLGLAAALGTRSGGAXXPWDVGHASXGAASIRGAWCDMELAAAG

SEQ ID NO: 8334 - DNA, 458 bp, Zea mays
  misc_feature: Ceres CLONE 368391-F
  misc_feature: Translation starting site: 114
aacaaacaccctctaaactagtcggccgcagtcaaaccctaaaccctggcgagccgcggctacagtatagccaccgcaacaccgcatctcaagcgcaagacctcctcgcggctatggcgaagcgtctgatcccgtcgctgaaccggsgttctggtggagaagctgctgaagcccagcaagagcgccggcggcatcctcctcccggagaccaccaagcagctgaacgccgctaaagtcgttgctgttggccctggtgatcgtgatagggatggcaagctgatccctgtatctctgagcgaaggcgacactgttctgcttcctgagtacggtgggacagaagtgaagcttgcagaaaaagagtaccttcttttcagagagcacgacatactggggaagctcgaggagtagctctggactgttaaaatggagttgtttgaaagtaggtatgcaagagtttt

SEQ ID NO: 8335 - DNA, 402 bp, Zea mays
  misc_feature: Ceres CLONE 368396-F
aggaaaggcggcgaaaaccctcccttgccttgcccagttgcccccaaaccccagccactaatggcggccaccgcgatggaccatgacggcggcgacgacgtggtcactccaggggagcttctcggaaactcattaaccctcgcggccggacgtggcgccykacgccgacggtcgctctgtgcgcgcgtcggtcaccgggcgccgccgcatcgtgccgcccgcacctggctccgacgaccagagatccacggtggaggtggtggggcacaaggcccatggagctgtgccgcagccgggaagcgtcttcatcgcccgagtaacaaaggttatggctagaatggcctctgcagatatcatgtgtgttgactcaaaggctatcagagaaaagttcactggcatgat

SEQ ID NO: 8336 - DNA, 186 bp, Zea mays
  misc_feature: Ceres CLONE 368405-F
  misc_feature: Encodes the peptide sequence at SEQ ID NO. 8337
aatccagtggattgagagtaaagacgggtggtgcaagcaaggcaggcggassgggcaagggcaactgggtaagcaagtgagggatgagaatgagggccgtggtgatcacgtgcgccggcgggccggtagtgctggaggcgcggkaggtggaggaccatcccgcgctaggcgaaggagaggtgctcc

SEQ ID NO: 8337 - protein, 34 aa, Zea mays
  misc_feature: Ceres CLONE 368405-F
  misc_feature (21)..(21): Xaa is any aa, unknown, or other
MRMRAVVITCAGGPVVLEARXVEDHPALGEGEVL

SEQ ID NO: 8338 - DNA, 442 bp, Zea mays
  misc_feature: Ceres CLONE 368418-F
  misc_feature: Encodes the peptide sequence at SEQ ID NO. 8339
caactttgcacagtctgcgcaccctgccacgacgagatggcttcctgttcctcatcgccacggccacccaccatccctctcctcctcctcctcctcttcctcctcctccacttctcctccgtcctcgccgcaccagctcctccagccttgtcacaacaggctggtaccggcggcggcaatgcgacggattcggcggcggcgtggacgccgcggctgaggaagacgttcttggacggcggcatggagcgctggcgcgggcggcggctggtggggcggttccaggtgtgcgcggtgtgcacctgctgcgggggcccgcacgggatgtgcatcccggcgccctgctgctacgccatcaactgcaacatccccaaccgccccttcggcgtctgctccttcaccccgcgcacctgcaactgctcacctgccacctctagctagcgct

SEQ ID NO: 8339 - protein, 133 aa, Zea mays
  misc_feature: Ceres CLONE 368418-F
MASCSSSPRPPTIPLLLLLLFLLLHFSSVLAAPAPPALSQQAGTGGGNATDSAAAWTPRLRKTFLDGGMERWRGRRLVGRFQVCAVCTCCGGPHGMCIPAPCCYAINCNIPNRPFGVCSFTPRTCNCSPATSS

SEQ ID NO: 8340 - DNA, 109 bp, Zea mays
  misc_feature: Ceres CLONE 368444-F
aaaaaagccagatgcctgttgccgtcgcggccactggatgccaagtactttttatatacgccgtccgcgcccacaacccccgaagacccagcctcccctcagtcagtct

SEQ ID NO: 8341 - DNA, 492 bp, Zea mays
  misc_feature: Ceres CLONE 368484-F
  misc_feature: Encodes the peptide sequence at SEQ ID NO. 8342
  misc_feature (306)..(306): n is a, c, t, g, unknown, or other
atcagaatcggaccaccacacgcccgaggcccgactgcaagcgcctgagcccaagacccatggccatggccgccgccaccgtcgcagcgtctctgcccgtggcgcaggggctcgggaagcccctctgcgccggaagcaacgcgccgtcgctccgggccgtcgggcgcgccccgtcgtcggtcggccaggaccaggatggccgtcgtccgggcgtccgcgcaaaagcagcacccggccaaggagtgggcggccgcggctgccgtggcggcggcgctggtgcttccggagtcgcggaggccgcgccgnggatctccccgtcgctcaagaacttcctcctcagcatcgtctccggtggggtcgtgctcgtcgccatcgtcggcgccgtcgtcgccgtctctaacttcgatcccgtcagcggggttgagctgcatgcgtcgttgtgtgttgttgtacctatgtactgagaatctctctccccgtgtgcttcccaat

SEQ ID NO: 8342 - protein, 132 aa, Zea mays
  misc_feature: Ceres CLONE 368484-F
  misc_feature (81)..(81): Xaa is any aa, unknown, or other
MAAATVAASLPVAQGLGKPLCAGSNAPSLRAVGRAPSSVGQDQDGRRPGVRAKAAPGQGVGGRGCRGGGAGASGVAEAAPXISPSLKNFLLSIVSGGVVLVAIVGAVVAVSNFDPVSGVELHASLCVVVPMY

SEQ ID NO: 8343 - DNA, 324 bp, Zea mays
  misc_feature: Ceres CLONE 368514-F
  misc_feature (242)..(242): n is a, c, t, g, unknown, or other
acctcgccccgtttcttcctcgaacagattctctgccccaccccgattctacctataaatcacaactgcacacccccgaatcccggcaaaacccaacggccgawgctaagctcgakccgccgcytgatgatcctccgtatccgcagccgckacggcacgttccgcatcacggtccagactcggcctcagtcaccgtcgccgacctgcagcgcctcatcgagtcgcacctcaccgtgcccgtnccgctccaggcctctccctcgacccggccctcctgctccctaacccctccgccgttgtcccactcctcaccgactcggcggc

SEQ ID NO: 8344 - DNA, 479 bp, Zea mays
  misc_feature: Ceres CLONE 368534-F
  misc_feature: Translation starting site: 166
acaaaactgaaccagcaacaaaccgatgcccatgagattgacatggtgatcgagctacaggccggtcgtcttctccaacgctagacaacgaagaaggagcaattaatcaagtagatcgattcaatccaatccaatggggttgctgataccagcccgtccggagcaatgcacgttgagccgtgtcgtgtctctcatcaccgtcggtgtcgtcatcgtggtttgcacgtacgtcacatcttctccggccggtggcgacgcgggaaggaggagttcttcagcatatggcaccgtcgatcatcggattttgtccccgacgatctggaggtggcgctgcgcggcgcasstacgcgaaacaggacgctgatcctgaccatgctgaacaagggcttattcggaggatggcggcctcctcgacctcttcctcgagagcctgagggaaggggacggcaccgagcagttgatcgaccacgtcctcttcg

SEQ ID NO: 8345 - DNA, 490 bp, Zea mays
  misc_feature: Ceres CLONE 368538-F
  misc_feature: Encodes the peptide sequence at SEQ ID NO. 8346
aagactccctccccaaaagatccagccgccgcgcgccgcggcccctgagcctgtgagcgaacgcagaagagggtttccgtgccgcgccacacgacccccccggcgggcgatggacaccgaccacggcggcgcgtcggccgcgggcatggacgaggcggaggcggccttcttcgcgcgcgggggccggcggtgctgctgcttcccctgggccgccgcctcctcctcctcatcctcctcccaccagcgggtcggcggcggcgccgcggcggcggcggcggaggagacctggtggcagcgcgcggtggacgcggtgctcaaggtgcgcgagtggtcggagctggtggccggcccgcggtggaagaccttccatccggcggttcggccgcagcggcccgcccgcgcggccgcaccaccaccacttcggcggccgcaagctcaactacgacgcgctcagctacgcgctcaacttcgacgagggccacggcgccag

SEQ ID NO: 8346 - protein, 127 aa, Zea mays
  misc_feature: Ceres CLONE 368538-F
MDTDHGGASAAGMDEAEAAFFARGGRRCCCFPWAAASSSSSSSHQRVGGGAAAAAAEETWWQRAVDAVLKVREWSELVAGPRWKTFHPAVRPQRPARAAAPPPLRRPQAQLRRAQLRAQLRRGPRRQ

SEQ ID NO: 8347 - DNA, 468 bp, Zea mays
  misc_feature: Ceres CLONE 368539-F
  misc_feature: Encodes the peptide sequence at SEQ ID NO. 8348
aagacctcctcgcggctatggcgaagcgtctgatcccgtcgctgaaccgggttctggtggagaagctgctgaagcccagcgagagcgccggcggcatcctcctcccggagaccaccaagcagctgaacgccgctaaagtcgttgctgttggccctggtgatcgtgatagggatggcaagctgatccctgtatctctgagcgaaggcgacactgttctgcttccggagtacggtgggacagaagtgaagcttgcagaaaaagagtaccttcttttcagagagcacgacatactggggaagctcgaggagtagctctggactgttaaaatggagttgtttgaaagtaggtatgcaagagttttgccacggcttatcttttttttttgtacgggggaacaaatgagaaacacaacccttgtgagaatgcaataacactgcctcattcttgacatcatcatttgggatgtca

SEQ ID NO: 8348 - protein, 97 aa, Zea mays
  misc_feature: Ceres CLONE 368539-F
  misc_feature (4)..(95): Pfam Name: Cpn10 Pfam Description: Chaperonin 10 Kd subunit
MAKRLIPSLNRVLVEKLLKPSESAGGILLPETTKQLNAAKVVAVGPGDRDRDGKLIPVSLSEGDTVLLPEYGGTEVKLAEKEYLLFREHDILGKLEE

SEQ ID NO: 8349 - DNA, 474 bp, Zea mays
  misc_feature: Ceres CLONE 368558-F
  misc_feature: Encodes the peptide sequence at SEQ ID NO. 8350
acatgtgcatctcagcagcactagcagtgacaaactcgaagcttgccttctagcttgtttacaccccaaaactaaaactagagtcggcggcggcaacaagcggtacgtagaggatgaagagcaggagcagcactctgttggtgatcctagttctccaggcccttctgctctctgcggctgtggccaaaggacctgcagggccgaagaagcagtgctggtgcggcgagtgcaccagctggtcgggcgtgtggacctgcgacgacctcctcaccaagtgcgccgccacctgcaagaactgcgtccccgtctccacggacaagggcgccaccaagtacagatgccgcgacttcctccccgaaaactgcggctgcaagatccactagagactcatccaatcaaccatggccacagccgatggacccttcttccatatgcatgctctcctccgtccgtccgcctagcttgctacaagca

SEQ ID NO: 8350 - protein, 89 aa, Zea mays; identical to SEQ ID NO: 3974
  misc_feature: Ceres CLONE 368558-F

SEQ ID NO: 8351 - DNA, 453 bp, Zea mays
  misc_feature: Ceres CLONE 368596-F
  misc_feature: Encodes the peptide sequence at SEQ ID NO. 8352
acgataagccctaatccccgccacctcgatggcgaccacctctttcttccatccgctcgccgccccgatggaccgcggtggcgtttgttttcgtcgctacccgttcaaaaaccatccccgcccgtacagcgccccggcgaccggcgccgcttctcgtcgtccgcgctaagsssccggcagccaggcccctgctgccgccgcctcgcgtcassccgcgaatcccagcgcggtcccgaagcgggacgtggaaagaagaggaggaggaggtcgaggaggagatgccctggatccaggacaaggcgctggacctcgtggagttcactggcaccgtcacacaggccatcccagggccccgtgtcgctctagccctgttccatggcttctcgcggttcccctcgcctacgtcggggtctcctttgtgctcgcggtcgtcggcaccgtgcgcaggttcac

SEQ ID NO: 8352 - protein, 58 aa, Zea mays
  misc_feature: Ceres CLONE 368596-F
MPWIQDKALDLVEFTGTVTQAIPGPRVALALFHGFSRFPSPTSGSPLCSRSSAPCAGS

SEQ ID NO: 8353 - DNA, 492 bp, Zea mays
  misc_feature: Ceres CLONE 368598-F
  misc_feature: Encodes the peptide sequence at SEQ ID NO. 8354
tctgttcttcctggttccgtcttcttcctcgagcagacagcgagagacccgtggccttttagatcccgggcttcagatctgctgtttcttcttcggtttggttctagttctagcagtgtactagtagtcgttaggttggtagccaagagaggttctttttccacacctcccttgcgcaagtgagtcctgtcctgagcggatctacccaccactgccatctgtttttactgtggctgttgggttccgccagtttcttcgtttgttcttggtttgctagagagatagagagaaaaaaaaacaaaaaacaaaaaaaaaacagtctagatggctgctactatagatctgtcaggggaggagctgatgagagcactcgagccttttatccgggatgcctctgctcacggatccagtccgctcctccacccgcaccagccacttagccccccgtcgcgcagatgggattttagacatcctgcgcgggcactagttgga

SEQ ID NO: 8354 - protein, 56 aa, Zea mays
  misc_feature: Ceres CLONE 368598-F
MAATIDLSGEELMRALEPFIRDASAHGSSPLLHPHQPLSPPSRRWDFRHPARALVG

SEQ ID NO: 8355 - DNA, 379 bp, Zea mays
  misc_feature: Ceres CLONE 368603-F
  misc_feature: Encodes the peptide sequence at SEQ ID NO. 8356
aaatcgagaaatcattagacgtcaagaaaacaggtcagcaatggaggccacggcgacgccaagaacccaagaagtgaagcccgtgcccggcacggccaaggtgaccgtggacgaggtgacgctccgcaagttcgagctgtccgacgtggacgcgatgatggcgtgggcgtcggacccgcgggtggccgccgtgtgccggtgggagccctacgagtcgacggagccgctgctggccttcatccgcgacgtggtgctcccgcacccgtggttccgcgccatctgcctccgcggcgagccccgccccgtcggcgccgtgtccgtgtccccgacgggggacccatgccgcgccgagctcggctacgtgctggcgcgcgcgcac

SEQ ID NO: 8356 - protein, 113 aa, Zea mays
  misc_feature: Ceres CLONE 368603-F
MEATATPRTQEVKPVPGTAKVTVDEVTLRKFELSDVDAMMAWASDPRVAAVCRWEPYESTEPLLAFIRDVVLPHPWFRAICLRGEPRPVGAVSVSPTGDPCRAELGYVLARAH

SEQ ID NO: 8357 - DNA, 123 bp, Zea mays
  misc_feature: Ceres CLONE 368613-F
tccaccgggacgctacggcgccgcssgctgcaacccgtcgggagcacgtacatggtggtgttcgggctcttccagctcctgctgtcgcrctgcccagcctccacaacatcgcctggctgtccg

SEQ ID NO: 8358 - DNA, 500 bp, Zea mays
  misc_feature: Ceres CLONE 368615-F
  misc_feature: Encodes the peptide sequence at SEQ ID NO. 8359
aaaaaaaattaattcagcacaaacacaattcgacgacacgtttctttaccctaaacttttcactgcttcgtcgagggcagagccgccgccgtttctcaatctcctcgcagcgccggcgctccatcttcgctcccttccttactcgctctcggcacgcaggcggcggcsctgggctctcggcacgcaggcggcggcsctgggctctcggcacgcaggcggcgaccctgggctctcggcgaccgcgtcagcggcttcccctccggcctctcgccagtcaccgcgcgccctcgcccctggtcctctgcacaccggccggtggccctgcgtgcttgcccttctctctcccctcccgcctccggtggatcgtcaacggcgcccggccccggcggcagcgcggcgcgcgatctcgagggcagcgggagccagcagccgctgctccaccaaggcggaagcaaagcgttacccttcctcttagcgcttcagcgcgctgacgcgtgcgc

SEQ ID NO: 8359 - protein, 157 aa, Zea mays
  misc_feature: Ceres CLONE 368615-F
  misc_feature (56)..(56): Xaa is any aa, unknown, or other
KKINSAQTQFDDTFLYPKLFTASSRAEPPPFLNLLAAPALHLRSLPYSLSARRRRXWALGTQAAALGSRHAGGDPGLSATASAASPPASRQSPRALAPGPLHTGRWPCVLALLSPLPPPVDRQRRPAPAAARRAISRAAGASSRCSTKAEAKRYPSS

SEQ ID NO: 8360 - DNA, 461 bp, Zea mays
  misc_feature: Ceres CLONE 368625-F
  misc_feature: Encodes the peptide sequence at SEQ ID NO. 8361
gcaaacccacgtttcaaaaaaaagagaggaaagcaaagttccttcttccctcggaaaaaaaatcagtctcgcaatggagagcagcgtaggcatagagaaggccgcagcggtggcggttggtgcaggtgtgggcggtggaggagggtacggctgcggcgggtgggagacgccgaagcgcgaggagtgccgcatcccggcgacgctgccgtgccccgcggcgctgaggaaggccgtgccggacttcgggaagcggcgcagcccgcccaagaacggctacttccagccgccggacctggaggcgctcttcgcgctcgcgccgcgccgccaggccttctgcgcgtgacttggcgcggactcgatttttggggagggagttgtagatagcttgccggtctcgctctgttgtactctttctagtgggggtgtctagtggccgcgggtgyaytagggaggcagtaggg

SEQ ID NO: 8361 - protein, 89 aa, Zea mays
  misc_feature: Ceres CLONE 368625-F
MESSVGIEKAAAVAVGAGVGGGGGYGCGGWETPKREECRIPATLPCPAALRKAVPDFGKRRSPPKNGYFQPPDLEALFALAPRRQAFCA

SEQ ID NO: 8362 - DNA, 180 bp, Zea mays
  misc_feature: Ceres CLONE 368635-F
  misc_feature (28)..(28): n is a, c, t, g, unknown, or other
aggagaactgggacgacagcagcggcgngcgacggggaacggggaaccctgtactgtatttcgtcgacctttgccatggcgtcgatgatgagttctcgcgcgggcgsgtcggcggccggtaggaggagaacaccgccgtcakcacgtcaccgtggcgtgcggtgggctgacgcggccgag

SEQ ID NO: 8363 - DNA, 420 bp, Zea mays
  misc_feature: Ceres CLONE 368651-F
  misc_feature: Encodes the peptide sequence at SEQ ID NO. 8364
aattggctctcttggacagttgtgtatacaacttgtggatctttatgcatatttaatctaaactcttgtagttttgcttagactcatttaatcactaaggtttatctcactttttttcttcctcaaggctttgaggacaggttccagagagaagcaaatctgtctgcttcagcaatctttccatcacttgtgaagcccccctgaatacatgtccgagaacctagcaaggtactcggcctggttgggtggtgcgatattggccaaggtcgttttccctgaaaaccagcatatcaccaagggcgagtatgatgagacggggcgtctattgtgcaccagaagtgcttttagagacaaactgccttgaactagcacggttgtgcaccatttgcttgctgttcatgtcacagctgtgctcgtacc

SEQ ID NO: 8364 - protein, 51 aa, Zea mays
  misc_feature: Ceres CLONE 368651-F
MSENLARYSAWLGGAILAKVVFPENQHITKGEYDETGRLLCTRSAFRDKLP

SEQ ID NO: 8365 - DNA, 485 bp, Zea mays
  misc_feature: Ceres CLONE 368672-F
  misc_feature: Encodes the peptide sequence at SEQ ID NO. 8366
aataaaccctgcacctccatcgcaccctctccgccgccaagaccatcctcgcatccgggttgccagctctccttgagcccagaagcacaccgcgcgccatgcgaccaccgagagggcgaggcggtggtggccggttcggcggaggaggaggccggggccgcggcgggggccgattcagcggtggtggccgaggtggcggcgggggccgcttcggcggcgggttccgcgacgagggcccgcccgcggaggtcgtcgaggtttcgacgttcctgcacgcgtgcgagggggaggcggtgacgaagctcaccaacgagaaggtgccctacttcaacgcgcccatctatctgcagaacaagacccagatcggcaaggttgaagagatcttcggccccatcaacgaatcctatttctctgtgaagatgatggaggggatcattgcaacatcgtacaatgaaggctacaagttctatatcgacccaatgaaa

SEQ ID NO: 8366 - protein, 129 aa, Zea mays
  misc_feature: Ceres CLONE 368672-F
  misc_feature (44)..(129): Pfam Name: Gar1 Pfam Description: Gar1 protein RNA binding region
MRPPRGRGGGGRFGGGGGRGRGGGRFSGGGRGGGGGRFGGGFRDEGPPAEVVEVSTFLHACEGEAVTKLTNEKVPYFNAPIYLQNKTQIGKVEEIFGPINESYFSVKMMEGIIATSYNEGYKFYIDPMK

SEQ ID NO: 8367 - DNA, 709 bp, Zea mays
  misc_feature: Ceres CLONE 368691-R
  misc_feature (5)..(5): n is a, c, t, g, unknown, or other
  misc_feature (28)..(28): n is a, c, t, g, unknown, or other
  misc_feature (36)..(36): n is a, c, t, g, unknown, or other
  misc_feature (39)..(39): n is a, c, t, g, unknown, or other
  misc_feature (40)..(40): n is a, c, t, g, unknown, or other
  misc_feature (533)..(533): n is a, c, t, g, unknown, or other
  misc_feature (542)..(542): n is a, c, t, g, unknown, or other
  misc_feature (617)..(617): n is a, c, t, g, unknown, or other
ggttntggtttttttcgcccgccccccngggagggnaanngagaataaggatcgcgcctttcacgattgggtacgggccccccctcgaggtcgacggtatcgataagcttttttttttttttttttgaaggcaatgagttaattcaaagaatagtcacaacacagtgcacagtacaaccaccggcagaacgtctcactgaaagaactctacacggccgccaacatccatccacagcagcttggcctcggaggccagcttcctgctcctgtacagcaccaggttcgtgagccggtgcttgggccgaggctcgaaggacctcgcctcgtcgtgcttccccaggagcgccagctcccgcgcgggcaccacgtcgccccaccagaagtcgcgcagcgcctcgtgcacgagctcccagtacgcgcggtcccgcggcacggggaacaggctgctcccgctgggcgtccagcagtagagcttctcccaccccccgcccatgatctccattaggccctgcacctgcggcatgtactactanggcatggcncgccagggcagcgcgagctcgggcttgcccttgttgaaggggcacttgacttccaggattccgccgtccagcccncaccccaggactccctcggggtaaggttccccggccatccggaagctggcccccggcggggcgaccgcccaagacccaaaggggcccacccg

SEQ ID NO: 8368 - DNA, 466 bp, Zea mays
  misc_feature: Ceres CLONE 368727-F
  misc_feature: Encodes the peptide sequence at SEQ ID NO. 8369
  misc_feature (69)..(69): n is a, c, t, g, unknown, or other
attcagcttcttgatctcacacgaaggcatggcgacggagatccagggctactacgatgacggcaccgnsstggtgtcgttcgacgtgcacaacatcgavaccacgctgacgaacttgggcagcgtggtggagtggtggctgggtgagacctatcgcctccaccaccgcggccacatcgccggcctcgacgtggagtggcgccccgctcgcgtgccgggccccgtccccgtcgccgtgctgcagatctgcgtcgaccaccgctgcctcgtattccagatcctccaagccgactacatccccgacgccctgtccaggttcctcgccgaccgccggttcaccttcgtgggggtcgggatcagcggcgacgtcgcaaagctgcgggccggggtacaggctggggggtggcgagcgccgtgggacctgcgcgttctcgctgccgacacgctgggaggtgcccgagctgct

SEQ ID NO: 8369 - protein, 146 aa, Zea mays
  misc_feature: Ceres CLONE 368727-F
  misc_feature (14)..(14): Xaa is any aa, unknown, or other
  misc_feature (15)..(15): Xaa is any aa, unknown, or other
  misc_feature (24)..(24): Xaa is any aa, unknown, or other
MATEIQGYYDDGTXXVSFDVHNIXTTLTNLGSVVEWWLGETYRLHHRGHIAGLDVEWRPARVPGPVPVAVLQICVDHRCLVFQILQADYIPDALSRFLADRRFTFVGVGISGDVAKLRAGVQAGGWRAPWDLRVLAADTLGGARAA

SEQ ID NO: 8370 - DNA, 420 bp, Zea mays
  misc_feature: Ceres CLONE 368733-F
  misc_feature: Encodes the peptide sequence at SEQ ID NO. 8371
  misc_feature (197)..(197): n is a, c, t, g, unknown, or other
  misc_feature (338)..(338): n is a, c, t, g, unknown, or other
  misc_feature (351)..(351): n is a, c, t, g, unknown, or other
gtgcaaagcgcgcgaccggacggcccggttcgttctcgacctctcgtctcgctcatccgcccgcccccgaggaaggaaccctagcctagccttgctccgaccggtcgccgcggcgmtgcgacgatgatggactgcgctggaggccgagaccccgtggaggacttcctcctcggcggcgcggcgcssgcgacgagssnagatctcgtcgccgtcttctgcgacgacggaggacttgggattgagggtatccatggagatgcttgtggatttgagcaatctaatttggggaaaaggggtagagatgaaccatgttcatctggcccaacatccaaagcttnccgtgaaaaaatnaggagggacaagctgaatgacaggttcctgggaattaagttcaattatgaatcctgggtaagtaagcaa

SEQ ID NO: 8371 - protein, 99 aa, Zea mays
  misc_feature: Ceres CLONE 368733-F
  misc_feature (21)..(21): Xaa is any aa, unknown, or other
  misc_feature (24)..(24): Xaa is any aa, unknown, or other
  misc_feature (25)..(25): Xaa is any aa, unknown, or other
  misc_feature (72)..(72): Xaa is any aa, unknown, or other
  misc_feature (76)..(76): Xaa is any aa, unknown, or other
MMDCAGGRDPVEDFLLGGAAXATXXDLVAVFCDDGGLGIEGIHGDACGFEQSNLGKRGRDEPCSSGPTSKAXREKXRRDKLNDRFLGIKFNYESWVSKQ

SEQ ID NO: 8372 - DNA, 478 bp, Zea mays
  misc_feature: Ceres CLONE 368754-F
  misc_feature: Translation starting site: 154
  misc_feature: SWISSPROT Homolog: EC 1.6.5.2 NAD(P)H dehydrogenase (quinone)
  misc_feature: SWISSPROT Homolog: EC 1.5.1.29 FMN reductase
aaacgtactcgcaacgattggttgtgttgtgtggctacaaatacgaatacagcagccctctgctctctgcacctgcgcattttgtaaaggtacgaggagctaggtgaggcaccaccaccaaccgggctccgactccgagttcatcacgcacgcatggaaggctcggcggcacaggcgccggggaagaccgtcctgagggtggtggcgatctccggctcgctgcgcagggcgtcggccaacaccggcctcatccgcgccgccgcggagatctgcagggagtcgatcccggggctggaggtggagcacgtggacatctcggagctgccctgctgaacaccgacatggagggcccgggccccggcgcgttcccggcggccgtcgaggcgttccgcggcaaggtgcgcgccgccgactgcttcctgttcgcgtcgcccgagtacaactactccatctcgggcccgctgaagaacgcgctgga

SEQ ID NO: 8373 - DNA, 445 bp, Zea mays
  misc_feature: Ceres CLONE 368772-R
cgattgggaccgggcccccctcgaggtcgacggtatcgataagcttttttttttttttttttcatcggtaagagctcctgcatagttctaagggtttttccactgaaaatgtagacttatgccttgaaatgtgaatatgaaacattatcaaacttatatctggtttccaatatgctaaaggtaataatgcctctaattgatattgagggttggactttcatctgctgcaaccacatattgggaaggcccctgatgctgtcctccaaaaaatcctggttgaaacaaggattccccggttccccgagaatggcaccccggttttcccccctcccgggaaatttttggcccccttttccaaaaaattttttcttttttggacaaaacccctctcctcttttgaacccccggggtttttaaaacaccctttttttcccgaaaaaaaaat

SEQ ID NO: 8374 - DNA, 357 bp, Zea mays
  misc_feature: Ceres CLONE 368776-F
  misc_feature: Encodes the peptide sequence at SEQ ID NO. 8375
aagttaccaaattgccacttccgtacccagacccggacgtgtggaaacagaaacagcaatggcggagaggctggtgccgagcacgaagaaggcgatggagcaccgggaggagaagcccaaggtgccgtctagcgacccgggccccgaccccgacctggtgcagctggtggccgggcagcagccgcagctgcagcgggagcagcagccgcccaacatctcggagatgaagccgctgacgcgggaggcgtacggcggcgggatgtacgcggccgaggaggagggcggccgtcggaggggccccgcgcggccgcgcgcgagcgccacgcagagcgccgacgggcccgaggagcagcgcgc

SEQ ID NO: 8375 - protein, 99 aa, Zea mays
  misc_feature: Ceres CLONE 368776-F
MAERLVPSTKKAMEHREEKPKVPSSDPGPDPDLVQLVAGQQPQLQREQQPPNISEMKPLTREAYGGGMYAAEEEGGRRRGPARPRASATQSADGPEEQR

SEQ ID NO: 8376 - DNA, 492 bp, Zea mays
  misc_feature: Ceres CLONE 368787-F
  misc_feature: Encodes the peptide sequence at SEQ ID NO. 8377
atcccatatcgccaagtccccttcgtcgtccccttccctcgcctcgcgttaggtagcctgcttccgacccgcacatctccctccggttctcgccatgggcgccggcgccaacaaccacgaggagtcgagccccctcatcccagctgcggttgccgcccccgcggacgagaagcccccgcaggctccggcgccggaggcygccaattactatgccgacggggtcccggtcgtgatgggcgagcccgtgtcggcccacgccttcggcggcgtcccgcgggagagctggaactccgggatcctctcctgcctcggccgcaacgacgagttctgcagcagcgacgtcgaagtgtgtcttcttggaacggtagcaccatgtgtgctctatggtagcaatgttgagaggcttgctgctggacaaggcacatttgcaaacagctgtttgccttacactgggctgtatttgcttgggaactctctctttgggtggaactg

SEQ ID NO: 8377 - protein, 132 aa, Zea mays
  misc_feature: Ceres CLONE 368787-F
MGAGANNHEESSPLIPAAVAAPADEKPPQAPAPEAANYYADGVPVVMGEPVSAHAFGGVPRESWNSGILSCLGRNDEFCSSDVEVCLLGTVAPCVLYGSNVERLAAGQGTFANSCLPYTGLYLLGNSLFGWN

SEQ ID NO: 8378 - DNA, 460 bp, Zea mays
  misc_feature: Ceres CLONE 368817-F
  misc_feature: Encodes the peptide sequence at SEQ ID NO. 8379
aaacaacatcgtgcgctgctgcacgcgaagcacagctcgccttgcctctgttcagctcacggcggaagacgagggcgacagcacacgagagggaggcaggagcggaagcgcgcaaggaggtcagtgaagcacgcgcccacggcccacatccagagcagcacagcaccgcgcgatggcgtgcatcaacatgtacaaccctgacggcgcgcccgggttcggcggcgggccgcagccgccggccgcgctgggcccgcgcgtctccttctccagcgacttcgccgtggagccgccgccggtgcagaaccgagcgatgagcctgcggtgccaggaggaggacgtcaacttcgagttctccgtgggcagccaccccatgatggcggccgaccagctcttctccaagggcaggatccttcccctcagggacaacggcggctgcttcgccgccgcgcggccgccacca

SEQ ID NO: 8379 - protein, 96 aa, Zea mays
  misc_feature: Ceres CLONE 368817-F
MACINMYNPDGAPGFGGGPQPPAALGPRVSFSSDFAVEPPPVQNRAMSLRCQEEDVNFEFSVGSHPMMAADQLFSKGRILPLRDNGGCFAAARPPP

SEQ ID NO: 8380 - DNA, 345 bp, Zea mays
  misc_feature: Ceres CLONE 368843-F
  misc_feature: Encodes the peptide sequence at SEQ ID NO. 8381
  misc_feature (244)..(244): n is a, c, t, g, unknown, or other
  misc_feature (303)..(303): n is a, c, t, g, unknown, or other
agttccttcgctcctctgtaacccggggcggccgacgagssgggaccaccgacggcgacgatgggcggcggcgagggcaagtccaagawacgccgctcttctacctcctcagcggaggaagaagggggggaacggaagakgcgggacaagaaggagagcaagaggaggagccgagacgacagggaggttgacgattacagacacaagaagaaggggaaacacttckacaggaacawaggaaaanagagattttcgaaggataggcattccaaggagaagacgagcaagagaaaagacaaggangctgccttcaaagaratatccaaggwtgaytactttgcaaag

SEQ ID NO: 8381 - protein, 95 aa, Zea mays
  misc_feature: Ceres CLONE 368843-F
  misc_feature (10)..(10): Xaa is any aa, unknown, or other
  misc_feature (27)..(27): Xaa is any aa, unknown, or other
  misc_feature (56)..(56): Xaa is any aa, unknown, or other
  misc_feature (59)..(59): Xaa is any aa, unknown, or other
  misc_feature (62)..(62): Xaa is any aa, unknown, or other
  misc_feature (81)..(81): Xaa is any aa, unknown, or other
  misc_feature (90)..(90): Xaa is any aa, unknown, or other
MGGGEGKSKXRRSSTSSAEEEGGERKXRDKKESKRRSRDDREVDDYRHKKKGKHFXRNXGKXRFSKDRHSKEKTSKRKDKXAAFKEISKXDYFAK

SEQ ID NO: 8382 - DNA, 486 bp, Zea mays
  misc_feature: Ceres CLONE 368852-F
  misc_feature: Encodes the peptide sequence at SEQ ID NO. 8383
aaagatacgagcacaccaaatggcgctagaccacggcgccgagcatatcttcctctttccctaccgaccgagagggagatgagcggtggcgtgcggagggtcctggaggcgtggaggctcggcgtggtgaagtacggcgaagcgctccagttgcaggagcgtctcgtcgcggaccgcaaggccggccgcgtcggcgacctcgttctgtcgctgcagcacccgccgacctacaccctgggcaagcggcgcgagaaggcggagcggaacctgctcgcgccggaggccgacctgcgcgccctgggcgccgagatccaccgcacggagcgcggcggcgacgtcacgttccacggcccccggcaagccgtgctgtacccgctcctctcgctccgcaccttggggcttggcgcgcggaggtacgtcgaggggctcgagtccgcgatgatccaggtcgcggcgctgcacggcgtctccgcgaggcccggggac

SEQ ID NO: 8383 - protein, 136 aa, Zea mays
  misc_feature: Ceres CLONE 368852-F
  misc_feature: SWISSPROT Homolog: EC 2.3.1.181 Lipoyl(octanoyl) transferase
MSGGVRRVLEAWRLGVVKYGEALQLQERLVADRKAGRVGDLVLSLQHPPTYTLGKRREKAERNLLAPEADLRALGAEIHRTERGGDVTFHGPRQAVLYPLLSLRTLGLGARRYVEGLESAMIQVAALHGVSARPGD

SEQ ID NO: 8384 - DNA, 432 bp, Zea mays
  misc_feature: Ceres CLONE 368872-F
  misc_feature: Encodes the peptide sequence at SEQ ID NO. 8385
acacgcctgctgaaaggccccgcttctatttttgacgcttataccctcgctctgctcatcgaaccaaaccctacaccgcggcgacaggtataaaagacatctcccgacccgtgccctactcgccgccgccgccaccgccaccgccaccgccacctacgcaacaccaggcgctccagcagaacagcactcggagctcgcctgcccgacggcccaccatgatcatccccaagaagaaccgcaatgagatctgcaagtacctcttcaaggagggcgtgctgtatgccaagaaggactacaacctggcgaagcacccacagattgatgtgcccaacctccaggtgatcaagctcatgcagagcttcaagtccaaggagtatgtcagagagaccttctcctggcagtactactactggtacctcaccaacgatggca

SEQ ID NO: 8385 - protein, 72 aa, Zea mays
  misc_feature: Ceres CLONE 368872-F
  misc_feature (3)..(72): Pfam Name: S10_plectin Pfam Description: Plectin/S10 domain
MIIPKKNRNEICKYLFKEGVLYAKKDYNLAKHPQIDVPNLQVIKLMQSFKSKEYVRETFSWQYYYWYLTNDG

SEQ ID NO: 8386 - DNA, 495 bp, Zea mays
  misc_feature: Ceres CLONE 368948-F
  misc_feature: Encodes the peptide sequence at SEQ ID NO. 8387
taacaaaaatatgtcttctgttttgcctgttgcccaattctcttttagtgtagcctacttacaataattaadagaagagttggtgtctgtttgagtagacagctaagtgcatatataagtacgtgcatgattttgattactaattgttattttgatgatctttcttttgaagacggtctaacatataagcgcatgatttagatgaacggaattactattgtgccatttctgaagaatcttactattttctcttgccttcttagaacaacatgggaagaagtgatgatgacagtccatcgccgccaagaggtcacatgagaagaactcgcagcccaagtccttgtggtagttatggaggccatggcaagcgccccacaactaatcttatggtgacgaatcttggtccagattgtaggattccgactctcatcaagtgactcctcccctcacgatgactttgcggacagatgtctcaattatagtggtggagctacg

SEQ ID NO: 8387 - protein, 55 aa, Zea mays
  misc_feature: Ceres CLONE 368948-F
MGRSDDDSPSPPRGHMRRTRSPSPCGSYGGHGKRPTTNLMVTNLGPDCRIPTLIK

SEQ ID NO: 8388 - DNA, 392 bp, Zea mays
  misc_feature: Ceres CLONE 369000-F
  misc_feature: Translation starting site: 192
  misc_feature (44)..(44): n is a, c, t, g, unknown, or other
  misc_feature (145)..(145): n is a, c, t, g, unknown, or other
aacagagcaacgcccaggcacacacgacacgaaccaggcagccnccgcggagggaggaaccctagcggaacaggtgacggcggcgcgcaaccggtgacggggatacggcggcatcgtcccctcctccatccccggcgcggcggcnmagcagcggcctgcaggctgtttgaagagcccgccatttaatctcaatggaagccaagtttttccgtttcctgaagctcgttggggtcggcttcaaagcgaggtcagagagccaaggccgtgarttgttccttaaactgggcttcarccatgaggtgcagttcaccgctcctccagctgtttcgtgtcttctgcttcaaacccaacataatctgctgcaccggcatcgataaggacagggtgcacca

SEQ ID NO: 8389 - DNA, 443 bp, Zea mays
  misc_feature: Ceres CLONE 369011-F
  misc_feature: Encodes the peptide sequence at SEQ ID NO. 8390
aacagatcctgcggtggcgtctgtctatggagggcttgggggtcctcgtccccgattccggtggacggaggcgtatcgtctagctcggagtaggagatcatctattcgactggaggagaatcaagtggcaagacatttgttttcaaggcgatgcgataatttttatcgtcgtcttgttggctgccatgctaggcccgagttcatgcttccagttcgccggaagttctcgacgatctccggcatgcatccatggaggtgggcttctcgacagatgaaagggaggtataccaggattcagcgtcgaaactgcagttgtgcaggtcatcttcagaggtacccactggttcaggttctggagactcctacaaaaggaggatgtacatcaacaaattctcgatgtgtgtcaagctctagaagtggtggcgatggaaatctttgcgttt

SEQ ID NO: 8390 - protein, 54 aa, Zea mays
  misc_feature: Ceres CLONE 369011-F
MEVGFSTDEREVYQDSASKLQLCRSSSEVPTGSGSGDSYKRRMYINKFSMCVKL

SEQ ID NO: 8391 - DNA, 467 bp, Zea mays
  misc_feature: Ceres CLONE 369013-F
  misc_feature (50)..(50): n is a, c, t, g, unknown, or other
gtggcacatccggggccatgttcgtttaggctgttcccggccgggaacanaccaaacctcgtggatcccttcccatggaaataaacccggcccacagaaaaacaagcgttcggttaagtccgatgtgggctgtatccagatcgttcctcgtcgttccagcccgggaaacacgcccggtcgaccgggggtggaaaatatcccagcctggactgcacgcgaacgsaagggcacgcgacttctcgtcggtgtcgatctgctccggcgaccgcttgtcatcgattatccctacatcggtttgacttggagaagacgagcttccaccatcttgggaccctataccctctcctttagagagctgcacctgaagaaaccaatgaacattaggtattacaaataagggctgtattgtattaatgtggttcttgtaaactaatttttcctttgaattttgtaattgaatcatccac

SEQ ID NO: 8392 - DNA, 490 bp, Zea mays
  misc_feature: Ceres CLONE 369022-F
  misc_feature: Encodes the peptide sequence at SEQ ID NO. 8393
agaaacccaccaccgcaacacctgcgctccggcctgctctctctttcaaacagcttcgtgtgtcgttgcgccgcgcatagttccagcgccagctcggcactgaagaatctggtgaccggccgggatcgagagccaagctcgagcaggaacggagagcgcgcggatatatatagctatgatgatgatgatgatggacaggcagctcgtcaggcaatgcgacatggaggtcatgaggatggccatgctcaagcacgaagagaccttccggcagcaggttcacgagctgcaccgcctgtaccgcatacagagggagctgatgagcgacctaataacgacccgatacgacgacgagccgctgctgctgacgaccgccggccggcgcagcaagcagccgcgccgggcgctggacctgcagctgccagccgacgagtacatcgtcagcgccgacgaggagtcggacgccgccggcgcggagctggagctgacgctg

SEQ ID NO: 8393 - protein, 105 aa, Zea mays
  misc_feature: Ceres CLONE 369022-F
MMMMMMDRQLVRQCDMEVMRMAMLKHEETFRQQVHELHRLYRIQRELMSDLITTRYDDEPLLLTTAGRRSKQPRRALDLQLPADEYIVSADEESDAAGAELELTL

SEQ ID NO: 8394 - DNA, 488 bp, Zea mays
  misc_feature: Ceres CLONE 369025-F
  misc_feature: Encodes the peptide sequence at SEQ ID NO. 8395
  misc_feature (377)..(377): n is a, c, t, g, unknown, or other
acacaagacctcctattccccatgccgaccgaagagggttccgacggcggtggcggcgcggagccggagccggggagaagaagagctcgcaggcgcccgcaaagcttggagcgtgcggcgccgcaaagttcctcgcggggttgccgtcgcgcggcaamtatctcttccggctccgcccctccaacctgggagggttcagggtttacgtctgcgagcacagcacagatcccccagaaggacaagttataaagacggattcaacgaatattttaatcaggcatctccagttgaacaagcagaagactgagggcaaagatgtggattccagaactgtcggggaaaacaacagagggaaaagatctgctgccagaagtttngatgtcaacaattcagcaaagaaggctaacttgggtacttcatctggatcatcagcctatgaggaaatttctggcttttcacaacacacactgcagtcatttacagtggag

SEQ ID NO: 8395 - protein, 162 aa, Zea mays
  misc_feature: Ceres CLONE 369025-F
  misc_feature (52)..(52): Xaa is any aa, unknown, or other
  misc_feature (125)..(125): Xaa is any aa, unknown, or other
TRPPIPHADRRGFRRRWRRGAGAGEKKSSQAPAKLGACGAAKFLAGLPSRGXYLFRLRPSNLGGFRVYVCEHSTDPPEGQVIKTDSTNILIRHLQLNKQKTEGKDVDSRTVGENNRGKRSAARSXDVNNSAKKANLGTSSGSSAYEEISGFSQHTLQSFTVE

SEQ ID NO: 8396 - DNA, 465 bp, Zea mays
  misc_feature: Ceres CLONE 369027-F
  misc_feature: Encodes the peptide sequence at SEQ ID NO. 8397
  misc_feature (430)..(430): n is a, c, t, g, unknown, or other
atcccatatcgccaagtccccttcgtcgtccccttccctcgcctcgcgttaggtagcctgcttccgacccgcacatctccctccggttctcgccatgggcgccggcgccaacaaccacgaggagtcgagccccctcatcccagctgcggttgccgcccccgcggacgagaagcccccgcaggctccggcgccggaggccgccaattactatgccgacggggtcccggtcgtgatgggcgagcccgtgtcggcccacgccttcggcggcgtcccgcgggagagctggaactccgggatcctctcctgcctcggccgcaacgacgagttctgcagcagcgacgtcgaagtgtgtcttcttggaacggtagcaccatgtgtgctctatggtagcaatgttgagaggcttgctgctggacaaggcacatttgcnaacagctgtttgccttacactgggcctgtatttgc

SEQ ID NO: 8397 - protein, 123 aa, Zea mays
  misc_feature: Ceres CLONE 369027-F
MGAGANNHEESSPLIPAAVAAPADEKPPQAPAPEAANYYADGVPVVMGEPVSAHAFGGVPRESWNSGILSCLGRNDEFCSSDVEVCLLGTVAPCVLYGSNVERLAAGQGTFANSCLPYTGPVF

SEQ ID NO: 8398 - DNA, 236 bp, Zea mays
  misc_feature: Ceres CLONE 369045-F
  misc_feature: SWISSPROT Homolog: EC 2.5.1.18 Glutathione transferase
  misc_feature (148)..(148): n is a, c, t, g, unknown, or other
agggatagcataacaccgccgaggaagcagcaagcagcaaggtcgacatgtcgtctccgccgccggtgaagctgatcggcttcttcggcagcccgtacgcgttccgccggaggcggcgctgtgcctgatassgtgccgtacgakctgntcctggaggacctgttcggcagcaagagcgagctcctgctccaccacaaccccgtgcacaagatggtgcccgtgctcctccacggcga

SEQ ID NO: 8399 - DNA, 513 bp, Zea mays
  misc_feature: Ceres CLONE 369046-F
  misc_feature: Pfam Name: PRA-CH Pfam Description: Phosphoribosyl-AMP cyclohydrolase
  misc_feature: SWISSPROT Homolog: EC 3.5.4.19 Phosphoribosyl-AMP cyclohydrolase
  misc_feature (391)..(391): n is a, c, t, g, unknown, or other
atgactcatgagtgaccaggtcacgtcacgaggagcggaacacacacacactcgggtttycgatggcggcggccgcaccaacacacgcgcccgtktcctcctcwgykgtgycgttttggattctcctctagcgatgtatccttccccaattttygctcggcggcggcttcggcccctgggtggcggcgcagggagccgtacccggcagtctccgtagtgtcgagctccccgcagtctgtgccaggagctataactgtcgacaccgaggttgacacattgctagacagtgtgaagtgggacagcaaagggttggctgttgccattgcacaawatgtggatactggagccattcttatgcagggttttgctaataaagawgcccttgcaaaanctatatcaaccaggaaakctacattctttagccgttcacgtcttccttgtggacgaaaggggagacatccatgaacttcattaatgtgcatgassattttcctagactgtgacatgactcta

SEQ ID NO: 8400 - DNA, 395 bp, Zea mays
  misc_feature: Ceres CLONE 369082-F
  misc_feature: Translation starting site: 36
  misc_feature (52)..(52): n is a, c, t, g, unknown, or other
  misc_feature (58)..(58): n is a, c, t, g, unknown, or other
attttacacactccgctctactcccggaagagacgatggcggaggcgacgcncgaatnggtgttcgtctacggcaccctaaagcgcgggttccctaaccactcgctcctcgtggcctccgccaccccttcgtgggagccgcatccacggccgggccagcctccctcatcatcggcccctactcggtacccttcctcctccccactcccgcctccgcctcctccggtcgtgtcgtctcgggcgagctctacgccccatcccccgccgcgctcgccgagctcgacgccctcgagggcacccacatcggcgtctacgagcggcgcccgatcaccgtcgtggtcgacgggtcgggcgaggtggtgcaggcggaggcgtacttcgcgcacccgagctacg

SEQ ID NO: 8401 - DNA, 426 bp, Zea mays
  misc_feature: Ceres CLONE 369095-F
  misc_feature: Translation starting site: 303
aggtctcgtcgttctatttcttattctttcccccccacacaaggatgcacgcgatagagacgtgcttaggagagtggcacgactagagcgagcacggcagctagcaggtacggctggacccggacgcggccgccggcgcccgcgcgccgcccggcctccacggcccgcaccgcctcctgccgcagctccggcggcagctgcaggcagacccagtccatgagcgcgtccacgtccttggcgaagtccagcagcgagcagtctgctttcgttgagctgatggcggaagatagcggaggctgggcatgctccccaaggacaaggagatcaaatcatgggaggcttcggcaggcatgcaagctgatacactgttatccatttggcgtcacagaagctatcaagttgggccatccttcagcgagaggagct

SEQ ID NO: 8402 - DNA, 407 bp, Zea mays
  misc_feature: Ceres CLONE 369190-F
  misc_feature: Encodes the peptide sequence at SEQ ID NO. 8403
aagaggcgaatcagtagcttcgctccggcctccgggggctccgcggctccgctagtccgctccggcgccacggcccggctcggaggggcgtttcggggagggcgamggacgccagcktttccgtttggttggcgtaggcgaacgtgctgctggagcgctacccgggtttcctccgttcactagcgctcgckatctgatgatcgttggctagttgctctgccagagtcccagccagcgctcctccgccatgatccaggcggtaatggtgakcagcacccaggccaagccccgccttctcaagttctacagtttccagccacccgagaagcatcaggacctcgtcgctgtgtcttccaattactctctgcaaggcccgagagcgcgassaattttgtcaaggtggactc

SEQ ID NO: 8403 - protein, 53 aa, Zea mays
  misc_feature: Ceres CLONE 369190-F
  misc_feature (8)..(8): Xaa is any aa, unknown, or other
  misc_feature (47)..(47): Xaa is any aa, unknown, or other
MIQAVMVXSTQAKPRLLKFYSFQPPEKHQDLVAVSSNYSLQGPRARXILSRWT

SEQ ID NO: 8404 - DNA, 491 bp, Zea mays
  misc_feature: Ceres CLONE 369191-F
  misc_feature: Encodes the peptide sequence at SEQ ID NO. 8405
aatctccgcatttccatcttcccgtgggatcccagccgccgccgcaagaagaagagctcggggacttccaggtgtcgcgagaagatgccgaagcagatccacgagatcaaggatttccttctcaccgcgagaggaaggatgcccgatcagtgaagatcaagaggagcaaggatgttgtcaagttcaaggtccgctgttccaagtacttgtacaccctttgcgtattcgacgctgagaaggcaaacaagttgaagcaatctctccccccaggcttgagcgtccaggaggtttgattggatacatggcaacgtcgggtcgaacctctagggcatctttatcattagcagagcatgctgtttatgtagttttggaccttaagctattagacatgtcagtgttggatttgtggatcttgaatttttggagaaataccaatttgcctcgttcaaggacgcacctttcagttttttcttatttaactgcattgttcc

SEQ ID NO: 8405 - protein, 96 aa, Zea mays
  misc_feature: Ceres CLONE 369191-F
  misc_feature (33)..(96): Pfam Name: Ribosomal_L38e Pfam Description: Ribosomal L38e protein family
SPHFHLPVGSQPPPQEEELGDFQVSREDAEADPRDQGFPSHRERKDARSVKIKRSKDVVKFKVRCSKYLYTLCVFDAEKANKLKQSLPPGLSVQEV

SEQ ID NO: 8406 - DNA, 271 bp, Zea mays
  misc_feature: Ceres CLONE 369208-F
ctgtgccaaaccctagccggctatggagcatcccgccgccacctcctcacctgatccgacgccgtagcacctctccctgtccctgtccccatctccctccgtctccctggccaagcactccacctggaagcaccctgccccgaactgcaccgcagtcgtcgacgctaagcgctggcccacgctctccaaggttgcaagggtatgaagctcctagactcctcggatcccttacttgcgcccatcgctgcccaatcgtgccagatggtacaaa

SEQ ID NO: 8407 - DNA, 246 bp, Zea mays
  misc_feature: Ceres CLONE 369232-F
  misc_feature: Encodes the peptide sequence at SEQ ID NO. 8408
  misc_feature (52)..(52): n is a, c, t, g, unknown, or other
gtctcagccgtcgccaactaatctatccccgatcacgcggcgaaccgcsacncaccactatcaccaatcgcaatggagaaccctccaccgtcctccgccggtccgtactcggcgcccgcgcggcagcgcacatcaggacgcggcgaaggaggatcaggacgtggcgcmsstcgtgctcaacctgtgcatcccggagctccgcrgaagggccatcatcatcctttccaagaagcgagaaaawtgtga

SEQ ID NO: 8408 - protein, 81 aa, Zea mays
  misc_feature: Ceres CLONE 369232-F
  misc_feature (56)..(56): Xaa is any aa, unknown, or other
  misc_feature (57)..(57): Xaa is any aa, unknown, or other
  misc_feature (68)..(68): Xaa is any aa, unknown, or other
  misc_feature (80)..(80): Xaa is any aa, unknown, or other
SQPSPTNLSPITRRTATHHYHQSQWRTLHRPPPVRTRRPRGSAHQDAAKEDQDVAXXVLNLCIPELRXRAIIILSKKREXC

SEQ ID NO: 8409 - DNA, 461 bp, Zea mays
  misc_feature: Ceres CLONE 369243-F
  misc_feature: Encodes the peptide sequence at SEQ ID NO. 8410
acccacccacccacccactcctttccccaacccatggccgccgccgccgccggcacccgggaggagatggtctacatggccaagctagcggagcaggcggagcggtacgaggagatggtggagttcatggagaaggtcgcggccgccgccgagctcaccgtcgaggagcgcaacctgctctccgtcgcctacaagaacgtcatcggcgcgcgccgcgcctcctggcgcatcgtctcctccatcgagcacaaggaggagacgcggggcgcggcggggcacgccgccgccgccagggggtaccgcgcgcgcgtggaggccgagctctccgggatctgcgcggggatcctgcgcctcctcgacgagcgcctcgtgccggcggcggcggccgtggacgccagggtcttctaccctcaagatgaagggggactaccaccgctacctcgccgagttcaagaccggcg

SEQ ID NO: 8410 - protein, 142 aa, Zea mays
  misc_feature: Ceres CLONE 369243-F
  misc_feature (9)..(142): Pfam Name: 14-3-3 Pfam Description: 14-3-3 protein
MAAAAAGTREEMVYMAKLAEQAERYEEMVEFMEKVAAAAELTVEERNLLSVAYKNVIGARRASWRIVSSIEHKEETRGAAGHAAAARGYRARVEAELSGICAGILRLLDERLVPAAAAVDARVFYPQDEGGLPPLPRRVQDR

SEQ ID NO: 8411 - DNA, 495 bp, Zea mays
  misc_feature: Ceres CLONE 369250-F
  misc_feature: Encodes the peptide sequence at SEQ ID NO. 8412
actactacggcccgccaccttcgcttcgctagcggtccgcacccactcacccgttgcctccaaactcatttctcccgagcgccgccgcgagcctctgttccagcttcgttcatggcttccctcaccggatccgctctctcctttgcgaggcccgtcaaggcaatcagcattaagtctgtctctttctctggtctaaggaaggataatgtagccttccgcttgcagccagtgccacaaagattcgctgtctgctgtcctgctaaaaaggagactgtggatcgggtttgtgatattgtcaagaagcagcttgcacttcctgagggcactgaggtctgtggctcctctaagtttcaagacctcggtgctgattcgttggacactgttgagattgttatgggccttgaggaggctttcaagatcactgtagaggagtcgagcgcgcagtcaatcgcaactgtggaagatgctgctaatctcatcgacgaacttgttgcc

SEQ ID NO: 8412 - protein, 128 aa, Zea mays
  misc_feature: Ceres CLONE 369250-F
  misc_feature (56)..(123): Pfam Name: PP-binding Pfam Description: Phosphopantetheine attachment site
MASLTGSALSFARPVKAISIKSVSFSGLRKDNVAFRLQPVPQRFAVCCPAKKETVDRVCDIVKKQLALPEGTEVCGSSKFQDLGADSLDTVEIVMGLEEAFKITVEESSAQSIATVEDAANLIDELVA

SEQ ID NO: 8413 - DNA, 398 bp, Zea mays
  misc_feature: Ceres CLONE 369262-F
  misc_feature: Encodes the peptide sequence at SEQ ID NO. 8414
ggccgagagttctcaacgacgacgtctgctggcagtgctcctgctcctgttcctccttcccggccgccgcgcgagcttggtgggttagtgtctcttcttcgcggagacctgtgaggagccgtcgtcatggccgctgttgagactgttgtcctcaaggttgctatgtcatgcgagggttgcgccgggcggtcagaagagtgctctccaagatggaaggagttgaaaccttcgacatagacctcaaggagcagaaggtgacagtcaaaggcaatgtcaagcctgaggacgtcttccagacggtttccaagtcggggaagaggacctcctactgggagggcgacgacggccccggacgctgcggcgctccagawgccgaagcagctcccggcaccgcggca

SEQ ID NO: 8414 - protein, 63 aa, Zea mays
  misc_feature: Ceres CLONE 369262-F
  misc_feature (54)..(54): Xaa is any aa, unknown, or other
MEGVETFDIDLKEQKVTVKGNVKPEDVFQTVSKSGKRTSYWEGDDGPGRCGAPXAEAAPGTAA

SEQ ID NO: 8415 - DNA, 506 bp, Zea mays
  misc_feature: Ceres CLONE 369299-F
  misc_feature: Encodes the peptide sequence at SEQ ID NO. 8416
attgctggctcagcttgcgccataccgcgtcgtgcggagttcttctctccttccgctcgaagagaagagaaaaaagaacggtccgtgctcggctgccgtgaatctctctcacctccccgaagcaatcgagcggggcagcgcgccaggaaggatcggaggagacgccatcaatcagcacttgcacgcgcgcggtcggccgcagtggaggaagaagatgggcctgtgctcgtgctgctgccggtgcctggagctgatgtgctcggtcctcctcccgcccctcggcgtctgcttccgccacggctgctgctccatggagttctggatcagcgtgctgctcaccatcctcggctacctccccggcgtcctctacgccgtctacgtcatctgctccgtcgacccccaccgccaccgcgacaacgacgactacgtctacgtcgcatgacaagatggaccggtccccgtggtgctctggtccgtgtctctgctgctacctccgtccgctgtgt

SEQ ID NO: 8416 - protein, 75 aa, Zea mays
  misc_feature: Ceres CLONE 369299-F
  misc_feature (8)..(59): Pfam Name: UPF0057 Pfam Description: Uncharacterized protein family UPF0057
MGLCSCCCRCLELMCSVLLPPLGVCFRHGCCSMEFWISVLLTILGYLPGVLYAVYVICSVDPHRHRDNDDYVYVA

SEQ ID NO: 8417 - DNA, 484 bp, Zea mays
  misc_feature: Ceres CLONE 369306-F
  misc_feature: Encodes the peptide sequence at SEQ ID NO. 8418
tcgattcaccacattcagctcgccgtgttgcggtcactcaaccaaatccaatcccggcggagggaagcgtcgtctaaattccaaccctaggccatggcgaatgcggcctcatccgcatcgtcgccgggggcaggttcctcctcctcgcagcaggccggtggagacgggggaggggacgcgcacacgccgcggcagcggcagggccggcccccgcgcgccggctccgacccgctcctcatcgtctgcggctgcttcagcgtcgtcacggttgccaccgcgctcctctgcgtcgccgtcaacgtcgtctccgccgtccagtccttccgcgccggcttcgacatattcgggggcatattccggtgctacgcggtcgtcttctcgctattcgtcgccgtcctcgagaccgagtgggggttcatcatccgtttctggaagatatttgaatactggcctgcacggggaatgctccagatctttgttgtta

SEQ ID NO: 8418 - protein, 130 aa, Zea mays
  misc_feature: Ceres CLONE 369306-F
MANAASSASSPGAGSSSSQQAGGDGGGDAHTPRQRQGRPPRAGSDPLLIVCGCFSVVTVATALLCVAVNVVSAVQSFRAGFDIFGGIFRCYAVVFSLFVAVLETEWGFIIRFWKIFEYWPARGMLQIFVV

SEQ ID NO: 8419 - DNA, 382 bp, Zea mays
  misc_feature: Ceres CLONE 369357-F
  misc_feature: Encodes the peptide sequence at SEQ ID NO. 8420
  misc_feature (248)..(248): n is a, c, t, g, unknown, or other
gattagggcctgatccgtttcgtagtttttttttctcggtaatccagccgttttccctttccccagagattcgcatattctcgcgatgggagcggaggaagcagagggtactcccccgccgctgcccgccaccggsagcccgcaaccacggcaagggcgcasaattatctgcagcacaattcctctcctggaagcagcgcaaggatgcagaggtagccgcaagaaagctgaagcagctgagaagcganctgatgatatcgcttcgggagcggcgcagatgaacggccgcgagctgttccaacatgasccctgggtgttcgacaacgaacatttactgaratcgtgtcggggctactgttcctgcattagtccaagctccagc

SEQ ID NO: 8420 - protein, 99 aa, Zea mays
  misc_feature: Ceres CLONE 369357-F
  misc_feature (26)..(26): Xaa is any aa, unknown, or other
  misc_feature (55)..(55): Xaa is any aa, unknown, or other
  misc_feature (74)..(74): Xaa is any aa, unknown, or other
  misc_feature (85)..(85): Xaa is any aa, unknown, or other
MGAEEAEGTPPPLPATGSPQPRQGRXIICSTIPLLEAAQGCRGSRKKAEAAEKRXDDIASGAAQMNGRELFQHXPWVFDNEHLLXSCRGYCSCISPSSS

SEQ ID NO: 8421 - DNA, 472 bp, Zea mays
  misc_feature: Ceres CLONE 369450-F
  misc_feature: Encodes the peptide sequence at SEQ ID NO. 8422
accgtgaagaaacctttacagactgtacgtagggccgtgccgtcgcccctccttccttcgtcgatctctctctcggcgacgactgggcgaccgctgcctcctgttgccctggtctccattgggccctttgccagattttctttcgcctctccgccggcgacgaacaccaccaccaggaatgggcttgtggacgttgctggagggttttttgcttcttgcaaatgcgttggctatattgaatgaagaccgctttctcgctccaaggggatggagcatgtctgaagtatcaggaaatgggcaaacgaagtcgttgaagggccagatcgtggggctaatctatgctacacaatttctgaggatgcccttaatagcactcaatgttctgatcattgttgtgaaactggtgtctggctgaggctcattatctagttttcactgttgtgttggattgatatctgttccagcatgatgt

SEQ ID NO: 8422 - protein, 78 aa, Zea mays
  misc_feature: Ceres CLONE 369450-F
  misc_feature (3)..(78): Pfam Name: Yos1 Pfam Description: Yos1-like
MGLWTLLEGFLLLANALAILNEDRFLAPRGWSMSEVSGNGQTKSLKGQIVGLIYATQFLRMPLIALNVLIIVVKLVSG

SEQ ID NO: 8423 - DNA, 1292 bp, Zea mays
  misc_feature: Ceres CLONE 369475
  misc_feature: Encodes the peptide sequence at SEQ ID NO. 8424
atcgtctgctggcatcgttccattctcctctaaaccctagccgcctagcgcctcgatctgagcagcctgtctcgcggaggtagttctggttgatttggtcctagatggcggaggaaaaagtggggcggatcttcgtcggcgggctgtcgtggaacaccacggagcgcacgctcgagcgcaccttcggtcagtacggcaaggtcatcgaggctcaggttgtagtggaaagggagacaggccgctctaggggatttggatttgtcacattttcagaacctcgggctgtggatgctgccattcggggaatgcataacggagaactggatggccgcaatatttctgtgaacaaagctgaacctaggaactctgatggctatggatatggtggtggtggtggtggtggttactcgtccggtggtagaggtggatatcgtagtggagctgatgtagttccagcagccagtgatgattgtttcaaatgtggccgtcctggacattgggctcgtgaatgcccttattcagatggaagtggtagaactggaaggtattctcccggttcaaggtatggtggtggcactggtggacgtggtgatcgctttggaggatcagatcgttttgctcgctatgatgatgatcgatatgatggtgggcgctatgtggacagcagggatacttattatggttccgggcgcgatcgctatgcaccggcagcagaacgctattctggtgacaggtacagtggtgcagatcgatatgcgtccagcggctttgccagagaaaggagctatgagagagatggagggaggtccaatggaggttactaccgtgatgaaccgaggggcactggtggctatggcagaggtggttcacgtggcggcggcggcggtgggcctgctcgctttggtgggagttaccgagataggcctgctccatacgatcgtcccagcaggggaggagcagctcgtgcttatgatgatcgttactgaagaatgttcccctgaggcagaacagagatatctgtgtatttcagctatgcactagtatttacatttgccagcttgatccttcaattccgtgttatccagcagttgcagtttgttttattagtctatgaagacaatggttcagtccatgggttattaatatgctggtaccgtaatctttaggcagtgtgctcctggttgattcgtcatgtttgtgtaactactttggagtttgcactaaataatgaactaattccagtatgtggtctttgaattggacttctgttatgcttaaaaaaaaaaaaaaaa

SEQ ID NO: 8424 - protein, 293 aa, Zea mays
  misc_feature: Ceres CLONE 369475
  misc_feature (9)..(80): Pfam Name: RRM_1 Pfam Description: RNA recognition motif. (a.k.a. RRM, RBD, or RNP domain)
  misc_feature (121)..(138): Pfam Name: zf-CCHC Pfam Description: Zinc knuckle
  misc_feature: SWISSPROT Homolog: EC 5.2.1.8 Peptidylprolyl isomerase
MAEEKVGRIFVGGLSWNTTERTLERTFGQYGKVIEAQVVVERETGRSRGFGFVTFSEPRAVDAAIRGMHNGELDGRNISVNKAEPRNSDGYGYGGGGGGGYSSGGRGGYRSGADVVPAASDDCFKCGRPGHWARECPYSDGSGRTGRYSPGSRYGGGTGGRGDRFGGSDRFARYDDDRYDGGRYVDSRDTYYGSGRDRYAPAAERYSGDRYSGADRYASSGFARERSYERDGGRSNGGYYRDEPRGTGGYGRGGSRGGGGGGPARFGGSYRDRPAPYDRPSRGGAARAYDDRY

SEQ ID NO: 8425 - DNA, 316 bp, Zea mays
  misc_feature: Ceres CLONE 369477-F
actcgagccatcatggccctcgcctcccgcgccgccgcagccgccgtggsstgcgtcctcctggcgctcgcgcctccgccgcgggggssgctccaactcccctgcaccggcgccggcggtggactgtatctcccaggccgccagcttgatcgaytgcttcgactacktccagaaggggagcagcgcsstgccgtccgtccgctgcttgcttcggcgaggtcaagaccgcrttggccagccccgtcatcgtgggctgcytctgytccctcgccggctccaactccagtwacctgggctttcccatcgacatgaagcg

SEQ ID NO: 8426 - DNA, 326 bp, Zea mays
  misc_feature: Ceres CLONE 369488-F
  misc_feature (94)..(94): n is a, c, t, g, unknown, or other
  misc_feature (114)..(114): n is a, c, t, g, unknown, or other
  misc_feature (116)..(116): n is a, c, t, g, unknown, or other
atggatcgtatccagatcgttcctcgtctttgtcttttcagcccgggaacgcgcccggtcgactggggtagaaaatatccccgtctgaaccacngcgaacgsaagggcgttvsnanggcacgcgacggctgtggatacaacattcttctctccggcgccgatctgctacggcggccgcttctcaccgattatccctgcaccagttcgagttggagaagacgaacttccaccgtcttggggaccctatatcctctmctttagttagcaatggatgtagcactaagagatcaccttaggacagaggagagatgatgatgatgacatga

SEQ ID NO: 8427 - DNA, 122 bp, Zea mays
  misc_feature: Ceres CLONE 369498-F
gagattttggactagattcgtgcaaaacactgaaaaagaaaaggccatcgaaaacgccgccgccgcctctgatgctttccgccgtgcgatgtggtgcccttcgccggtggcggctacggcgg

SEQ ID NO: 8428 - DNA, 468 bp, Zea mays
  misc_feature: Ceres CLONE 369533-F
  misc_feature: Encodes the peptide sequence at SEQ ID NO. 8429
cttcttacagccgccgccgccgcatcccagcctccatcaccgtttccgtctcgttgccatgggtaaggtgcacggatcgttggcgcgcgccgggaaggtccgcgggcagacccccaaggtggcgaagcaggacaagaagaagaagccccgcggccgcgcgcacaagaggatgcagtacaaccgccgcttcgtcaccgccgtcgtcggcttcggcaagaagcgcgggcccaactcctccgagaagtaggcgccgctcggctcgtaccggttcctcatccttcctgctctccgtatgcttatgctcttgatggtactagtttcgttgttcgcaagcagaggaagaaccttctgtagattcggttttgttgtccatgtgctcagatgggaacttgagattgtatgaatttgagatatggtgatatgagctgatgatttttattatgcttattgttgctcctctgagctgtt

SEQ ID NO: 8429 - protein, 62 aa, Zea mays; identical to SEQ ID NO: 6893
  misc_feature: Ceres CLONE 369533-F
  misc_feature (3)..(61): Pfam Name: Ribosomal_S30 Pfam Description: Ribosomal protein S30

SEQ ID NO: 8430 - DNA, 447 bp, Zea mays
  misc_feature: Ceres CLONE 369662-F
  misc_feature: Encodes the peptide sequence at SEQ ID NO. 8431
  misc_feature (412)..(412): n is a, c, t, g, unknown, or other
ggaaaaagaaagagaagagaagccaaggaggttctcagttggagcggctccctctccccgcgcgcgccaccgcctccgatccgagcagccgcctacaattaacccattcaacctcaaatgttccttgtgaggtatcatgacagaacagcaggaacgtgttagcaagagctcttcctcaagtattagcagcagcactcaggaaagtgaggaggaactgaccatcggtacccttataaccgaagcaacaaacacaacaaacagtgccaagagtcttggaaagcgcctttcacacttagattcgatcccgcacactccacgtgttaatgggaaaattccagattttwataatgcgacaattgatcatgaatcattattagawagattaggcacttatggcttagctgaatatcanatagacggagatgggaattgccagttccgagctct

SEQ ID NO: 8431 - protein, 103 aa, Zea mays
  misc_feature: Ceres CLONE 369662-F
  misc_feature (70)..(70): Xaa is any aa, unknown, or other
  misc_feature (81)..(81): Xaa is any aa, unknown, or other
  misc_feature (92)..(92): Xaa is any aa, unknown, or other
MTEQQERVSKSSSSSISSSTQESEEELTIGTLITEATNTTNSAKSLGKRLSHLDSIPHTPRVNGKIPDFXNATIDHESLLXRLGTYGLAEYXIDGDGNCQFRA

SEQ ID NO: 8432 - DNA, 278 bp, Zea mays
  misc_feature: Ceres CLONE 369681-F
  misc_feature: Encodes the peptide sequence at SEQ ID NO. 8433
  misc_feature (124)..(124): n is a, c, t, g, unknown, or other
ctcggtcggtcgaacaatcttcaataacccagtcggcaggcgtgacccgatgctctctcgtcgtcggatcgccgccaccgtctcctccgcgtctacaccgatatggacgaccggcagtatgcancttgaccaaggcaggcttgggcgtgctggccttcaactcgggcctcgccatctacaactcctggggcgacgcgagctccgtcgcgttcgtgctctccgcggactccatcctcgtgctgctcttcctctgcctccgtgagctggagctgcagggg

SEQ ID NO: 8433 - protein, 92 aa, Zea mays
  misc_feature: Ceres CLONE 369681-F
  misc_feature (41)..(41): Xaa is any aa, unknown, or other
RSVEQSSITQSAGVTRCSLVVGSPPPSPPRLHRYGRPAVCXLTKAGLGVLAFNSGLAIYNSWGDASSVAFVLSADSILVLLFLCLRELELQG

SEQ ID NO: 8434 - DNA, 451 bp, Zea mays
  misc_feature: Ceres CLONE 369693-F
ccgctccatgccagcacctaggaacttgggccggagcttggcgttccgctgttcgcagccgcgaaggagagcttgaagacaccgccgcacccgtatttggtctgtggtgccgttcggctcccctgctatgggcagagcgcatcatttgcgagtgaggaacctggacagggcgactccgggggcggtgaaccggtgagtctcagtgaattgctcgccggcgacacatcgccaccgcgggtatgcgctacaaagtggatagggcctcgcaccgcgtgattcacgtgaggtcatgagaatctgaggatcatcctagtgcctggaatctcaagtgccaggagaagaacaagtggttcaagaggagccacacaacgagaagtttgattcgatctaggtggcgtctcccagttgactttctggcgccaaggatggattttagatcctgttatattta

SEQ ID NO: 8435 - DNA, 470 bp, Zea mays
  misc_feature: Ceres CLONE 369730-F
  misc_feature: Encodes the peptide sequence at SEQ ID NO. 8436
caaggattcaaggagagctagtttcaccattgatagagatggccggaggtggagcttctcgattgaacaggagcatctcgttgcggagcctaaggtgctgatggcatccagaaaggggaagaagacttcttctgagccagagtcagagaaagattgtgttgttgttgctccaaacagtgtagaggaaggacaagaatcctgtgatgatggaaaggaagaagaaactaccgagaatgcagagggagaaggaaaaacacattattcggaaatcaaccaagaagtagagaaagtagaaactagagcagaagagtgtgaaggtggggccggaccagtgatacagaggaggaagaagagtggcgagttaccagattgcctcatgttgatgatgtatgagccaaagctctccatggaggtctccaaggagacatgggtctgcagcactgacttcgtccattggaagtcttaccagg

SEQ ID NO: 8436 - protein, 156 aa, Zea mays
  misc_feature: Ceres CLONE 369730-F
KDSRRASFTIDRDGRRWSFSIEQEHLVAEPKVLMASRKGKKTSSEPESEKDCVVVAPNSVEEGQESCDDGKEEETTENAEGEGKTHYSEINQEVEKVETRAEECEGGAGPVIQRRKKSGELPDCLMLMMYEPKLSMEVSKETWVCSTDFVHWKSYQ

SEQ ID NO: 8437 - DNA, 241 bp, Zea mays
  misc_feature: Ceres CLONE 369806-F
  misc_feature: Encodes the peptide sequence at SEQ ID NO. 8438
  misc_feature (231)..(231): n is a, c, t, g, unknown, or other
atcagagttcagtgaagtgtagtgcagccagggcagcagagcgtgaggtgcactaccaggcaacaaggaaaaaaacaatggagctccaggcaaggtgcgtctgcgtcgtcgcgatgctcctggtggccagcttcgcggggctggataccgcgcacggsgsgggggagtgcggccgcgtcccggtggaccaggctgcgctcaagcttgccccgtgcgcgcggccacgcaganacccgcgtgc

SEQ ID NO: 8438 - protein, 54 aa, Zea mays
  misc_feature: Ceres CLONE 369806-F
  misc_feature (28)..(28): Xaa is any aa, unknown, or other
  misc_feature (52)..(52): Xaa is any aa, unknown, or other
MELQARCVCVVAMLLVASFAGLDTAHGXGECGRVPVDQAALKLAPCARPRRXPR

SEQ ID NO: 8439 - DNA, 506 bp, Zea mays
  misc_feature: Ceres CLONE 369820-F
  misc_feature: Encodes the peptide sequence at SEQ ID NO. 8440
acgggtagattgctgatgagaaaaacaagctggcataaatgaataattcgcaattggcatcttgcaggtgaaaggactgttgaaggagaagaaggtggagatgctggtggacccagatctgcagaaagcctacgaggaggtcgaggtggagagccttattcaggtggcactcctctgcacgcagggctcccccctggaccgtccaaagatgtcggaggtggtgaggatgctcgaaggtgacgggctggcagagcgttgggacgaatggcagaaagtagaggtggtgaggcaggaggctgagtcggcaccgctccgcaatgactggatcgtcgattccacgtacaaccttcgtgccgtcgagctgtccggcccaaggtagccactccacgactccgatgaaagaaaacactgaattggccaagattcagtctaattgctgcttgtgtatatgaaaggtagcttttggaattgttagcgacaatttgaaaggatcttttttttggatc

SEQ ID NO: 8440 - protein, 92 aa, Zea mays
  misc_feature: Ceres CLONE 369820-F
  misc_feature: SWISSPROT Homolog: EC 2.7.11.1 Non-specific serine/threonine protein kinase
MLVDPDLQKAYEEVEVESLIQVALLCTQGSPLDRPKMSEVVRMLEGDGLAERWDEWQKVEVVRQEAESAPLRNDWIVDSTYNLRAVELSGPR

SEQ ID NO: 8441 - DNA, 423 bp, Zea mays
  misc_feature: Ceres CLONE 369828-F
  misc_feature: Encodes the peptide sequence at SEQ ID NO. 8442
aaaccaggtcttcgctgggtttggttcgcttaccactccgtcctagcagcacggtcctcgattcttccgatcgctccggcagggcacacaccgatcccctcgtcaccggaggtggttaattagcggcttagcgccgccgaagaagggatggcagcagccaccacgcctgaggaggacgccgcctccgcggctgccgtggacgccaccactgagacaaccaatcacttcaccgtcaacacggacgccgccggtgccgatgctggtcctctcaagctcgacgacgtggacggaaacgtctacagctgcaagcgctgcgggacgctcctcgccgtcgccgacgacatcgtctccaagagcttccattgcaagaacgggaaggcttacctcttcgataatgttgtcaatgtaaccgtcggagagaaa

SEQ ID NO: 8442 - protein, 92 aa, Zea mays
  misc_feature: Ceres CLONE 369828-F
  misc_feature (38)..(92): Pfam Name: Yippee Pfam Description: Yippee putative zinc-binding protein
MAAATTPEEDAASAAAVDATTETTNHFTVNTDAAGADAGPLKLDDVDGNVYSCKRCGTLLAVADDIVSKSFHCKNGKAYLFDNVVNVTVGEK

SEQ ID NO: 8443 - DNA, 486 bp, Zea mays
  misc_feature: Ceres CLONE 369839-F
  misc_feature: Encodes the peptide sequence at SEQ ID NO. 8444
agtgatcaaaccgtgcccacaccgagcaagcatcgaccaaagagagaagggagaaagagacatccgccgtcgggtataggtgtgtgggtcgccaccttgctcataaagtatggtcggaggatgtcgacatgacgtgttgtacctgtgcgaggcatcttcgagctttggggtcagcgaaacctcgagaattcctcgttggagttcccactcccccgcggtgccactcctcgccgtggccggcgtcacctgagcgacaatccgtggtcaagtacaggtaccacaagataaggagcctgaaggatatcgcgatgagttcatgagaggtctaggtcgtcgtctccctgtcaactatggttacggagggtcgttatcttcatgtgatgtaattatttagctattttgtacagaacccctattatataatgaagatgtgacattcgtttctatatcataagtcatcatatgtgcgaaaaaaaaaaaaaaaaa

SEQ ID NO: 8444 - protein, 63 aa, Zea mays
  misc_feature: Ceres CLONE 369839-F
MTCCTCARHLRALGSAKPREFLVGVPTPPRCHSSPWPASPERQSVVKYRYHKIRSLKDIAMSS

SEQ ID NO: 8445 - DNA, 437 bp, Zea mays
  misc_feature: Ceres CLONE 369856-F
  misc_feature: Encodes the peptide sequence at SEQ ID NO. 8446
acagcaagctcgacggaactgactagaactagtacgtagatccaacactcgggacgaaattaaaagagacgacgcrcatcaaccagcaggcatcgcgcggtcaccaccatggcggcgcaggagggcggcatgaggctggtgtcgcacccgatcgcggcgcacgacgggcggctgcgcggcagtacacggcggaggggcagggcgccaagaaggacatgtcgccgccgctggagtggtacggcgtgcccgagggcgcgcggtcgctggcgctgctggtgcaggacatcgacgccgaccccagcgtgccgtggacgcactgggtggtggccaacatcccgcccgccaccaggggcctccccgaggggttctccggcgccgcgggrgcgggccgcgaccagctcggcggcctgcaggagggggtcaacgactggaagcag

SEQ ID NO: 8446 - protein, 74 aa, Zea mays
  misc_feature: Ceres CLONE 369856-F
MSPPLEWYGVPEGARSLALLVQDIDADPSVPWTHWVVANIPPATRGLPEGFSGAAGAGRDQLGGLQEGVNDWKQ

SEQ ID NO: 8447 - DNA, 518 bp, Zea mays
  misc_feature: Ceres CLONE 369859-F
  misc_feature: Encodes the peptide sequence at SEQ ID NO. 8448
acctcgtcctcctccgactctccgaccacccgcagcagcaacagcccaacaggcaaagctttgcttagctcctgctcctccactgctcaaggcatcaggccgtccttcctagcctagccagtaagccaggaggaacaacagccacacccaggcctatacgcgcgcgcaatggcctccgccttcttcttcgacgccgagccggactgcgagcccagcctgctgcccacgctggacgcctgcgcgctctgcgccaagccgctgggacgcgactgcgacatcttcatgtacagaggggacacgcccttctgcagcgaggagtgccgcgacgagcagatgcagctcgacgccatccgcgccaggcagcaggccgccaggtccgccgcacggaggcagcagcagcactcctccagaacggagtccaggcaccaggagtccatgaaggtatctgtggcgacctgaacggagtcctgatgactagtacaagacatcctcttgtgcagttgtgtgtcaacmaagat

SEQ ID NO: 8448 - protein, 96 aa, Zea mays
  misc_feature: Ceres CLONE 369859-F
  misc_feature (8)..(63): Pfam Name: DUF581 Pfam Description: Protein of unknown function (DUF581)
MASAFFFDAEPDCEPSLLPTLDACALCAKPLGRDCDIFMYRGDTPFCSEECRDEQMQLDAIRARQQAARSAARRQQQHSSRTESRHQESMKVSVAT

SEQ ID NO: 8449 - DNA, 427 bp, Zea mays
  misc_feature: Ceres CLONE 369914-F
  misc_feature: Encodes the peptide sequence at SEQ ID NO. 8450
aaacgtgcagaccttggtgggggagcgaggagtcgaaacaagggtaagaaccatgagtgaaacagggcacactgtacaagtcactaacctctcgagcagagtatctgaaagtgatctttatgagttcttttctttctctggccctattgaacatgttgaacttatcagatcaggagaatacggtgctactgcttatgtgacattcaaggagcgctttgccttggaaactgcggtattgctcagtggggctactattgtggatcagccggtatgcataacttattggggacaacctgaggagacttttaatttctgggacaggccaacttgggaggttgaagaggaaattgaatacacggaagctcttacagtggctcaagatatcgtgaagacgatgctagcaaaggggtacgtgctcagcaaggac

SEQ ID NO: 8450 - protein, 125 aa, Zea mays
  misc_feature: Ceres CLONE 369914-F
  misc_feature (8)..(75): Pfam Name: RRM_1 Pfam Description: RNA recognition motif. (a.k.a. RRM, RBD, or RNP domain)
MSETGHTVQVTNLSSRVSESDLYEFFSFSGPIEHVELIRSGEYGATAYVTFKERFALETAVLLSGATIVDQPVCITYWGQPEETFNFWDRPTWEVEEEIEYTEALTVAQDIVKTMLAKGYVLSKD

SEQ ID NO: 8451 - DNA, 473 bp, Zea mays
  misc_feature: Ceres CLONE 369946-F
  misc_feature: Encodes the peptide sequence at SEQ ID NO. 8452
atttttcaacgaggaacacgagtccacaagtaacgcctgtacggaaacccttcgggaattaatgcgcccgtcctcgccacgaccgcagcaatccaccgcccttggccgtgccccgtgctgccgtactcgtaatccgtgaggggaagcgtccgcgctccgggccccgccgccgatagttccttcaagggagcgatgagcgcgcggtcgatggagacggtggaggaggatgtggaggagtacagctggcgggaggtggtgctgccgcacctcgtccccgtggttcccggcgcgccaccggagctcgagcgggagaccggggagcggcgccgcggcagggacctcctcgtcgccgtcgacttcggcccgaactccaagcacgcctttgactgggcgctcgggcacatcgcgcgcatggccgacacggtccacctcgtccacgccgtctccagtgtgcaaaatgagattgtgtatga

SEQ ID NO: 8452 - protein, 88 aa, Zea mays
  misc_feature: Ceres CLONE 369946-F
METVEEDVEEYSWREVVLPHLVPVVPGAPPELERETGERRRGRDLLVAVDFGPNSKHAFDWALGHIARMADTVHLVHAVSSVQNEIVY

SEQ ID NO: 8453 - DNA, 1145 bp, Zea mays
  misc_feature: Ceres CLONE 369954
  misc_feature: Encodes the peptide sequence at SEQ ID NO. 8454
agcgcgcacacctacgtgtcgagccgtcttcatccctccgaccggaaatcaacggaagcggacgcgagaggagactaaccgacctcggatccatcgacgcgtgaagatgtcttcgcccgccgagtactacaaatcacttccacctataagcaaggcatatgggacattgtgtttctttaccaccgtgctagttcagctccagattttgcacccattatttctttacttagattaccccttggtgttcaagaagtttgagatatggaggctattgacaagtttctttttcctggcaccattttccatgaaatttggtattcgccttctgatgatagcaaggtatggtgtcatgttggaaaagggtgcatttgataagcggactgcagatttcttatggatgatgatatttggtgccatctcactattggtgttgtctattattcccctattcaattcttttttcttaggaatacctatggtcagcatgctcctttatgtctggagccgagagaatccaaatgctcagataaatatatacggcctcgtccaattgaggtccttttatcttccatgggctatgctcttattggatgtgatatttgggtcatcattaatgcctggacttctgggtatcatggttggacatctctactacttctttgcagtgttgcaccctcttgccaccgggaagaactacctcaagactcctaaatgggtacataagattgtttctcgattcaggataggcatgcaagcaaactcacccgtccgtccaccagccaatggcaacagcgggtctggtgtgtttagaggaagaagctataggctcaatcaatagattcacccacctcgtaatgtgatccatggtcggagtggcaatgtagaagcaaagaccagaacgcatagtagggtcaatcaaaattaagggttacccgtcagagattttcttaaaaaacctggacggacggaatggagaaccctttcatttgctcatttagttgctaacaatgttcatcgtccatgtttacacatgaatataattctgtaatgacaatttgtgtacacttatgctggacttattgtcgcctctttttagctaggataagaacaaaagatgatgagtttgcacaaaaaaaaaaaaaaaa

SEQ ID NO: 8454 - protein, 243 aa, Zea mays
  misc_feature: Ceres CLONE 369954
  misc_feature (11)..(202): Pfam Name: DER1 Pfam Description: Der1-like family
MSSPAEYYKSLPPISKAYGTLCFFTTVLVQLQILHPLFLYLDYPLVFKKFEIWRLLTSFFFLAPFSMKFGIRLLMIARYGVMLEKGAFDKRTADFLWMMIFGAISLLVLSIIPLFNSFFLGIPMVSMLLYVWSRENPNAQINIYGLVQLRSFYLPWAMLLLDVIFGSSLMPGLLGIMVGHLYYFFAVLHPLATGKNYLKTPKWVHKIVSRFRIGMQANSPVRPPANGNSGSGVFRGRSYRLNQ

SEQ ID NO: 8455 - DNA, 485 bp, Zea mays
  misc_feature: Ceres CLONE 369966-F
  misc_feature: Encodes the peptide sequence at SEQ ID NO. 8456
  misc_feature (446)..(446): n is a, c, t, g, unknown, or other
acacgacgggagaagaaatggcatctttgtcccgcacagccgtcgccgccgtgaggtccgcagcccgctcagcaccccttaccggccgcgtcccaggtgcgccactgcttcccttgcctcgtcttccgctgcccggtccgcccggatcctccgcaggtcggcggccgcgtcgtcgtcggggctggagacgctcatgccgctgcacagcgcggtggcggccgcgcggcttaggtcctgcatcgccgttgacttctcctgctggagctcgctctcacaaggccaagttcatggagctactgcttaggagcgtgtgttcattctctgacttattggctgtcagtgctaaatggcgcataccaatttggaaacttgtgaacttccatagtagtttcgattttgtataaccttttgtttctggcaacattgacaaaatttgatcagcaggnatctttatgaatgcttttcaaagttacactagtacttgt

SEQ ID NO: 8456 - protein, 100 aa, Zea mays
  misc_feature: Ceres CLONE 369966-F
HDGRRNGIFVPHSRRRREVRSPLSTPYRPRPRCATASLASSSAARSARILRRSAAASSSGLETLMPLHSAVAAARLRSCIAVDFSCWSSLSQGQVHGATA

SEQ ID NO: 8457 - DNA, 440 bp, Zea mays
  misc_feature: Ceres CLONE 370002-F
  misc_feature: Encodes the peptide sequence at SEQ ID NO. 8458
gtgcaatctgggagtggtgttaacagcgccgcaccacctcgtgccgtgggaggtcgagctcgtcgatgcgacgctcctcggagagcagcgcctcctcctgcgcggtcttcttcggcgcgagggcgggcgggacggagggcgccgaggaggaggcggtggcggaggagctagggttagggttcgccgccgccgtctgagctgcggcgtcgaggttgctggggtcggaaccggtagcagctgcggcggaattcgcggagggcaccgacgtgccggccttggcgagcagctggcggtgctcgtcgcggcgcttctggagctgcttctgctccagctccgaccgccgcacgaagctcttgctcccgaagtcggccgtcgccgccttccgcttcttctccagttcccgcttcagcagatccattacgcccgccgcccagttcggc

SEQ ID NO: 8458 - protein, 43 aa, Zea mays
  misc_feature: Ceres CLONE 370002-F
MRRSSESSASSCAVFFGARAGGTEGAEEEAVAEELGLGFAAAV

SEQ ID NO: 8459 - DNA, 415 bp, Zea mays
  misc_feature: Ceres CLONE 370006-F
  misc_feature: Encodes the peptide sequence at SEQ ID NO. 8460
aggaatcccataaagataaaggtttcagtttcggaagccaagccactcccacacccccacgctcgagcgaagggagccagcaatggcgcgtcgcgggccgtgagagacgggaacaagaatggctgccatggtgcgcgggccggcgatggcctctgcggctgggccgggtgcgacgtcggcggctgctgcggccgcggcggargagatgcggtggcggcagctagacagcggcgtgagcgcggtgtcgttcgggttcgtggccaccgccatactcgtgtccatgttcctcgccatggccatcctcgagcacttcctccgccccacgacgtcgacccacgcgccgccccggggccggggcgtcctccgccgcctccgcctcttcctcctcggccgcggtggcggcgccccggcggga

SEQ ID NO: 8460 - protein, 99 aa, Zea mays
  misc_feature: Ceres CLONE 370006-F
MAAMVRGPAMASAAGPGATSAAAAAAAEEMRWRQLDSGVSAVSFGFVATAILVSMFLAMAILEHFLRPTTSTHAPPRGRGVLRRLRLFLLGRGGGAPAG

SEQ ID NO: 8461 - DNA, 422 bp, Zea mays
  misc_feature: Ceres CLONE 370028-F
  misc_feature: Encodes the peptide sequence at SEQ ID NO. 8462
aggggaaatcataggttctccacgacgcggccacctccgccgccgccagcgccccctgctagggtcaacacccgctctctgcggactgcgtgaaacaccagcggcggccaccgggcaggacgagccccctccccaaacagagaggggcggggatcagtgcgtgcgctcctggtggagggcgtggaagagctgggcaggcggcaagcaggggtttgggaggatggtttcgctctcgacttggttccgctatgccgcacaaaagttcgagtactgcgtttccctctcgttgaagaaatataatgatgtgggccagatcagcagcacacagttaactgatgtgttacacaaaaatttattccaaggcaagctcacctacgtgtgtcggaccaaaggggaagaagccatggctcccatcgcatctc

SEQ ID NO: 8462 - protein, 67 aa, Zea mays
  misc_feature: Ceres CLONE 370028-F
MVSLSTWFRYAAQKFEYCVSLSLKKYNDVGQISSTQLTDVLHKNLFQGKLTYVCRTKGEEAMAPIAS

SEQ ID NO: 8463 - DNA, 506 bp, Zea mays
  misc_feature: Ceres CLONE 370063-F
  misc_feature: Encodes the peptide sequence at SEQ ID NO. 8464
atcgatgatccatcctcacttgctataaaaagaggtgtccatggtgctcaagctcagccaagcaaataagacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatcgacgaccattggatatgattattatctatctagcttgtggtggtggttgaacaataataagcgaggccgagctaggctgccatacataggtattgtgtggtgtgtgtgagagagagagaaacagagtcttcagtt

SEQ ID NO: 8464 - protein, 76 aa, Zea mays
  misc_feature: Ceres CLONE 370063-F
  misc_feature (1)..(76): Pfam Name: Metallothio_2 Pfam Description: Metallothionein
MSCNCGSSCGCGSSCKCGKKYPDLEETSTAAQATVVLGVAPEKKAAPEFVEAAAESGEAAHGCSCGGNCKCDPCNC

SEQ ID NO: 8465 - DNA, 482 bp, Zea mays
  misc_feature: Ceres CLONE 370064-F
  misc_feature: Encodes the peptide sequence at SEQ ID NO. 8466
gttcccaatttgaaggctgcccaacccttgcgccggtaggcggtggcggtgaggatagagggttacctgaggaggcagtgatggcggccacgattcagtacaaccggagcaacccggcggtgaagcggatcctgcaggaggtcaaggagatgcagtccaacccctcacccgacttcatgtccctccccctcgaggaggacatcttcgagtggcaatttgctatccttggtccgagagacagcgagtttgagggtggaatttatcatggcaacacatccaagtccatgstcaggctcgtcgagtggccatcctgtgcctgaagctgaatcgctggctgcagaaaacacgggtgaagcatcagcagttgaggttgccaaccatcaagtgcctgaagcgagccgtagagaaagcattccaagagttccttcgtctctgcagaatgctgctattgcaacccagaagccaaagcatgacaggctatt

SEQ ID NO: 8466 - protein, 79 aa, Zea mays
  misc_feature: Ceres CLONE 370064-F
  misc_feature: SWISSPROT Homolog: EC 6.3.2.19 Ubiquitin--protein ligase
  misc_feature (70)..(70): Xaa is any aa, unknown, or other
MAATIQYNRSNPAVKRILQEVKEMQSNPSPDFMSLPLEEDIFEWQFAILGPRDSEFEGGIYHGNTSKSMXRLVEWPSCA

SEQ ID NO: 8467 - DNA, 415 bp, Zea mays
  misc_feature: Ceres CLONE 370071-F
  misc_feature: Encodes the peptide sequence at SEQ ID NO. 8468
  misc_feature (31)..(31): n is a, c, t, g, unknown, or other
  misc_feature (327)..(327): n is a, c, t, g, unknown, or other
gtcgaaccgaaagcaccaccagcgacaaagnkagagcgcaacgagcagtggaggagccaccaccaccgccatgagctacgawgcacagccaccgaggtcaatgcacgctcgccattggccgctcaatgccgtggttgggmcttcgtcgcctcttacatcaccggtcaagaacaagtaccgccaagatgaggagcatgaaggatgctacgatgagttcgggaggtctagtccgatgtctcccaatcaactatggttgcagaggatcattgttgtcatataatgtatatttatgtagctgttttgtacaaaacttctattatataatanrgatgtaacattgatttatgtaccatgagtagtcatatgtgtgagacttgaacctaacacaaatttaagacacacctagatttgtcct

SEQ ID NO: 8468 - protein, 69 aa, Zea mays
  misc_feature: Ceres CLONE 370071-F
  misc_feature (4)..(4): Xaa is any aa, unknown, or other
  misc_feature (24)..(24): Xaa is any aa, unknown, or other
MSYXAQPPRSMHARHWPLNAVVGXSSPLTSPVKNKYRQDEEHEGCYDEFGRSSPMSPNQLWLQRIIVVI

SEQ ID NO: 8469 - DNA, 477 bp, Zea mays
  misc_feature: Ceres CLONE 370073-F
  misc_feature: Encodes the peptide sequence at SEQ ID NO. 8470
  misc_feature (65)..(65): n is a, c, t, g, unknown, or other
  misc_feature (66)..(66): n is a, c, t, g, unknown, or other
attttctattccgtattgaaggcgtcgatggccttgtccgccctaatcagcaccctcctcgccgnngccatctggtgcgccgcttacctcgccgctgccatctcctccgccttctgattcccactccccaaccctaacctcccccctgtagcacaccccacctctagctttgtaggtcctactatacttgcaacctctcccgctgactcgcttcgatctacccgccctcgcgtcaccatggggtacgcgcacgtcgtcatcggccccgctgggagcggcaagtcaacttattgctccagtttatgcgaccattgccagaccgtgggaaggacaattcatattgtcaatcttgatccagctgctgagcacttcgactatcctgtagatatggatattagagagctgatttcattggatgatgttatggaggatattgggttggggccaaatggcggtctcatctactgcatggagcac

SEQ ID NO: 8470 - protein, 80 aa, Zea mays
  misc_feature: Ceres CLONE 370073-F
  misc_feature (7)..(80): Pfam Name: ATP_bind_1 Pfam Description: Conserved hypothetical ATP binding protein
MGYAHVVIGPAGSGKSTYCSSLCDHCQTVGRTIHIVNLDPAAEHFDYPVDMDIRELISLDDVMEDIGLGPNGGLIYCMEH

SEQ ID NO: 8471 - DNA, 456 bp, Zea mays
  misc_feature: Ceres CLONE 370074-F
  misc_feature: Encodes the peptide sequence at SEQ ID NO. 8472
acgcaaactagcagtgccaactgccatcttcttctccagctgcgctgtgcccgtccccccgccaccaaggtccaaggtctccggagcgcgacctggctgcaacgcaggcaatggagtcgccgttccgcgcggacctgctgagggggaaggcggcgctggtcacgggcgggggctccggcatcggcttcgagatcgccgcgcagctcgcgcgccacggcgcgcacgtcgcactcatgggccgccgccgcgaggtcctcgacaaggccgtcgccgcgctccggtccgagggcctcagggctgttggttttgacggggatgtccgaaagcaagaggatgctgccagagtgatcgcagcaacggttgagcattttggcaaactggacattcttgtcaatggtgctgccggcaacttccttgcctccccggaggatttgaagcccaagggattccggactg

SEQ ID NO: 8472 - protein, 115 aa, Zea mays
  misc_feature: Ceres CLONE 370074-F
  misc_feature (13)..(114): Pfam Name: adh_short Pfam Description: short chain dehydrogenase
  misc_feature: SWISSPROT Homolog: EC 1.3.1.34 2,4-dienoyl-CoA reductase (NADPH)
MESPFRADLLRGKAALVTGGGSGIGFEIAAQLARHGAHVALMGRRREVLDKAVAALRSEGLRAVGFDGDVRKQEDAARVIAATVEHFGKLDILVNGAAGNFLASPEDLKPKGFRT

SEQ ID NO: 8473 - DNA, 471 bp, Zea mays
  misc_feature: Ceres CLONE 370117-F
  misc_feature: Encodes the peptide sequence at SEQ ID NO. 8474
atcctctccgccacctcgcacccacgcaagcgagtcagccaagccacgcccgacccccgcctccattcccggggcggagacgcgcctgcctgccatgggaatggggccgctcgacaacgccgcgtcggccgcgctggaggccgccgccgccccctcgcgggcgggctcgtacgcggtgctgcagtgcggcgaggactcggagtacgtgcggcagaagtacggcggctacttcgccgtcttccgcgcgctgctggaggaggacggcgagaggtggcgggtgtacagcgccgtccgcggggagctccccgccgacgccgaggcagccgggttcgacgggttcgtcatctccgggagctgcgccgacgcgcacggcgacgagccctggatcctcgcgctcgtcgacctcacccgccgcgtccacgccgccggcaagcgcgtcctcggcgtctgcttcggccaccagatcctgtg

SEQ ID NO: 8474 - protein, 125 aa, Zea mays
  misc_feature: Ceres CLONE 370117-F
MGMGPLDNAASAALEAAAAPSRAGSYAVLQCGEDSEYVRQKYGGYFAVFRALLEEDGERWRVYSAVRGELPADAEAAGFDGFVISGSCADAHGDEPWILALVDLTRRVHAAGKRVLGVCFGHQIL

SEQ ID NO: 8475 - DNA, 133 bp, Zea mays
  misc_feature: Ceres CLONE 370162-F
actctctctccccatccgcgccagtccaaccaagtcagcacccgcgcgcgcaaggagttcacgcccatggsagcaccaacatggcgtcggccacctcgcggttcatgctggccgcgggcgtgcccactgccag

SEQ ID NO: 8476 - DNA, 432 bp, Zea mays
  misc_feature: Ceres CLONE 370186-F
  misc_feature: Encodes the peptide sequence at SEQ ID NO. 8477
acagtctgcgtctctttccccgtcgtggtgggttccgatccaatcgacgtcgacgactccgcagccaccgctcctctcctgctcgtcgcttcttccgtctctcggcgtcgaatctcatccggccagtgaccacactctactagccgcccggaaggagttcttccgggtttcgagccgttgctgccctcacctctgcaggcccggcgtcgagcggagatccaatcggaaattcaactgacttcgtcatttgtcgcatccccgtcaggagaatcaatgtcaggagtgatcacaaagttcgcggttacatccatggtgatgtggatggcccctgttgcgatcatgtatgggttttactaccaggtgtttccaggtgtgagtcagatgtcatcctcggcgcagacacttgccagtgggttcctggctgtcatatcg

SEQ ID NO: 8477 - protein, 53 aa, Zea mays
  misc_feature: Ceres CLONE 370186-F
MSGVITKFAVTSMVMWMAPVAIMYGFYYQVFPGVSQMSSSAQTLASGFLAVIS

SEQ ID NO: 8478 - DNA, 472 bp, Zea mays
  misc_feature: Ceres CLONE 370197-F
  misc_feature: Encodes the peptide sequence at SEQ ID NO. 8479
gtccagcccaaagataagcccctgaactaccagtggccacacacagattccttcgattcccgctgacagcgaagctgaggagaatcccaagaaacagagccggtgaaattgcattgtcgcaacaggcaagagaagaggagaagaaagaaatggctgcaatacctgcagcgatcccgggctgctgctcttcgtctcgcctgcctcagcttgctggcctccctgcctccacaagcagaaggcgcttcaaggtcacggccatggcgcccaaaaagaaggtgaaccgctacgacgagaactggtcgaagcagtggttcggcgcgggcatcttcgcggagggcagcgaggaggtgtccgtggacgtgttcaagaagctggagcggcgcaaggtgctgagcaccgtggagaaggccggcctgctgtccaaggccgaggarctgggcctgacgctctcctcgctggagaagctgggcct

SEQ ID NO: 8479 - protein, 71 aa, Zea mays
  misc_feature: Ceres CLONE 370197-F
  misc_feature (1)..(71): Pfam Name: DUF1118 Pfam Description: Protein of unknown function (DUF1118)
MAPKKKVNRYDENWSKQWFGAGIFAEGSEEVSVDVFKKLERRKVLSTVEKAGLLSKAEELGLTLSSLEKLG

SEQ ID NO: 8480 - DNA, 181 bp, Zea mays
  misc_feature: Ceres CLONE 370202-F
  misc_feature (97)..(97): n is a, c, t, g, unknown, or other
  misc_feature (116)..(116): n is a, c, t, g, unknown, or other
aaaaataacaattttttcttcgcctgctaaatagttaaagggttcctctckacgcacgtctccgagtccgagaggmttcctcgagcgagttcgcganatccaattctcccagcgankggaagtcatggtagtgatcgagctggagcccgaggwggcgacgcgcccctcgtcaccggcatcg

SEQ ID NO: 8481 - DNA, 645 bp, Zea mays
  misc_feature: Ceres CLONE 370269-R
  misc_feature (284)..(284): n is a, c, t, g, unknown, or other
  misc_feature (328)..(328): n is a, c, t, g, unknown, or other
  misc_feature (371)..(371): n is a, c, t, g, unknown, or other
cgattgggtacgggcccccctcgagtcgacggtatcgatattttttttttttttttttagtactaaacatcaaatatgtttaaatatcctataacgtaaatccaaaagcaaatagaataggttcaacagccacaagctccagttgagcacaactactacaatagcaatatgatcagaccaactagacaacaagcataacaaataaaaaagaggtccattgttgtgagatgtaactttagcatgattggatgatgacaacaatcttaaggaggagacagagcttnttcttggaggcgggttgaaggtcaacattgtgaaggaatttacnttgagctcaacaaaatatgggaaacaacttatgtagaagactncacaaagtgtcccatcttcaactgaactaacaccattggcctccaaaatcttcgaaggcccctcccaggggttgggaaaaggcccattgggggggaaccccccccccgcggaaaaaccccccttggggggggttgggggggggggggggggggccccccccaacagtccccccccccccggggggggcccccccccccacaaaaaaaaaaaatgttggttttttttccccgggggggggggcgcccctcccccccctccaaaaaaaaaaaaaaa

SEQ ID NO: 8482 - DNA, 444 bp, Zea mays
  misc_feature: Ceres CLONE 370291-F
  misc_feature: Encodes the peptide sequence at SEQ ID NO. 8483
tgtcctcttcctgtcgccgcactcattttctcttgccggtaaggagtggagatccgcgtccatcttctattgattaggataccgggtggaatagggaacggccatacaccatggcggatttctccaaggaatcttgcccttctgtgaagaacattttacttctggattctgaaggaaagcgtgttgctgtaaagtatttctcagatgattggccgactaatgcatcaaagttagcctacgaaaagtctgtttttactaaaactctaaagacaaatgcacggacagaagctgagataacattgtttgatggttatattgtcgtttacaagtttgtacatgaccttcacttttttgtcaccgctggagatgatgagaatgagctcatcttagcaagtgtactacatggtttttctgattctgttggtcttctactcaggggtgatg

SEQ ID NO: 8483 - protein, 111 aa, Zea mays
  misc_feature: Ceres CLONE 370291-F
MADFSKESCPSVKNILLLDSEGKRVAVKYFSDDWPTNASKLAYEKSVFTKTLKTNARTEAEITLFDGYIVVYKFVHDLHFFVTAGDDENELILASVLHGFSDSVGLLLRGD

SEQ ID NO: 8484 - DNA, 425 bp, Zea mays
  misc_feature: Ceres CLONE 370315-F
acaccaaatggggcgacgcctgccgccggggagcattcaatcgtcggcggcacaccgtcccccattcttcccgttccccaacgtgaagtggcaccatggtcgccactcgccacgcgctcgccgcaggagcaggagcagcgactgcgggccagccagcctccggttgggtagctgttctgcgcaacagtccgaggggcgcggatggaggagggaccaaacaggagcggaggggaaggcgggcggtacaactgatgagccggtacctgttctacgatggcggtcgcttcagacacgaaagatgttcttgcgagggacatgctgatcatcgccttcgagtaagatgctccaaccatgaggagcataggcacaactagcagggagagcaggccgacctcccaacagcacgcgaaggcmacaatgatagc

SEQ ID NO: 8485 - DNA, 464 bp, Zea mays
  misc_feature: Ceres CLONE 370325-F
  misc_feature: Encodes the peptide sequence at SEQ ID NO. 8486
accgcacatgaagctgttggcaagtcaattattgcgtcccactcccactcggatacgatccctttatgtaaacgaagccggggaacagtcgacggcaaaggcccccttcgtcctcctcttggtgtcgtccgtcgccgctttcgccgccgccgaccacggcctcacgcacatccatctgtacgtgcacgagacgtacaccggggcgaacgccacggccgccgccgtgctgcagtccccgctgggcgccaactcgtcgttcgggagcatgggcgtggtggacgacgagatacgcgtgggcccggaccggtcgtcgcagctcgtcggccggtaccagggcgtcttcttcggcacgagcgtgcagctgggcgccggctacctgtcgtccatcacgctggtgttcaccgccggcgagtacaaggggagcaccctgtccgtgcagggccccctgctcgggttcacgggca

SEQ ID NO: 8486 - protein, 152 aa, Zea mays
  misc_feature: Ceres CLONE 370325-F
  misc_feature (32)..(152): Pfam Name: Dirigent Pfam Description: Dirigent-like protein
MKLLASQLLRPTPTRIRSLYVNEAGEQSTAKAPFVLLLVSSVAAFAAADHGLTHIHLYVHETYTGANATAAAVLQSPLGANSSFGSMGVVDDEIRVGPDRSSQLVGRYQGVFFGTSVQLGAGYLSSITLVFTAGEYKGSTLSVQGPLLGFTG

SEQ ID NO: 8487 - DNA, 230 bp, Zea mays
  misc_feature: Ceres CLONE 370377-F
  misc_feature: Encodes the peptide sequence at SEQ ID NO. 8488
  misc_feature (99)..(99): n is a, c, t, g, unknown, or other
aaaattaccaaaccctaccccttcgccgcgaccgssatcccccacatcgttggcgatgagctcctcctccaacagcgggaagaagccggckcycgbstnccgcggggggcccaccatccgcacgctcgccgacataaaccgtggccctgccggtttcccaggtgccggassgtcagcagcgatgacgacgagccccaggagktactacaccggcggcgagaagagtggaa

SEQ ID NO: 8488 - protein, 58 aa, Zea mays
  misc_feature: Ceres CLONE 370377-F
  misc_feature (13)..(13): Xaa is any aa, unknown, or other
  misc_feature (14)..(14): Xaa is any aa, unknown, or other
  misc_feature (15)..(15): Xaa is any aa, unknown, or other
  misc_feature (39)..(39): Xaa is any aa, unknown, or other
  misc_feature (49)..(49): Xaa is any aa, unknown, or other
MSSSSNSGKKPAXXXRGGPTIRTLADINRGPAGFPGAGXSAAMTTSPRXYYTGGEKSG

SEQ ID NO: 8489 - DNA, 494 bp, Zea mays
  misc_feature: Ceres CLONE 370403-F
  misc_feature: Encodes the peptide sequence at SEQ ID NO. 8490
aatcgcaagaaaaaggaaatcaaaacaaagtaaagtgggggggaaagcatggcgatagctcttctcccatccgttcgtcttcttccacaaagtctctccagaaggccaccaccaacctcgtcgccattatccgttcgccgcccacggccaagagcccttcccctccctcgcgtccactgccgcgccggccggaccccggaccccctcaccgctgctagggaggctgctgccttttgggttgggaagctcgccggcgttgtgccatggaaggccgcggtctccggcgtggtcgccctcgccgtctccttcacctgccttgttggtttggccaatgccagaactggggtaaacaaaccagaattgcttcctaaagaatttactaccgtcatcgatgttgctggttttctctcgtcaggccaggaaaaccgtttgcgccaagagatagaagacctggagaaagatacagggtacaaactgcgagttcttgcacaaaa

SEQ ID NO: 8490 - protein, 148 aa, Zea mays
  misc_feature: Ceres CLONE 370403-F
MAIALLPSVRLLPQSLSRRPPPTSSPLSVRRPRPRALPLPRVHCRAGRTPDPLTAAREAAAFWVGKLAGVVPWKAAVSGVVALAVSFTCLVGLANARTGVNKPELLPKEFTTVIDVAGFLSSGQENRLRQEIEDLEKDTGYKLRVLAQ

SEQ ID NO: 8491 - DNA, 432 bp, Zea mays
  misc_feature: Ceres CLONE 370421-F
  misc_feature: Encodes the peptide sequence at SEQ ID NO. 8492
cccctcgaccgagctcctctcctgcccatccatggtgctcggcacccggtatccctgctcctcttccttggcggccgagcggggctccctctgacgactccgcgcttcctctggtgcacggccgcctctattgccgtcgcctggggcttctgctgcgttaccatgggccaaacagcgaggaaaatgccgagagagaggtagagacagtttggtcgtcgagtcacatggagggtgccctggtggccggggaatccttcacctgcggggtgctacatcgccgggctgctgcatcgtggtctgcctctactaccagggctgactccattgccggacagccaaaactctcggtcgagtctctgaaggccgtctgtccctgttccttccgattccaaggcgccgccgggctgtgctgctaccgtctgttgttgaggt

SEQ ID NO: 8492 - protein, 69 aa, Zea mays
  misc_feature: Ceres CLONE 370421-F
MEGALVAGESFTCGVLHRRAAASWSASTTRADSIAGQPKLSVESLKAVCPCSFRFQGAAGLCCYRLLLR

SEQ ID NO: 8493 - DNA, 448 bp, Zea mays
  misc_feature: Ceres CLONE 370432-F
  misc_feature: Encodes the peptide sequence at SEQ ID NO. 8494
accttgccatcacctcctcgcctagcctgccactgcagcaggtgccaccgctatctctgctctgctctcgcaacgcaggcacacgcccgcgccgcctgccacagttgccatggcgaccatagccacgatggcgctgctgaagcccgccgccaaggccgcggcgcggtcggcgccgtccaccagcagcggcagcgtctcgctgcgcgtccggacggggcaggccgccaagaaggctgcggtgtccgcgtccgcgtcgtccacgctggcgggcgccttcttcgcggcgctggcgtcgtcgcccgacgctgcgctggcggacgtcgtggcggcggcggacgccggcggcgacagccgcggccagctgctgctcgtcgtggtggcgcccgccatcgggtgggtgctgtacaacatcctgcagccggcgctgaaccagctgaaccgcatgcgc

SEQ ID NO: 8494 - protein, 113 aa, Zea mays
  misc_feature: Ceres CLONE 370432-F
MATIATMALLKPAAKAAARSAPSTSSGSVSLRVRTGQAAKKAAVSASASSTLAGAFFAALASSPDAALADVVAAADAGGDSRGQLLLVVVAPAIGWVLYNILQPALNQLNRMR

SEQ ID NO: 8495 - DNA, 495 bp, Zea mays
  misc_feature: Ceres CLONE 370434-F
  misc_feature: Encodes the peptide sequence at SEQ ID NO. 8496
actcagctgtccgtgttcttgatcgattaagctgtcctcaaccatcatggctgccattatggcggcaggtctggtagtactggcactcctcgctgccgtcgccgctccggcgcacgccacggactacgtggtgggcgactcggccgggtgggccagcggcgtggactacgccacctgggcgagcggcaaaaccttcgctgctggggacaacctagtgttccagtacagcgcgatgcacacggtggcggaggtgagctccgcggactacagcgcctgctcggccagcaactccatccagtcctacagcgaccagaacaccaaggtcgcgcttacggcgcccggcacgcgctacttcatctgcggcgccccgggtcactgcggcaacggcatgaagctcaccgtcacggtcgccgccgcggcgccaccaccaccccggagacgtccacgtctacgcccgccgcaacgacgacgcccaccacgaccaacgctgacacg

SEQ ID NO: 8496 - protein, 149 aa, Zea mays
  misc_feature: Ceres CLONE 370434-F
  misc_feature (35)..(115): Pfam Name: Cu_bind_like Pfam Description: Plastocyanin-like domain
MAAIMAAGLVVLALLAAVAAPAHATDYVVGDSAGWASGVDYATWASGKTFAAGDNLVFQYSAMHTVAEVSSADYSACSASNSIQSYSDQNTKVALTAPGTRYFICGAPGHCGNGMKLTVTVAAAAPPPPRRRPRLRPPQRRRPPRPTLT

SEQ ID NO: 8497 - DNA, 399 bp, Zea mays
  misc_feature: Ceres CLONE 370491-F
  misc_feature: Encodes the peptide sequence at SEQ ID NO. 8498
aaaaaaaaatctaattgcagtggctcgagcctccgccgcggccataggtcggtccgaaaccctgggtccggcccacacctataataaagcccactagcggtccagacaggagccggaagtggcaccggccgccgccgaacgtgtccactgttcagtgcggctcgagtaacaacagcaatagaatgggtggcggcggcgggagcccggcagcgagcggcgggagcagcagcagcgaggatgacggtgacgccgcgtggaaggcagccattgactccatcgcgtccgtggggttcagcgtcccttcgtccaacggcgtggcgaaggcagcctctagcggcagccgcgaggtgaacaaccgcgctgatckggaagagccgcgtgaggggaagccaaagagtc

SEQ ID NO: 8498 - protein, 72 aa, Zea mays
  misc_feature: Ceres CLONE 370491-F
  misc_feature (62)..(62): Xaa is any aa, unknown, or other
MGGGGGSPAASGGSSSSEDDGDAAWKAAIDSIASVGFSVPSSNGVAKAASSGSREVNNRADXEEPREGKPKS

SEQ ID NO: 8499 - DNA, 196 bp, Zea mays
  misc_feature: Ceres CLONE 370503-F
  misc_feature: SWISSPROT Homolog: EC 3.6.3.14 H(+)-transporting two-sector ATPase
agagatcgcatacgcctgcctgcccacccacctccccttttccttcctcttcgccccagcgacgcggccgcccggagaccgagcgaggcaggcaactaaccaccgagaggcagggacaggaacaggaagccggaggcgaagatgtcgtcggtgttcagcggcgatgagacggcccccttcttcggcttcctcaagc

SEQ ID NO: 8500 - DNA, 419 bp, Zea mays
  misc_feature: Ceres CLONE 370529-F
  misc_feature: Translation starting site: 34
actgctcgagctcagctcaagtaaccacagaaaatggcgtcacttctccgccctctcgtcctcgtgctcctgatcgcctcctgcacagcgcagcagtcaccgccggcgcagcccccgccaacgccgaacgcgccaccggccaactcgccgccccaggcgcctccagccggcaacccgccgccggcaggcaacccgccacccgcgcccaccgccactccacctccggccccgaccactccgcccccggccccgaccactcctcccccggctcccacaacgccgcccccggcgccgacaactccacctccggcccccaccacgccgcctccgtccccaccagcgtcgccaccgcccgctcccaccactccgccaccgtctcccccggcaagcccgccgcccgctcccgccaccccgccacc

SEQ ID NO: 8501 - DNA, 634 bp, Zea mays
  misc_feature: Ceres CLONE 370548
  misc_feature: Encodes the peptide sequence at SEQ ID NO. 8502
agcagagtttccctctccccgactcccgactcccgactgccggccctgccctgcgccgcgcggagccgcggaccgcccgcccaccaccgaaaccctagagcaagcagggatgcacggtccggtcccgctcctcctcctcctcctgctcctctgcacggccgcggcggcctccgacggctcccagccccaggcgcaggcaccggcggcggcgcggcgggggatggtgccggtggcccccgcggaggcggagctcggcgccatggtggcgctcgctctcaacggcacgcggcgccggctcgggggcagcttccagctctgcgcgccctgcacctgctgcggcggggccagcggcgcctgcatcctcgcgccctgctgctactccatcaactgcaacatccccaaccgccccttcgggtactgctccttcacgcccaaatcctgccagtgcgtcggatgcaacctctgagctccgtggccgcgggattcattggattggattggtcagagtgtgtttgtgtgtgtgtgtatgagtatgagagagagagtggggtggtaacgaatctgtataaaaaattccccacatccttagttaagtggcgattgctattacttctacctaaaaaaaaaaaaaaaa

SEQ ID NO: 8502 - protein, 118 aa, Zea mays
  misc_feature: Ceres CLONE 370548
MHGPVPLLLLLLLLCTAAAASDGSQPQAQAPAAARRGMVPVAPAEAELGAMVALALNGTRRRLGGSFQLCAPCTCCGGASGACILAPCCYSINCNIPNRPFGYCSFTPKSCQCVGCNL

SEQ ID NO: 8503 - DNA, 368 bp, Zea mays
  misc_feature: Ceres CLONE 370596-F
  misc_feature: Encodes the peptide sequence at SEQ ID NO. 8504
cccccctactccaactactggaagcgccgatccatcaggttctgatcgattcttctgccccgatccgcagcggcaagcggagatgaactgcgagacctgtcagctgaaagaactggagctggaactkacggagatcagggatgttctgcgctgtattttgcacaccatattcttccatagaaccctcagcctggttcgccccaaagatgttgactgtgatttcctcggataatttammttatgtacaatgtggtctaccggaactagaaaaggaagttgacgaaaagatagaccagttcartgcattggtggagaaacacccccaaccggcgaagccagatctgcctctcctttttcgacgagaaaca

SEQ ID NO: 8504 - protein, 49 aa, Zea mays
  misc_feature: Ceres CLONE 370596-F
MNCETCQLKELELELTEIRDVLRCILHTIFFHRTLSLVRPKDVDCDFLG

SEQ ID NO: 8505 - DNA, 487 bp, Zea mays
  misc_feature: Ceres CLONE 370605-F
  misc_feature: Encodes the peptide sequence at SEQ ID NO. 8506
tccattctctgtcgccttcgcccctccaaggttctctgattccagacgcaaccctgcggctgcggggtcaaggagccagagggggtgcacagcgatcgttctgccggagatcgaaaccctcagctagggtctgaggcgccgggctgcggccgccgagatgtcgacgccggcgaggaagcggctgatgcgggacttcaggcgcctgcagcaggacccgcccgccgggatcagcggcgcgccgcacgacaacaacatcatgctctggaacgccgtcatattcgggccggatgatacgccttgggacggaggcacgttcaagcttaccttgcagtttacagaagattacccaaacaagccaccaactgttcggttcgtctctaggatgtttcatccaaacatatatgctgatggaagcatctgcttggatatcctacagaaccagtggagtcctatatatgatgttgctgcaatcttgacttctattcag

SEQ ID NO: 8506 - protein, 110 aa, Zea mays
  misc_feature: Ceres CLONE 370605-F
  misc_feature (8)..(110): Pfam Name: UQ_con Pfam Description: Ubiquitin-conjugating enzyme
  misc_feature: SWISSPROT Homolog: EC 6.3.2.19 Ubiquitin--protein ligase
MSTPARKRLMRDFRRLQQDPPAGISGAPHDNNIMLWNAVIFGPDDTPWDGGTFKLTLQFTEDYPNKPPTVRFVSRMFHPNIYADGSICLDILQNQWSPIYDVAAILTSIQ

SEQ ID NO: 8507 - DNA, 487 bp, Zea mays
  misc_feature: Ceres CLONE 370610-F
  misc_feature: Encodes the peptide sequence at SEQ ID NO. 8508
  misc_feature (442)..(442): n is a, c, t, g, unknown, or other
acccggttcaagaactttctatctgaagttcaataattctctcggcaactcagctcccgccagacaatagccaccacctccgacgccgcctcctcgtcctctttcgcctgaaccctagcctcgcatcggccaccgccaccgctcttcgtcggcagctgctgtgcggctgaacggccgcgatggacaggcacggctcggttcggctgcccacccccgaggatgtcttcacggatttccgcgcccgccgtgacggcattctcaaggcactcaccaccgatgtggaggagttctacaagttgtgcgacccagagtacgagaccttgtgcctgtatggactacctaacgaaacctggaaagtgaacgttcgtcctgcgaaagttcctcaacaactaccagagccagcagagggaataaacttcctcgcgattcaatgccaaaggangattggctctcgttcgtagctgcacacagtgatgcatggttggtt

SEQ ID NO: 8508 - protein, 93 aa, Zea mays
  misc_feature: Ceres CLONE 370610-F
  misc_feature: The sequence is a functional homolog of SEQ ID NO 1645 in the 11/479,226 US patent application
  misc_feature: The sequence is a functional homolog of SEQ ID NO 782 in the 10/412,699 US patent application
  misc_feature: The sequence is a functional homolog of SEQ ID NO 816 in the 10/412,699 US patent application
  misc_feature: The sequence is a functional homolog of SEQ ID NO 1052 in the 10/225,066 US patent application
  misc_feature: The sequence is a functional homolog of SEQ ID NO 2552 in the 10/374,780 US patent application
  misc_feature: The sequence is a functional homolog of SEQ ID NO 1981 in the 11/479,226 US patent application
  misc_feature (88)..(88): Xaa is any aa, unknown, or other
MDRHGSVRLPTPEDVFTDFRARRDGILKALTTDVEEFYKLCDPEYETLCLYGLPNETWKVNVRPAKVPQQLPEPAEGINFLAIQCQRXIGSRS

SEQ ID NO: 8509 - DNA, 422 bp, Zea mays
  misc_feature: Ceres CLONE 370624-F
  misc_feature: Encodes the peptide sequence at SEQ ID NO. 8510
attccacatccacagcacttttactgtcctctaaatttatctttgttgactttattaaaaaaagagattatcttcatttgtgcagctttgaatcgcctctcagaaccgagatcctcaaaacccttttccctcctcccttctcccctctcggatcgagtgcttgagctccgaccaaatctcgcagcggctgcaattccgagcccgaagagcggatcaggcgaggacgacgccttcgattctgatctgcggtcggcgcgacccagagagaaccggagatgcagcagggcgacggcacggaggcgcaggtgacgtgggaggaccagcagaacatcaaccgcttcggtcgcctcaacaaccgcctccacgaggctccaggaagagatcaagctcgcaaaggagacgaatgagaaccttgatgatgc

SEQ ID NO: 8510 - protein, 43 aa, Zea mays
  misc_feature: Ceres CLONE 370624-F
MQQGDGTEAQVTWEDQQNINRFGRLNNRLHEAPGRDQARKGDE

SEQ ID NO: 8511 - DNA, 470 bp, Zea mays
  misc_feature: Ceres CLONE 370661-F
  misc_feature: Encodes the peptide sequence at SEQ ID NO. 8512
aaggcaaaacacatcaagctcaacacacatggctgacaatgccggtctagtaggcctgctcttggagcagcaccagctgcgcccaccagcagcagcagcagcatcaagaacaccagctcaaatcacaagcaaggccactcgtcccctcctcgccaccgccaagaacgacgtcgtcgacgtccagaagggcgccagctccgccgccgcttccttcagccgctcttcttcttcttcttcttcccgtgcacaggcgccgacggtgtcgccaacaacgaccgcctgcccgttcctgcagcggtgcttcttctgccacggggagctcgccgacggcagggacatatacatgtacagaggcgagagggcgttctgcagcgaggagtgccgctgccgccatatcctggcagaggaggacgatgacgacactactacctcggtcggggtcgtggaagcggcagcggcagcggactgct

SEQ ID NO: 8512 - protein, 147 aa, Zea mays
  misc_feature: Ceres CLONE 370661-F
  misc_feature (72)..(130): Pfam Name: DUF581 Pfam Description: Protein of unknown function (DUF581)
MADNAGLVGLLLEQHQLRPPAAAAASRTPAQITSKATRPLLATAKNDVVDVQKGASSAAASFSRSSSSSSSRAQAPTVSPTTTACPFLQRCFFCHGELADGRDIYMYRGERAFCSEECRCRHILAEEDDDDTTTSVGVVEAAAAADC

SEQ ID NO: 8513 - DNA, 730 bp, Zea mays
  misc_feature: Ceres CLONE 370665-R
  misc_feature (588)..(588): n is a, c, t, g, unknown, or other
  misc_feature (594)..(594): n is a, c, t, g, unknown, or other
  misc_feature (607)..(607): n is a, c, t, g, unknown, or other
  misc_feature (614)..(614): n is a, c, t, g, unknown, or other
  misc_feature (618)..(618): n is a, c, t, g, unknown, or other
  misc_feature (619)..(619): n is a, c, t, g, unknown, or other
  misc_feature (621)..(621): n is a, c, t, g, unknown, or other
  misc_feature (625)..(625): n is a, c, t, g, unknown, or other
  misc_feature (627)..(627): n is a, c, t, g, unknown, or other
  misc_feature (628)..(628): n is a, c, t, g, unknown, or other
  misc_feature (630)..(630): n is a, c, t, g, unknown, or other
  misc_feature (631)..(631): n is a, c, t, g, unknown, or other
  misc_feature (635)..(635): n is a, c, t, g, unknown, or other
  misc_feature (646)..(646): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (661)..(661): n is a, c, t, g, unknown, or other
  misc_feature (664)..(664): n is a, c, t, g, unknown, or other
  misc_feature (684)..(684): n is a, c, t, g, unknown, or other
  misc_feature (699)..(699): n is a, c, t, g, unknown, or other
  misc_feature (705)..(705): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
ccgattgggtaccgggccccccctcgaggtcgacggtatcgatattttttttttttttttttcgtattaactgctcactatgtaaaccggtaagcccactgttccaacacttctctatctacagctacagccacaaagctgataacactacgcaacaaagcaaatgtcatcaaagcgcttgagtacacaaattttattgcccttccggctcatttgattgtaaacttccatcggagctatgtttaccagactcgataaccagttgtctatcttggttctcaaacttggagccctgaagattttcagatggcttgcctgacaattccatttgtctctcattacgctgcatactccttggatccggagggagtctggtaacatcgtttgaagcctctagccttgcctgcaaagcttcatgctcagcctttacaccgggatggggacgcatccctttgaataaacaattttggtttgggggggccccccggctcacttttcttgggcgccccaccaaaaaggagggggtttggcggggaaaaaccccccccccaaaccttgttttggctgggggaaaacacacaaaccttncgcggngaagagtagaaanaaaaacntcanncncacntnncnncccnccactcccganaaaannnatccgacncanacataaaactagagggggtnggggtgaggtgggcnaaaganannngannngagcactgtctgcccc

SEQ ID NO: 8514 - DNA, 443 bp, Zea mays
  misc_feature: Ceres CLONE 370676-F
  misc_feature: Encodes the peptide sequence at SEQ ID NO. 8515
  misc_feature (154)..(154): n is a, c, t, g, unknown, or other
ggaaacctaggctttctactctctcagccgaaaactctggccggcggcttccttctgtctcagccgcctgggagctgtggcactgccgaccgcacctccctcttccttttttttctgccgctcactttcgttcgtccgccagwagcaccagcgnctggctctggccgactgcgccctgcacagagccacacagccgcccactctctatttgctttctgttttttttattcgtttctacttgccgcatggacatttctgtatgcacttggctgcatggccatctctgtcatgattttytccctttttttttattcgatccccacttcacgagatgtatgcttgtaagaaatgaataatatgcaatgggaatcgagattttgagggttttccctaaccctaagattttaggtctggccactgtaaaaagacacagtgtgtctcgg

SEQ ID NO: 8515 - protein, 114 aa, Zea mays
  misc_feature: Ceres CLONE 370676-F
  misc_feature (48)..(48): Xaa is any aa, unknown, or other
  misc_feature (52)..(52): Xaa is any aa, unknown, or other
GNLGFLLSQPKTLAGGFLLSQPPGSCGTADRTSLFLFFLPLTFVRPPXAPAXGSGRLRPAQSHTAAHSLFAFCFFYSFLLAAWTFLYALGCMAISVMIFSLFFYSIPTSRDVCL

SEQ ID NO: 8516 - DNA, 685 bp, Zea mays
  misc_feature: Ceres CLONE 370677
  misc_feature: Encodes the peptide sequence at SEQ ID NO. 8517
gccaaccgcgaagcactacactacactacaccacacccacccgacgacgatcacacacgcagaagatcgagttcgttcgatcgtgaccgtgacgcaggaagctataagctagccaagacaggaataataatggcggcgtcgacggtggcgagcctctctgtcccggtgacgacgacgaccttcgcggcggcgggcggcggcgacgtgctgatcgtcgtcccgaggagggcgggcgccaagcgcgtcgtctggttccccgcggcggcgcgccgcggcggcgggcggttggtcgccgtgcggtccagcgggccggccacgccgccggagatctccgacaaggtgtcggagagcatcaagcaggcggaggagacgtgcgcggacgaccagaagggcgacgccgagtgcgcggcggcgtgggacgaggtggaggagctcagcgccacggccagccacgcccgcgacagcctcaaggagaccaacgccaacgacccgctcgagaagtactgcaaggacaacccggactccgaggagtgccgcatctacgacaactagctagtcgtatagctatataggccatcgacatgaaggacgaaggttgtagcacactacgaaagaatgatactctcgatcggcgcgtcatacgtggaatgaacttgtttgtatcaagctcaaaaaaaaaaaaaaa

SEQ ID NO: 8517 - protein, 140 aa, Zea mays
  misc_feature: Ceres CLONE 370677
  misc_feature (67)..(140): Pfam Name: CP12 Pfam Description: CP12 domain
  misc_feature: SWISSPROT Homolog: EC 1.2.1.13 Glyceraldehyde-3-phosphate dehydrogenase (NADP(+)) (phosphorylating)
MAASTVASLSVPVTTTTFAAAGGGDVLIVVPRRAGAKRVVWFPAAARRGGGRLVAVRSSGPATPPEISDKVSESIKQAEETCADDQKGDAECAAAWDEVEELSATASHARDSLKETNANDPLEKYCKDNPDSEECRIYDN

SEQ ID NO: 8518 - DNA, 465 bp, Zea mays
  misc_feature: Ceres CLONE 370678-F
  misc_feature: Encodes the peptide sequence at SEQ ID NO. 8519
atttcctccgcctgcagtctagctgcagctaataaccccggccgccggatgttctccttctcgcatgcttttttttttgggggtaacataatctcgctgatggtgttcctttcgccgctgccgacgttctaccgcgtgtaccgcaagaagtcgacggaggggttccagtcgaccccgtacgtggtgacgctgttcagctgcatgctgtggatcttctacgcgctgctcaagtccggcgccgagctgctggtgaccatcaacggcgtcgggtgcgtgatcgaggcggcgtacctggcgacgtacctggtgtacgcgcccaaggccgccagggcgctgacggccaagatgctgctggggctcaacgtcggcgtcttcggcctcgccgcgctcgccaccatggtggtctccagcgccggcctccgcgtgcgcgtgctcggatggatctgcgtcagcgtcgcgctcagc

SEQ ID NO: 8519 - protein, 139 aa, Zea mays
  misc_feature: Ceres CLONE 370678-F
  misc_feature (8)..(93): Pfam Name: MtN3_slv Pfam Description: MtN3/saliva family
MFSFSHAFFFGGNIISLMVFLSPLPTFYRVYRKKSTEGFQSTPYVVTLFSCMLWIFYALLKSGAELLVTINGVGCVIEAAYLATYLVYAPKAARALTAKMLLGLNVGVFGLAALATMVVSSAGLRVRVLGWICVSVALS

SEQ ID NO: 8520 - DNA, 403 bp, Zea mays
  misc_feature: Ceres CLONE 370679-F
  misc_feature: Encodes the peptide sequence at SEQ ID NO. 8521
  misc_feature (309)..(309): n is a, c, t, g, unknown, or other
cagagaagacccgcctctcccgtgagccgtgacgcgacgccggatcgtcctcgtctcctagctcgtggaatgaagggaggtggcgtcatcagggmcgccggcggaggtgccgsttgcgggtctgttgcgaacgcgactgcggcttcccgtggtgctcctctcctgctccctcttcttcctcgccggcttcttcggctcgctcctcttcacccaggatccggagaggcggatatgccggtgccgagagagcggctgttggaggcggcgtggcggagatgccttacggcgagtccggcgaggctgcgcgtnccttgatcccataccagattttgagctggcagcctcgtgctttgtactttccacaatttgcgacatcagaacagtgtgaaaatatagtaaaaac

SEQ ID NO: 8521 - protein, 42 aa, Zea mays
  misc_feature: Ceres CLONE 370679-F
  misc_feature (12)..(12): Xaa is any aa, unknown, or other
MPYGESGEAARXLIPYQILSWQPRALYFPQFATSEQCENIVK

SEQ ID NO: 8522 - DNA, 444 bp, Zea mays
  misc_feature: Ceres CLONE 370682-F
aaaaaaaatcccccttccctctcttccgcctccgattgagtggctcaccttctttcccagccagcacgagcttgcaagcaagcgagctcctgagatttcagctcgcttctcctccagaggtcgagcagaccagactcctccgaccgaagctctaccacttcccagttagcctgtccaggaactgcttggccggagatccaaacaaacctctgtgttggggttctccggggttccttgcgctggagggaggtttcgttctcgctggccatggtttggctgagaagcagcagcggcagcatcttgatgccaaatctctgagctttatgaagatcgccactcacctgcgccgctcctgcttcctccactccttctcggttgtcttcctctactggttttatgtgatctcataacttgccctcccccggatccgccattcccccgtgc

SEQ ID NO: 8523 - DNA, 408 bp, Zea mays
  misc_feature: Ceres CLONE 370684-F
  misc_feature: Encodes the peptide sequence at SEQ ID NO. 8524
  misc_feature (45)..(45): n is a, c, t, g, unknown, or other
ttcccagcccaaaccccgacgcgtccccacctccgtcgccgatgnhaccgcgtgccccgcagcttcggcatcacccgccgcacctcctcctcgccgaggctgtcgcctcctggcaccccttccacaagaagccctgtctcacggaccgctccacggctcccccctcctcggcccgcctccctgatgcggagactccgacgcctgccctctcggggggcggtassggcggatccttccggtggttcgggctccgcaagctggcgccgccgttcccgggctcgcggtccgtgtccggccgcagcagcgaccgccggagatccggcacgtgctccgacttccatttcacgtgcggcgccggtggtggtggcggcggcggcgcacttgactccagcggggagatgtgggcgt

SEQ ID NO: 8524 - protein, 122 aa, Zea mays
  misc_feature: Ceres CLONE 370684-F
  misc_feature (2)..(2): Xaa is any aa, unknown, or other
  misc_feature (61)..(61): Xaa is any aa, unknown, or other
MXPRAPQLRHHPPHLLLAEAVASWHPFHKKPCLTDRSTAPPSSARLPDAETPTPALSGGGXGGSFRWFGLRKLAPPFPGSRSVSGRSSDRRRSGTCSDFHFTCGAGGGGGGGALDSSGEMWA

SEQ ID NO: 8525 - DNA, 460 bp, Zea mays
  misc_feature: Ceres CLONE 370701-F
  misc_feature: Encodes the peptide sequence at SEQ ID NO. 8526
aattttctccagccgccgcgctcctgatccttatctctgcgcgcgctgcatcggcgcccgccgggaggcggatcccgcccgcctcgtccatgccgtgggtccgcaatctccgccgcttcgtcgacacgggcgccggcctcggatccgaggccctcatggaactggagactaaaaggatattgcttgagattttcaaggagcggtagcggaagagtgccgaggctggttccatcccaagtttttacaagaagaaacctgaagaaggatccattagctctagagttcaaaggttggccaagtacaggtttctaaagaaacaatcagagcttctgctgaatgctgatgatcttgatgccatgtgggtttgtctaagagaaaattgtgttattgatgatgctactggtgctgaaaagatgaattatgaagatttctgccatatcgccacagtctgcacggagca

SEQ ID NO: 8526 - protein, 67 aa, Zea mays
  misc_feature: Ceres CLONE 370701-F
FSPAAALLILISARAASAPAGRRIPPASSMPWVRNLRRFVDTGAGLGSEALMELETKRILLEIFKER

SEQ ID NO: 8527 - DNA, 469 bp, Zea mays
  misc_feature: Ceres CLONE 370703-F
  misc_feature: Encodes the peptide sequence at SEQ ID NO. 8528
ataatagcaaaaaactccgctccagcgcttcgacgacgagaaagacagcgacgccgccgccgctccctccgcccggtacgtgcgcacgctacacgagctgcgccagttcaagactgccgggaaccccttcacggatgagttcttcgataccttcgacgccgtttaccagcagcagctggacatgctgaagaagctgcagcagcgccagcaccggctcgacaagaaggtcaagaccatccaggcgtggcgccgggtgtcaagcatcatcttcgcgaccacgttcgcggccgtgctcatctgctcgattgttgccgcggtcatcgctgccccgcctgtcgctgcggcattggccgcggctgctgcagtcccgctgggatccatggggaagtggtttgattcgttgctgaaagggtgtcaggacgcggtcaacagacaggagggggtggtgagcgaaatgcagtttggcaca

SEQ ID NO: 8528 - protein, 96 aa, Zea mays
  misc_feature: Ceres CLONE 370703-F
MLKKLQQRQHRLDKKVKTIQAWRRVSSIIFATTFAAVLICSIVAAVIAAPPVAAALAAAAAVPLGSMGKWFDSLLKGCQDAVNRQEGVVSEMQFGT

SEQ ID NO: 8529 - DNA, 811 bp, Zea mays
  misc_feature: Ceres CLONE 370725
  misc_feature: Encodes the peptide sequence at SEQ ID NO. 8530
agatcacacacaccaccaaaggccaaagcgggacgggagacacagagatagcaagcaaggcagtatcgcagcaaagcaagaaaccacagatggcggcggccacccaggcggcgacggtgctactgctcgcggtgctggtgctggcggcgggaccgggcggggcgcgggcgcagtcggcgtcgccgtcgagccagtgcacgtcggcgctggtgagcctgtcgccgtgcctcagctacatctccgggaacgtgtcggcggcgccgccgtcgtgctgcgcgcagctgggcaaggtggtgcagtcggacccgcagtgcctgtgcgtggcgctcagcgcggacccggcgtcgctgggcctcaccgtcaaccgcacccgcgcgctgggcctccccgacgcgtgcaaggtcacgacgcccgacgtcagcaactgcaagggcgccgccgccgccgccgcggggggagcgcctgtggcgacgcccgcggggcagacggcgccggccacggggtccaagacgacgcccgccacgtcgtccgtgcccggtgccgccgcgtcgccgcgtggctcggctggccgtctcgtcgtcgccggcttcgtcgccgcggccgtcgtcgctggcttcgccgcgtgatccggcgctagcttcggtaggaatcgcagcggattttgtgttgtttgtttcatcggtggcggtggtggtggtggtgcatttgtgattcgttcagtgaccgagagagagagccgtctcttattcatcgatcgactcgattcgtcacagcattcgcgcgtcgcgctgaatgaaaaaaaaaaaaaaaa

SEQ ID NO: 8530 - protein, 178 aa, Zea mays
  misc_feature: Ceres CLONE 370725
  misc_feature (36)..(113): Pfam Name: Tryp_alpha_amyl Pfam Description: Protease inhibitor/seed storage/LTP family
MAAATQAATVLLLAVLVLAAGPGGARAQSASPSSQCTSALVSLSPCLSYISGNVSAAPPSCCAQLGKVVQSDPQCLCVALSADPASLGLTVNRTRALGLPDACKVTTPDVSNCKGAAAAAAGGAPVATPAGQTAPATGSKTTPATSSVPGAAASPRGSAGRLVVAGFVAAAVVAGFAA

SEQ ID NO: 8531 - DNA, 465 bp, Zea mays
  misc_feature: Ceres CLONE 370749-F
  misc_feature: Encodes the peptide sequence at SEQ ID NO. 8532
attcagttcgtcacggacttgcagatctgaggatttgggccgtaagggtactagagccggcgccggcggttacctggggcggccgccccacctcgctgttacggtaggtgcgtccctaacctcgaagcttcgacgcaagaggcggtgaatccaatggcgggcgaggaagagctcactgtaggcggcggcgtgcccatccggccgccgcggctggaagacgcggggctcgaggactgcgcgctcccgccggagtctatcgctgaggcattctccctcgctgccgcggccgtctcctcccgcctcgcccggctgcccttctccgaagactccgacgaggaggactgcgtctcggcaccacgcggaggaggctgcgtggatgacgccggactcgactgcggggccgcccccgtcgccctcgtcggcggcggcgttgcgggcgtcggcagcgtcgacgaagtcgtggtc

SEQ ID NO: 8532 - protein, 104 aa, Zea mays
  misc_feature: Ceres CLONE 370749-F
MAGEEELTVGGGVPIRPPRLEDAGLEDCALPPESIAEAFSLAAAAVSSRLARLPFSEDSDEEDCVSAPRGGGCVDDAGLDCGAAPVALVGGGVAGVGSVDEVVV

SEQ ID NO: 8533 - DNA, 201 bp, Zea mays
  misc_feature: Ceres CLONE 370754-F
acagtgataatacatgcatgtcgcgcgcaacssagccacccagcaagcgcacgagcgtgcgcccgtcgcggcggtggcagcggcaggcccggcccacgcgcagggggaggagacgtcgctctgggggtccggggcgccgtgcgcgttgcwagttcctgcggcggcgatgcgtgccggggtgtgtcttcgcgccgcactttg

SEQ ID NO: 8534 - DNA, 416 bp, Zea mays
  misc_feature: Ceres CLONE 370771-F
  misc_feature: Encodes the peptide sequence at SEQ ID NO. 8535
atcccatatcgccaagtccccttcgtcgtccccttccctcgcctcgcgttaggtagcctgcttccgacccgcacatctccctccggttctcgccatgggcgccggcgccaacaaccacgaggagtcgagccccctcatcccagctgcggttgccgcccccgcggacgagaagcccccgcaggctccggcgccggaggccgccaattactatgccgacggggtcccggtcgtgatgggcgagcccgtgtcggcccacgccttcggcggcgtcccgcgggagagctggaactccgggatcctctcctgcctcggccgcaacgacgagttctgcagcagcgacgtcgaagtgtgtcttcttggaacggtagcaccatgtgtgctctatggtagcaatgttgagaggcttgctgctggac

SEQ ID NO: 8535 - protein, 107 aa, Zea mays
  misc_feature: Ceres CLONE 370771-F
MGAGANNHEESSPLIPAAVAAPADEKPPQAPAPEAANYYADGVPVVMGEPVSAHAFGGVPRESWNSGILSCLGRNDEFCSSDVEVCLLGTVAPCVLYGSNVERLAAG

SEQ ID NO: 8536 - DNA, 476 bp, Zea mays
  misc_feature: Ceres CLONE 370845-F
  misc_feature: Encodes the peptide sequence at SEQ ID NO. 8537
gtcgccaacaggaacagcctcggtctgtcctccaactccaacgaggcaacgactcgtcagtggtcagtacactacaccgtaaccgtcgccggaatcgatcgacccaaagctccccttagagcccgagctctatccaacccacgaacgggatcccgatgcccatggcggcctcggttcttgtcgccgcaccggcggtctcgcccccgctgacgtggcggagatgggctcctcttctcgccgcgtcacatccacgggcgaacccgcctcccgcactgcgcctgcgggcgcccgctcctcctctccgggcctcctccgttccccgcgattcctgcgccggagccgccgtccggaggacgccgtgtgcggcggcggcggcattaggtggaggtgtgaaggcggagtccacggagcgggaggcgcccgatcgggatgctctgaagcgggtggcgctgctcgcgcttggctgctgcgctgca

SEQ ID NO: 8537 - protein, 107 aa, Zea mays
  misc_feature: Ceres CLONE 370845-F
MPMAASVLVAAPAVSPPLTWRRWAPLLAASHPRANPPPALRLRAPAPPLRASSVPRDSCAGAAVRRTPCAAAAALGGGVKAESTEREAPDRDALKRVALLALGCCAA

SEQ ID NO: 8538 - DNA, 332 bp, Zea mays
  misc_feature: Ceres CLONE 370863-F
  misc_feature: Encodes the peptide sequence at SEQ ID NO. 8539
atgaaaatcacaaattgagagagagggagaagggggtgggggttacgtaacacggcgattcaggaggggatagcatcgtcatcgcaaaatgcaggctctcctgctccccgcgcgggccgccgccgacgccggcatgcttcggcagcgtgcggtttctgcctccgcgtgtgcgtcgcaggtctgccgccccctattcggtgccgccaattgcatctcctgtggggtctacggaagcgttcggcggcacctcacagtggcggtggcggcggcccgccttcgaccttcgtcctcaccttcgtcgggaccggctctacccgacgcctccacccacc

SEQ ID NO: 8539 - protein, 81 aa, Zea mays
  misc_feature: Ceres CLONE 370863-F
MQALLLPARAAADAGMLRQRAVSASACASQVCRPLFGAANCISCGVYGSVRRHLTVAVAAARLRPSSSPSSGPALPDASTH

SEQ ID NO: 8540 - DNA, 464 bp, Zea mays
  misc_feature: Ceres CLONE 370879-F
  misc_feature: Encodes the peptide sequence at SEQ ID NO. 8541
gcgcgccaaaaggcgaaaagggggcgacctggctgtaagcctgtaaccaatcgcctccccaccccattcttatctcctctccaccgcttgctatccgtcgcctcgccgcgcgcgcgtacgttcggttctcggccactgctcagctctcgctgcagcgatggccctgcaggccccgtcactcatgcgcgcgccggcggcacagcggtccgcgccgccacggccctccttctccgccccgtggtcgctccggctgccggcgccggcgcggcgccgggtggccacggccgcgcggatcaccatgcgggtcgcgtccaagcaggcctacatctgccgtgactgcgggtacatctacaacgacaggacgccgttcgacaagctggctgacaactacttctgccctgtttgtggagctccgaagagaaggttcagaccctacgagccggcagtctccaagaacgcgaacg

SEQ ID NO: 8541 - protein, 102 aa, Zea mays
  misc_feature: Ceres CLONE 370879-F
  misc_feature (55)..(90): Pfam Name: Rubredoxin Pfam Description: Rubredoxin
MALQAPSLMRAPAAQRSAPPRPSFSAPWSLRLPAPARRRVATAARITMRVASKQAYICRDCGYIYNDRTPFDKLADNYFCPVCGAPKRRFRPYEPAVSKNAN

SEQ ID NO: 8542 - DNA, 620 bp, Zea mays
  misc_feature: Ceres CLONE 370885-R
  misc_feature (19)..(19): n is a, c, t, g, unknown, or other
aaaaaaagaaaaaaaaaanaaaaaaaaagaagagaaggaggaaaaaaagggaaaaaaacccatcatcttagagtctcatttgtctacagtatgcgttcaggagggtttcaaatgtaagaaccacatgtcgctggagcaaatcagtttacagagtgataaaaccaagacatgtcgctagagcaaatcagtttacagagtgataaaaccaagacaagcttcaggctggctgctcataagtgatgctgctattcttgtttgaaacagtaaatcatcaacagacaacttactccacctctgcctgcgtctgtgtctgctgctgctgctgccgcaccggcgtggcggcggccgccggatccagcggcgtcatcccgctgcccgcgccgggacgcgaacctcgaagaaaccttggccgcgacaacacacaacccaattcatgcacaaagagaacagactccgaatccgggaacggaggaacactgcggaagggggcctgggagagcggggggcgggagggcggggggggggagggcagggggggggagaggggggggaggaggggggggggggggggggggggggagggggagggggggggagggggcgggaggaggaggcggaac

SEQ ID NO: 8543 - DNA, 450 bp, Zea mays
  misc_feature: Ceres CLONE 370890-F
  misc_feature: Encodes the peptide sequence at SEQ ID NO. 8544
tatcttcaccattggtgccaagttcataaatatcagatctggtgataaaccatgaccggaaaawagaccacggtctcctctgtcggccgcactcgaaagaaggtcaaggtggtgttggaggatgaggaagaggcagggttggaagatgaggaagaggtgactgtgacattatccgaggagaaggacgcgctggagtgcgacatctgctgcctacccttccagtccgaagttttcgtgtgcaagaacgggcattctggatgtgcaaaatgctgcatccgcacggacggtaagtgctggacctgttccgagcgcattgacgacatgcgttaccgtccgctcgagaagctcctggcggcggcgaccacctcctgcatgttcaagagcaacggctgctacgacgccatcagctacctggagaaggtgacccacgaggagacatgccagcgcgcg

SEQ ID NO: 8544 - protein, 133 aa, Zea mays
  misc_feature: Ceres CLONE 370890-F
  misc_feature (5)..(5): Xaa is any aa, unknown, or other
MTGKXTTVSSVGRTRKKVKVVLEDEEEAGLEDEEEVTVTLSEEKDALECDICCLPFQSEVFVCKNGHSGCAKCCIRTDGKCWTCSERIDDMRYRPLEKLLAAATTSCMFKSNGCYDAISYLEKVTHEETCQRA

SEQ ID NO: 8545 - DNA, 430 bp, Zea mays
  misc_feature: Ceres CLONE 370895-F
  misc_feature (67)..(67): n is a, c, t, g, unknown, or other
atccgtgcatacatgctcattgctcaccaagggcaagggaggaggagaggacacacagcagtagcgncgaaatgkcggcgatgatgatggatagtaccgcggagaaagacctcgccggcgacgcttggcggtgagcgggcacgggcaggacttggagcggtcttgccatgaccaggagcccgccgctgcagatggtgcgagcagcagaggcctagccatcgggcgtttcgtacgggagctgatggtggagggcgtggcgtckttcctgctggtgttctggtccgcggtggcgcgctgatgcagggagatgcacggcacgctgackttccccatgggtgtgcctcgtcgtcggcgctcaccgtcgtcttcgtgctctgctggctcggccccgcgcacttcaaccccgccgtcaccgtcactttcaccgtat

SEQ ID NO: 8546 - DNA, 485 bp, Zea mays
  misc_feature: Ceres CLONE 370903-F
  misc_feature: Encodes the peptide sequence at SEQ ID NO. 8547
aacaaccaccagcgcacaagcacaacgacagcgaccaagaacaagaagccgtgaccgtgagaggtccgagtgccagccgcgtttcctatacacgggcagagggcggtgaccgaggaacagaggaggcggaggaagaggagaattagaaggatgtacttccgtccgccgccgaagggcccggagtggtacgccggcgatgcggagacggggcaggcagcgcggccgctgtacccgatgatgctggaggacccgcgcctgcgctgggccttcatccggaaggtctacagcatcctctccatccagatgctgctcaccgtcgccgtcgccgccgtcgtcgtgtacgtccgccccgtcgcgctcttcttcgtctccacggccgcgggcttcgggctctacatcttcctcatcatcctcccgttcatagtgctgtgccccctgtactactactaccagcgccacccggtgaacctgctgctgctcggcct

SEQ ID NO: 8547 - protein, 111 aa, Zea mays
  misc_feature: Ceres CLONE 370903-F
MYFRPPPKGPEWYAGDAETGQAARPLYPMMLEDPRLRWAFIRKVYSILSIQMLLTVAVAAVVVYVRPVALFFVSTAAGFGLYIFLIILPFIVLCPLYYYYQRHPVNLLLLG

SEQ ID NO: 8548 - DNA, 473 bp, Zea mays
  misc_feature: Ceres CLONE 370953-F
  misc_feature: Encodes the peptide sequence at SEQ ID NO. 8549
  misc_feature (68)..(68): n is a, c, t, g, unknown, or other
  misc_feature (69)..(69): n is a, c, t, g, unknown, or other
ctccctcgacctctctttcttgttgcacgcctgcctgggcgaaccgtcgccgctatacaccaggcgcnnagggcttcgcggcgccgagtagccaccagctgccgctcaacattcacctctgccaagggcatggaccacatgacgatgctcggcgccggagccccccaccagctctccagggctgaaccaatgcctgaccgtabhagggttctggcagacggatgtgcagcctgtgcctcggatagacatcatctgtcctctgccttgtcgcccttcccgctcactgctcctcaataggcccagccccaagcctaatggggcactcccattgtatggagcaaaccctacttatgatatcgttgatctcatccttagcaagaatgaccctgatgtggatactgattcaagcagccaggcggcctttttctgtggctcgcctcctgcccgcactaacaaccctgttatccatgacc

SEQ ID NO: 8549 - protein, 55 aa, Zea mays
  misc_feature: Ceres CLONE 370953-F
  misc_feature (25)..(25): Xaa is any aa, unknown, or other
MDHMTMLGAGAPHQLSRAEPMPDRXRVLADGCAACASDRHHLSSALSPFPLTAPQ

SEQ ID NO: 8550 - DNA, 211 bp, Zea mays
  misc_feature: Ceres CLONE 370967-F
actcaacccaaacaccacaatccccttcaacaaacgcaccgcactccacggcagccagaaaacacaatccacagagtctccgtgaggtctgagcgaggtaggactagctctgagcgagttcttccgttttccaggtataatcctagcaactctcactatcctcttcgcatcgctcgtctctttttgagaccagttggatttctcttatttt

SEQ ID NO: 8551 - DNA, 479 bp, Zea mays
  misc_feature: Ceres CLONE 370987-F
  misc_feature: Encodes the peptide sequence at SEQ ID NO. 8552
acctctgcctttcccttttctcctcctatccctaacgcagtcgccgccgctcggctctcccttgccaatgcactcgccgccgccgctcaaatctcccctcccaatggcaccccgtcgctcacgatcaaatatttcctcccctataagtgcaagatcgctattggtggacccacctgacatcaagagggagatgcagatggagatgcaccatctgctgcggcgtaggcatcgcagacggcgtggccgccggattggccggtggacgggcgctcgctcaatcctccatcgccgcccctatatcagtctagtattagagcgctaggtatgctcgctatgcctacgatgatttatatgaggatgacttagataaggaggtggatcacatgtcagtttccagcaaggtgtttggactggaatgcgcacagtctgttactttgatggcaaaacgcaacgaagtaccatgggtaaggatgtgctgg

SEQ ID NO: 8552 - protein, 72 aa, Zea mays
  misc_feature: Ceres CLONE 370987-F
MAPRRSRSNISSPISARSLLVDPPDIKREMQMEMHHLLRRRHRRRRGRRIGRWTGARSILHRRPYISLVLER

SEQ ID NO: 8553 - DNA, 397 bp, Zea mays
  misc_feature: Ceres CLONE 371011-F
  misc_feature: Encodes the peptide sequence at SEQ ID NO. 8554
aaagyttatcttcgtcacatgggatggccgtttgcttgtttgttgcttccgggaggcggtggtgaattgaagcagatcgacaagcatggctgcccactggtctcgatcgatcggcctgccatgccatgccactagagtccgtcctgactggccgcccgttcccccgtataaaaaggcaggcaggcaggcagagcggggacgagcaagcaagcagttgcagttgcagcggcctcctcctctgcttcctccctcctcctcctcaccatggtgctggctgcgcacgatccccctccccttgtgttcgacgctgcccgcctgagcggcctctccgacatcccgcagcagttcatctggccggcggacgagagccccaccccggactccgccgaggagctgg

SEQ ID NO: 8554 - protein, 44 aa, Zea mays
  misc_feature: Ceres CLONE 371011-F
MVLAAHDPPPLVFDAARLSGLSDIPQQFIWPADESPTPDSAEEL

SEQ ID NO: 8555 - DNA, 359 bp, Zea mays
  misc_feature: Ceres CLONE 371022-F
acacttgaggatgaagacctagatgatgatcatgatgatggaccagaggcatcgttgtaagcttgttgatgaagacctagatgatgataatgcaacatgaatgctctgaatgttttcattgtacttgttgcgtaatgctttgtgatcttgcgaacttgggacttgtggacttgtggttgtgtactttgtgatctgtgtgatgaacttgttatattgtgaacttgtgatctgtgtgatccacttattatattgtgaacttgtgatcaacttgttatattgtgaacttgtgatctgtgtgatccacttattatattgtgaacttgtgatcaacttgttatattgtgaacttgtgagaaaaa

SEQ ID NO: 8556 - DNA, 506 bp, Zea mays
  misc_feature: Ceres CLONE 371051-F
  misc_feature: Translation starting site: 95
  misc_feature: SWISSPROT Homolog: EC 6.3.5.5 Carbamoyl-phosphate synthase (glutamine-hydrolyzing)
atcctctccgccacctcgcacccacgcaagcgagtcagccaagccacgcccgacccccgcctccattcccggggcggagacgcgcctgcctgccatgggaatggggccgctcgacaacgccgcgtcggccgcgctggaggccgccgccgccccctcgcgggcgggctcgtacgcggtgctgcagtgcggcgaggactcggagtacgtgcggcagaagtacggcggctacttcgccgtcttccgcgcgctgctggaggaggacggcgagaggtggcgggtgtacagcgccgtccgcggggagctccccgccgacgccgaggcagccgggttcgacgggttcgtcatctccgggagctgcgccgacgcgcacggcgacgagccctggatcctcgcgctcgtcgacctcacccgccgcgtccacgccgccggcaagcgcgtccctcggcgtctgcttcggccaccagatcctgtgccgggcgctgggcgggcgcacggggcggtcggcc

SEQ ID NO: 8557 - DNA, 224 bp, Zea mays
  misc_feature: Ceres CLONE 371064-F
gacacgaaccaggcaaccagctgccgagggaggaaccctagcggaacaggtgacggcggcgcgctaccggtgacggggatacggctgcatcgtccccctcggcccctcctccatccccggcgcggcggassagcagccggcctgcagctttataatggatcccaacatgaagcagcttcaagaggctctggttgatattgagaccgatgcagaaaaagttcttc

SEQ ID NO: 8558 - DNA, 495 bp, Zea mays
  misc_feature: Ceres CLONE 371079-F
  misc_feature: Encodes the peptide sequence at SEQ ID NO. 8559
  misc_feature (255)..(255): n is a, c, t, g, unknown, or other
  misc_feature (421)..(421): n is a, c, t, g, unknown, or other
aagaactccgtcgaatcctccccctcctccacgcagacgcagctcgctctcctctcagcccccacccatcgagccgctagcgccasssccggcggcgtatggaggctggtggcgaggagttcgcgatcggcgtggtgctctccgccaagaccaccctgggggaaggagttcgagggccagatcgtcgccttcgatcgaccctccaacctcctcgttatccaggagggtgtggggagggcggagagcggggagcgncggaacgtgagggtgctgaaggcgaactacatccgggagttctctgtgctcagcaagggagacgaccctctcgatcctgccggttgcatgctggaccttaactccatttatgcccgggaggatgctgcactcaggcaagcagagattgaagctgagaaaattcgtnttggtgtcacccagaagctcaaaatatattcgatgcgctgtccaagacgcttccggtgcaagtggggacaagac

SEQ ID NO: 8559 - protein, 165 aa, Zea mays
  misc_feature: Ceres CLONE 371079-F
  misc_feature (29)..(29): Xaa is any aa, unknown, or other
  misc_feature (30)..(30): Xaa is any aa, unknown, or other
  misc_feature (141)..(141): Xaa is any aa, unknown, or other
KNSVESSPSSTQTQLALLSAPTHRAASAXXGGVWRLVARSSRSAWCSPPRPPWGKEFEGQIVAFDRPSNLLVIQEGVGRAESGERRNVRVLKANYIREFSVLSKGDDPLDPAGCMLDLNSIYAREDAALRQAEIEAEKIRXGVTQKLKIYSMRCPRRFRCKWGQD

SEQ ID NO: 8560 - DNA, 204 bp, Zea mays
  misc_feature: Ceres CLONE 371095-F
  misc_feature: Encodes the peptide sequence at SEQ ID NO. 8561
  misc_feature (184)..(184): n is a, c, t, g, unknown, or other
agacgcagacggccccgaacgccggcggcaagcatcaggtcgtcgactccgagcatcgacccgccgcgatggagaagggaaagggcctcgctcgccgctgggcgttggagctccccgacccctcctcctcctcccccgccgtccccgacccgcccggcttcaccagatccgcgcctgacsssancgacgccgctggagcgcgcc

SEQ ID NO: 8561 - protein, 45 aa, Zea mays
  misc_feature: Ceres CLONE 371095-F
  misc_feature (38)..(38): Xaa is any aa, unknown, or other
  misc_feature (39)..(39): Xaa is any aa, unknown, or other
MEKGKGLARRWALELPDPSSSSPAVPDPPGFTRSAPDXXDAAGAR

SEQ ID NO: 8562 - DNA, 435 bp, Zea mays
  misc_feature: Ceres CLONE 371130-F
gagaccaggattgttccaacttcatatagaccatagttagtgacagcattaaagtttgagatgttgaatgctaaaaaacaattagtcacaatattgtttagataaaaatttgagatgtcggaggaagctgctgaaaaaggttaactttatctatgggactaagcttcaattcggcatccgcccattcttcagtcttaatgtcgttgccgccgagtacaacagtgactcaccagtgcatgcacaccaaggatgtcgtcaccaccaataccatcaacgactacaacggtgaagagtttgtmttctactctccatgggagtacggtgccaaaacaaactcaataatagactaccacaccaaccaaaatgactcattgttgccaccagagagaatgtatagccctattwatgtmtggcacttagggaatcgatagcttt

SEQ ID NO: 8563 - DNA, 117 bp, Zea mays
  misc_feature: Ceres CLONE 371138-F
  misc_feature (72)..(72): n is a, c, t, g, unknown, or other
  misc_feature (104)..(104): n is a, c, t, g, unknown, or other
  misc_feature (108)..(108): n is a, c, t, g, unknown, or other
aattccagaccatggcgacgaccaaggaccccgcgaccaccggcggcgagcccgcbatacggcattcccctnaccacccggcggcggaattcccaggggcactnactnactaacgcg

SEQ ID NO: 8564 - DNA, 384 bp, Zea mays
  misc_feature: Ceres CLONE 371149-F
  misc_feature: Encodes the peptide sequence at SEQ ID NO. 8565
gccctttttcttccgttgctccatggccatggcatcccgaccgcctcttcgtcgtcgacgtcgtcttcccctcgtcccactcctcgttctgctctgcctctctccgggatgcgccgccggtagagtcccggttttggtctactacgaagcgctgtgcccgttctgctccgcgtttgtcgtgaacgacctctccagggtcttccgcgacgggatctcctccatcgctgagctgcggctcgtccctttcggccatgggcgtgtctcggccgacggaaccgtcacttgccagcatggagaggacgagtgccaactcaacgctatagaagcttgcgtgatcagaatatggcctgacgcggagcagcattttcctttcattcaatgcgt

SEQ ID NO: 8565 - protein, 120 aa, Zea mays
  misc_feature: Ceres CLONE 371149-F
  misc_feature (35)..(120): Pfam Name: GILT Pfam Description: Gamma interferon inducible lysosomal thiol reductase (GILT)
MAMASRPPLRRRRRLPLVPLLVLLCLSPGCAAGRVPVLVYYEALCPFCSAFVVNDLSRVFRDGISSIAELRLVPFGHGRVSADGTVTCQHGEDECQLNAIEACVIRIWPDAEQHFPFIQC

SEQ ID NO: 8566 - DNA, 372 bp, Zea mays
  misc_feature: Ceres CLONE 371186-F
  misc_feature: Encodes the peptide sequence at SEQ ID NO. 8567
aattccccaacgcagccagcagcgcaaggtccagaagcccagaaccagacgagcacggacggatctcccccaacgcgcgtgcgtccgcaactagcgtctgccgccggccgccttcttccgcaccccccgacgcggcaaggagccccccgccatgagggtccacccggccccgcggaagcgcaccatcgccgtgcaacgctgcgcctccgcggcggcgggcgcgctcggcgggaagaagctgcgccgcctgccgcacatattcgacaaggtgctggagctcctgttcgcggccgacgcggacgtgtccgtcgaggaggacgcggcggcgcttgcggttcgtcgccgccgccgacgagttctccctcgcgggcg

SEQ ID NO: 8567 - protein, 73 aa, Zea mays
  misc_feature: Ceres CLONE 371186-F
MRVHPAPRKRTIAVQRCASAAAGALGGKKLRRLPHIFDKVLELLFAADADVSVEEDAAALAVRRRRRRVLPRG

SEQ ID NO: 8568 - DNA, 414 bp, Zea mays
  misc_feature: Ceres CLONE 371318-F
  misc_feature: Encodes the peptide sequence at SEQ ID NO. 8569
ctctgaagccggcagatgtcgagtccaaaattgcaaaaatctctgccgtgcctctcgtctctcttctcaggcgccacgcaaaacggtctccgttttccctctccggatccggcccgcgggagccaggagccatcgatgatccggaccgcaacggtgcgagcgcgtctcctcctatcgcgctcctacgtagcacaggcaaaggcagcttctcgctggcctctcgtccgctggaaggcttcgcatcttggatctgtacgctctttctatcagatggacattacaaggcaatacaaaaataaaattttgactgcaagagggtgccatagctcccctgagagtcaagaattagcaatgaaaagctgtgttccatgcaactctaaggatttaggtcccatgtcagaagattctgctaaa

SEQ ID NO: 8569 - protein, 93 aa, Zea mays
  misc_feature: Ceres CLONE 371318-F
MIRTATVRARLLLSRSYVAQAKAASRWPLVRWKASHLGSVRSFYQMDITRQYKNKILTARGCHSSPESQELAMKSCVPCNSKDLGPMSEDSAK

SEQ ID NO: 8570 - DNA, 417 bp, Zea mays
  misc_feature: Ceres CLONE 371327-F
  misc_feature: Encodes the peptide sequence at SEQ ID NO. 8571
  misc_feature (2)..(2): n is a, c, t, g, unknown, or other
ancctatcgctacacagtccgccgtggctctctgcaattaatggctgcctccacagcgtcgtcgtcatactctgccggtgtaagcvsccgcctgctgtgtgtctccgcgccatggcagcagcttcgtcaagccgcagcgctctggacggccggcggcggcggcggcgaccctacctgcgtcaggcggcgaccagssaacctatcgttagactgctgtcgtgagtaagagtagggctagaagaggcgagcgaatcagggcttcagatgatgctgcgaccatcatggacgcgggcggctgggcagcacggcttgaagccccgccgccggtagccgtcgtcactggagcgtctagagggattggcagagcatagctgtagcacttggcggacagggtgcaaggtggttgtgaactatgcc

SEQ ID NO: 8571 - protein, 29 aa, Zea mays
  misc_feature: Ceres CLONE 371327-F
MDAGGWAARLEAPPPVAVVTGASRGIGRA

SEQ ID NO: 8572 - DNA, 439 bp, Zea mays
  misc_feature: Ceres CLONE 371357-F
  misc_feature: Encodes the peptide sequence at SEQ ID NO. 8573
  misc_feature (352)..(352): n is a, c, t, g, unknown, or other
atttattagaataaagaagcacccagccacgcctgtgactgtgagaggccggcgcggagggagtttcatcagatcgtgccgtgcgtgccctctgtgtgtctgattacgcgtgcgtgcgagggtcagagaggagggagggaggggctctggagatgacggggagaagggagcttctgctgcttgcgctcttgggagtccttcagctagctcttcgtctaccttccgcagcgtcgcagtccttcatcggcatcaactacggcgaagtggccgacaacctcccgccgccgtcgtccaccgcgcgcctcgtccagtccacgaccatcaccaaggtgcgcctctacgggaccgaccnggccatcatctccgccttctccggcacgggcgtctccctcctcctgggcgccaccaacggcgacatcgccaacctcgcgtcctcgcc

SEQ ID NO: 8573 - protein, 95 aa, Zea mays
  misc_feature: Ceres CLONE 371357-F
  misc_feature: SWISSPROT Homolog: EC 3.2.1.39 Glucan endo-1,3-beta-D-glucosidase
  misc_feature (67)..(67): Xaa is any aa, unknown, or other
MTGRRELLLLALLGVLQLALRLPSAASQSFIGINYGEVADNLPPPSSTARLVQSTTITKVRLYGTDXAIISAFSGTGVSLLLGATNGDIANLASS

SEQ ID NO: 8574 - DNA, 523 bp, Zea mays
  misc_feature: Ceres CLONE 371370-F
  misc_feature: Encodes the peptide sequence at SEQ ID NO. 8575
tccgcatttccatcctgtcgtgggatcccagccaccgccgctagaagaagagctcggcgattcccaggtcccgcgagaatatgccgaagcagatccatgagattaaggacttcctcctcaccgcgaggaggaaggatgcccgctcagtgaagatcaagaggagtaaggatgttgtcaagttcaaggtgcgctgctccaagtacttgtacacgctctgcgtcttcgatgctgagaaggcaaacaagttgaagcaatctcttcccccaggtttgaccgtcgaggaggtctgattggatacatggcaacgccgagttgaactacccaagcttctttatcagtagcagagcatgctactctatgtacttttggaacctaagctattagacctgtcagtgttggatgtctggatcttgcatttttggagaaataccaatttacctcgttcaaggatgcaagtatattcttgtttaactgcacattacttttatatttatgcctgtttcatacctttcctctacaaaaa

SEQ ID NO: 8575 - protein, 69 aa, Zea mays
  misc_feature: Ceres CLONE 371370-F
  misc_feature (2)..(69): Pfam Name: Ribosomal_L38e Pfam Description: Ribosomal L38e protein family
MPKQIHEIKDFLLTARRKDARSVKIKRSKDVVKFKVRCSKYLYTLCVFDAEKANKLKQSLPPGLTVEEV

SEQ ID NO: 8576 - DNA, 488 bp, Zea mays
  misc_feature: Ceres CLONE 371383-F
  misc_feature: Encodes the peptide sequence at SEQ ID NO. 8577
acaggctgtacgtagggccgtgccgtcgcccctccttccttcgtcgatctctctctcggcgacgactgggcgaccgctgcctcctgttgccctggtctccattgggccctttgccagattttctttcgcctctccgccggcgacgaacaccaccaccaggaatgggcttgtggacgttgctggagggttttttgcttcttgcaaatgcgttggctatattgaatgaagaccgctttctcgctccaaggggatggagcatgtctgaagtatcaggaaatgggcaaacgaagtcgttgaagggccagatcgtggggctaatctatgctacacaatttctgaggatgcccttaatagcactcaatgttctgatcattgttgtgaaactggtgtctggctgaggctcattatctagttttcactgttgtgttggattgatatctgttccagcatgatgtaaaagttagtaatactcaaagctgctggaaata

SEQ ID NO: 8577 - protein, 78 aa, Zea mays; identical to SEQ ID NO: 8422
  misc_feature: Ceres CLONE 371383-F
  misc_feature (3)..(78): Pfam Name: Yos1 Pfam Description: Yos1-like

SEQ ID NO: 8578 - DNA, 489 bp, Zea mays
  misc_feature: Ceres CLONE 371402-F
  misc_feature: Encodes the peptide sequence at SEQ ID NO. 8579
  misc_feature (351)..(351): n is a, c, t, g, unknown, or other
aatccgtgctttgtgcctgtttggtgcgcgtccacctttcggggtcaccggcttctgctttcttgctacgccaccgcgcctctcgtctatttatggagtcccccgatccatgaagccggggcaggccgagagttgtcaaggacgacgtctgccggcagtgctcctgctcctcctcctccttcctggccgccgcgcgagcttgggttagttagtgtctcttcttcgcggagacctgtgagaggagccatcatcatggccgctgttgagactgttgtcctcaaggttgctatgtcatgcgagggctgcgccggggcggtcagaagagtgctctccaagatggaaggagttganaccttcgacatagacctcaaggagcagaaggtgacagtcaaaggcaatgtcaagcctgaggacgtcttccagacggtttccaagtcggggaagaggacctcgtactgggagggcgaagccacggccccggacgctgcg

SEQ ID NO: 8579 - protein, 79 aa, Zea mays
  misc_feature: Ceres CLONE 371402-F
  misc_feature (7)..(68): Pfam Name: HMA Pfam Description: Heavy-metal-associated domain
  misc_feature: SWISSPROT Homolog: EC 3.6.3.4 Copper-exporting ATPase
  misc_feature (33)..(33): Xaa is any aa, unknown, or other
MAAVETVVLKVAMSCEGCAGAVRRVLSKMEGVXTFDIDLKEQKVTVKGNVKPEDVFQTVSKSGKRTSYWEGEATAPDAA

SEQ ID NO: 8580 - DNA, 459 bp, Zea mays
  misc_feature: Ceres CLONE 371417-F
  misc_feature: Translation starting site: 81
agcagcctcccgaatccccaaagcctccgacccccttcctctctccctccgccgccgctgcgcacgcrggaacaagcgacatgggcgtctacaccttcgtgtgccgcaacaacggcggcgagtggaccgccaagcagcactccggcgagatcgaggcttccgccgctaccccatacgagctgcagcgccgcctcgtcgccgctgcctccgcggccgactctgcctacggcgtccagtcgtccttctccatggtcacccccagctccgccgtgttccaggtgatcgtcggtgctgttggtggtggtgcaatgatggtgagcggaggtggcggcggtgctgctgcatctggtggtgctgctgccgaggctcccaaggaggagaagaaggaagagggagaaggaagagagcgacgacgacatgggattctccctgttcgactagagttstgtgtgtcatctc

SEQ ID NO: 8581 - DNA, 670 bp, Zea mays
  misc_feature: Ceres CLONE 371479
  misc_feature: Encodes the peptide sequence at SEQ ID NO. 8582
acccaccgttgctgctgctataccaccatcaccagtcaccaccaccggataaggacacggcagcactagctcgtagagggtcggccagagtcagcaaaacagaaaagggagaggggggatgggggccgatcgcttcccgagcgtggcggagggcggcctcggcggcgaggcgctctactgcgcggtcatcctgtggctgtccgtgacgtcgtggatcatcttcacctgggccggcgacggcggggaaggcgggaggaggcggcggggcggcggtcgcagccgcgggagcccagcgttcgtcggcgcgtcggggctctgcgacggcaccgggcccgaatgcagcggcggctacggcatctgcggcacctgcctcgactagctagccgcgcgcctgctctgctactagtaagtttgtgtgagcgtgagcgtgtttctagcatctacatgtcgtcgtcgtcgtcgatccgtgacctcgatcgaaccggagcagctcccctgtgttatgatcctctgtaaattaagctggaagcctgctaaaagtatcagatacatgccttcaaaagtatatgagatgagattcttcgtcggcgaggttactttatccgctgcgtttagctgctgtgtaggatctctctttttaaggaattgattaataaaaaaaaaaaaaaaa

SEQ ID NO: 8582 - protein, 86 aa, Zea mays
  misc_feature: Ceres CLONE 371479
MGADRFPSVAEGGLGGEALYCAVILWLSVTSWIIFTWAGDGGEGGRRRRGGGRSRGSPAFVGASGLCDGTGPECSGGYGICGTCLD

SEQ ID NO: 8583 - DNA, 694 bp, Zea mays
  misc_feature: Ceres CLONE 371480
  misc_feature: Encodes the peptide sequence at SEQ ID NO. 8584
gagggcgagaagcggcggcaggcagacacagctcttagctctgccctgcagtgcgcgcgagcgcgacgggggtgctgtgctgccgcggtggtgggagaccatggcgacggtgccggtgccgttgccgtggccgagcgtgaggaggtcgctgcaggagggggccgccagcgcggcatcgtacgcgcggcgagctccgtggcagggggcggcgcggcccgcggccacggtgaggtcggtggagacgctggtggtgatcgtggccgcgatcgtgctcgccgccgtgctggcgggcgtcctcgcgcgggtctgtggcgggcggcacgtcgtgccgagcgcccagtaccacgacgaggaaggctgggtggagaggcgctgccggagctgcctcgacagcgggctgccgccgccggagcagggggcgtccaagacgagcgaggccaaatagcgtcattgtgcattgtggtagtactaccctagtagcctgctctgcgtactagtactgtgctgtgctgctgtactattatagtaatactactagcgtttgtctaggcaattcattactgcaggcttcttatcagcgtatgcaaagtttgtgtgtaattagaacagccgggtctggctgcattgctacctaattgtacacaggagtggtacgaggctaggacatcaggcattaagaaaaaaaaaaaaaaaa

SEQ ID NO: 8584 - protein, 114 aa, Zea mays
  misc_feature: Ceres CLONE 371480
MATVPVPLPWPSVRRSLQEGAASAASYARRAPWQGAARPAATVRSVETLVVIVAAIVLAAVLAGVLARVCGGRHVVPSAQYHDEEGWVERRCRSCLDSGLPPPEQGASKTSEAK

SEQ ID NO: 8585 - DNA, 502 bp, Zea mays
  misc_feature: Ceres CLONE 371520-F
  misc_feature: Encodes the peptide sequence at SEQ ID NO. 8586
agctcgtcgctctctcctcggccgcccgaacgtacgtgcctctataaattgatctgcatctccctccaactgcgacacacaccacacacacacattttcaaatctagcttgttcgctaagctcaggctagctgagctgatctgagaaacgatcgctgcttcagtttcagcttgatcgctagctcgctacacagatcgatcgacctcttatttagcttgttcctccaaggaccgagatcggttgttgttgataaaccagccatggttgcggttgcggaggcagcggtgacgacgaccatgacgacgacgggcgggcggtacgcgctgctgatggcggcgcacgactcggagtacgtgctcaacaagtacggcgggtacctccacgtcttcgtggcggccttcggcgacgccggcgagacgtgggacctgtatcgggccatcgacagcgagctccctggccccggtgagcttgaggcctacgacgggttcgtgatcagcggcag

SEQ ID NO: 8586 - protein, 80 aa, Zea mays
  misc_feature: Ceres CLONE 371520-F
MVAVAEAAVTTTMTTTGGRYALLMAAHDSEYVLNKYGGYLHVFVAAFGDAGETWDLYRAIDSELPGPGELEAYDGFVISG

SEQ ID NO: 8587 - DNA, 471 bp, Zea mays
  misc_feature: Ceres CLONE 371556-F
  misc_feature: Encodes the peptide sequence at SEQ ID NO. 8588
atccccctttctgctcctgtgctgcgtccaccagcctcgtcgttaggacgtaaggtaagacacccaggggcgagccagtgagtacagagagtagccttacgtagcgamstcagagcaagcgagggtacggtcaaggggggtgatggcgctgtctcgacgtatggcggctcccgtcctcgtcctcatgctcctcctcgtcgccacagagctggggacgaccaaggtggcggaggcgaggcactgcctgtcgcagagccaccggttcaagggcctgtgcatgagcagcaacaactgcgccaacgtgtgccagaccgagaacttccccggcggcgagtgcaaggcggagggcgccacgcsaagtgcttttgcaagaagatatgctagtagtagcctcggctttgctggcgttgggcggcacaggcaggtcgtcggcacgaaacgcaattcaagcatatatatcggtcctcctcc

SEQ ID NO: 8588 - protein, 109 aa, Zea mays
  misc_feature: Ceres CLONE 371556-F
  misc_feature (32)..(67): Pfam Name: Gamma-thionin Pfam Description: Gamma-thionin family
  misc_feature (72)..(72): Xaa is any aa, unknown, or other
MALSRRMAAPVLVLMLLLVATELGTTKVAEARHCLSQSHRFKGLCMSSNNCANVCQTENFPGGECKAEGATXSAFARRYASSSLGFAGVGRHRQVVGTKRNSSIYIGPP

SEQ ID NO: 8589 - DNA, 479 bp, Zea mays
  misc_feature: Ceres CLONE 371586-F
  misc_feature: Encodes the peptide sequence at SEQ ID NO. 8590
aaccaactaaaacgacgaatgtttttgagaggaacagggaaaaacaatacttaacgctcggtgtcgcattgcatcatccgtcgttacgtttcgacgccctcgcccgcctgagctgtttctgcagagtcataaatcccagccacccactgtgtgcaccgatcagtcaaccagcgtgaacaaacaggagacgcatccagcctccagcagagggctccagagatccagcaagatgaaggagggcacggcgaactgtgtggacatcctcatcgccatcatcctgcccccactcggcgtcttcctcaagttcggatgcaaggtcgagttctggctctgcctcttgctcaccttcctcgcctatcttccggggatcatctacgcgatctacgccatcaccaaggactagcgcggttccagttgggtgagagctgcaagctcctccttctcttctcagctgtgaagctactactactagtctacta

SEQ ID NO: 8590 - protein, 57 aa, Zea mays
  misc_feature: Ceres CLONE 371586-F
  misc_feature (6)..(56): Pfam Name: UPF0057 Pfam Description: Uncharacterized protein family UPF0057
MKEGTANCVDILIAIILPPLGVFLKFGCKVEFWLCLLLTFLAYLPGIIYAIYAITKD

SEQ ID NO: 8591 - DNA, 498 bp, Zea mays
  misc_feature: Ceres CLONE 371587-F
  misc_feature: Encodes the peptide sequence at SEQ ID NO. 8592
atccccctttctgctcctgtgctgcgtccaccagcctcgtcgttaggacgtaaggtaagacacccaggggcgagccagtgagtacagagagtagccttacgtagcgaagctcagagcaagcgagggtacggtcaaggggggtgatggcgctgtctcgacgtatggcggctcccgtcctcgtcctcatgctcctcctcgtcgccacagagctggggacgaccaaggtggcggaggcgaggcactgcctgtcgcagagccaccggttcaagggcctgtgcatgagcagcaacaactgcgccaacgtgtgccagaccgagaacttccccggcggcgagtgcaaggcggagggcgccacgcgcaagtgcttttgcaagaagatatgctagtagtagcctcggctttgctggcgttgggcggcacaggcaggtcgtcggcacgaaacgcaattcaagcatatatatcggtcctcctcctgcgttgcgctgtctaactcgatcc

SEQ ID NO: 8592 - protein, 80 aa, Zea mays; identical to SEQ ID NO: 6248
  misc_feature: Ceres CLONE 371587-F
  misc_feature (32)..(80): Pfam Name: Gamma-thionin Pfam Description: Gamma-thionin family

SEQ ID NO: 8593 - DNA, 449 bp, Zea mays
  misc_feature: Ceres CLONE 371598-F
  misc_feature: Encodes the peptide sequence at SEQ ID NO. 8594
aatctgggagtggtgttaacagcgccgcaccacctcgtgccgtgggaggtcgagctcgtcgatgcgacgctcctcggagagcagcgcctcctcctgcgcggtcttcttcggcgcgagggcgggcgggacggagggcgccgaggaggaggcggtggcggatgagctagggttagggttcgccgccgccgtctgagctgcggcgtcgaggttgctggggtcggaaccggtagcagctgcggcggaattcgcggagggcaccgacgtgccggccttggcgagcagctggcggtgctcgtcgcggcgcttctggagctgcttctgctccagctccgaccgccgcacgaagctcttgctcccgaagtcggccgtcgccgccttccgcttcttctccagttcccgcttcagcagatccattacgcccgccgcccagttcggcttcgattctccga

SEQ ID NO: 8594 - protein, 43 aa, Zea mays
  misc_feature: Ceres CLONE 371598-F
MRRSSESSASSCAVFFGARAGGTEGAEEEAVADELGLGFAAAV

SEQ ID NO: 8595 - DNA, 322 bp, Zea mays
  misc_feature: Ceres CLONE 371702-F
  misc_feature: Encodes the peptide sequence at SEQ ID NO. 8596
  misc_feature (72)..(72): n is a, c, t, g, unknown, or other
  misc_feature (79)..(79): n is a, c, t, g, unknown, or other
acgtaacacggcgattcaggaggggatagcatcgtcatcgcaaaatgcaggctctcctgctccccgcgcggnccgscgnccgacgccggsatgcttcggcagcgtgcggtttctgcctccgcgtgtgcgtcgcaggtctgccgccccctattcggtgccgccaattgcatctcctgtgggggtctacggaagcgttcggcggcacctcacagtggcggtggcggcggccccgccttcgccttcgtcctcaccttcgtcgggaccgctctacccgacgcctccacccaccgagcaggaggtggagagggtcaagctcgagcag

SEQ ID NO: 8596 - protein, 107 aa, Zea mays
  misc_feature: Ceres CLONE 371702-F
  misc_feature (24)..(24): Xaa is any aa, unknown, or other
  misc_feature (30)..(30): Xaa is any aa, unknown, or other
RNTAIQEGIASSSQNAGSPAPRAXRRPTPXCFGSVRFLPPRVRRRSAAPYSVPPIASPVGVYGSVRRHLTVAVAAAPPSPSSSPSSGPLYPTPPPTEQEVERVKLEQ

SEQ ID NO: 8597 - DNA, 810 bp, Zea mays
  misc_feature: Ceres CLONE 371715-R
  misc_feature: Encodes the peptide sequence at SEQ ID NO. 8598
  misc_feature (810)..(810): n is a, c, t, g, unknown, or other
tttcccattttttttttgaattcttatttttttcatcttttttttttttctttttaccccaattgggtacgggccccccctcgaggtcgacggtatcgatatccaggagctgcgccgccgtccaccggtcgcgcgggttcctggcgaagcaccgggccaggaagtccttggcctcggcggacatccacccgggcgcgtccggcacggcgtcagtgtacccgatccggtgcactgccgcggggaggctgtccacgtcgctccacggcgcgcggcccgtggccatctcgacgacggtgcagtccagcgcccagacgtcggcggcggggccctgctcctccccgcgccacctcgggcgccatgaacgccggcgtgctgtcgacggggctccctggagaccaccgtcccgccccaccctcaactcccctgagtttgtcacgttccgcttagttctcccctacacttttaccctgtccttccccctccttttgttttttttctttccatccccttttatcccacatttccagcttttcctttaccttccccccccctttttcccttattccccattatttaacccctttattaccatatacccccccaatcacctttttccccctttccccttccctttttccccccttatatttattttctccccccttacttatatctctttctttcttccctttacaccattcttattccccaccccccactccatttatataccccccactctttccacatataaccaacacctatacacccccagaccccgcgcctaaccactcttttttatatcagccn

SEQ ID NO: 8598 - protein, 261 aa, Zea mays
  misc_feature: Ceres CLONE 371715-R
SHFFFEFLFFSSFFFFFLPQLGTGPPSRSTVSISRSCAAVHRSRGFLAKHRARKSLASADIHPGASGTASVYPIRCTAAGRLSTSLHGARPVAISTTVQSSAQTSAAGPCSSPRHLGRHERRRAVDGAPWRPPSRPTLNSPEFVTFRLVLPYTFTLSFPLLLFFFFPSPFIPHFQLFLYLPPPFFPYSPLFNPFITIYPPNHLFPPFPFPFSPLIFIFSPLTYISFFLPFTPFLFPTPHSIYIPPTLSTYNQHLYTPRPRA

SEQ ID NO: 8599 - DNA, 400 bp, Zea mays
  misc_feature: Ceres CLONE 371718-F
  misc_feature: Encodes the peptide sequence at SEQ ID NO. 8600
  misc_feature (205)..(205): n is a, c, t, g, unknown, or other
  misc_feature (207)..(207): n is a, c, t, g, unknown, or other
atttttctccagccgccgcgctcctgatccttatctctgcgcgcgctgcatcggcgcccgccgggagssmttcccgcccgcctcgtccatgttgtgggtccgcaatatccgccgcttcgtcgacacgggcgccggcctcggatccgagcatcatggaactggagactaaraggatattgcttgagattttcaaggagcggcassnanagagtgccgaggctggttccatcccaagtttttacaagaaacctgaagaaggatccattagctctagagttcaaaggttgggccaagtacagggtttctaaagaaacaatcagagcttctgctgaatgctggatgatcttgatgccatgtggggtttgtctcagagaaaaattgtgttattgatgatgctact

SEQ ID NO: 8600 - protein, 51 aa, Zea mays
  misc_feature: Ceres CLONE 371718-F
  misc_feature (17)..(17): Xaa is any aa, unknown, or other
  misc_feature (18)..(18): Xaa is any aa, unknown, or other
  misc_feature (19)..(19): Xaa is any aa, unknown, or other
MELETKRILLEIFKERXXXSAEAGSIPSFYKKPEEGSISSRVQRLGQVQGF

SEQ ID NO: 8601 - DNA, 392 bp, Zea mays
  misc_feature: Ceres CLONE 371719-F
  misc_feature: Encodes the peptide sequence at SEQ ID NO. 8602
aaccactcgcattcgtcactcgtccctctcccctctctcccccaaggccccaacccacttgagcgagccctagagaaggcaaaagcatggcgtccttggttgttcgtgccgccggcgccgccgccgccgccgcccgtcttccctccctccgtcctcgccgcaacggcagcggggtgctctccggcttgagggtcggaacagggcactacggcgcgcggctcgcgcttgcttcgtccacagcttctcacaaagagttcaagatcgcctgccttactgtcgatgacagcagtttgggcccgggggatgaatatgagtctgacccccgcatgccaggcgaggatgagttcgaccatttctaccgtgttctcgccaagaagactgacaacctgctc

SEQ ID NO: 8602 - protein, 102 aa, Zea mays
  misc_feature: Ceres CLONE 371719-F
MASLVVRAAGAAAAAARLPSLRPRRNGSGVLSGLRVGTGHYGARLALASSTASHKEFKIACLTVDDSSLGPGDEYESDPRMPGEDEFDHFYRVLAKKTDNLL

SEQ ID NO: 8603 - DNA, 467 bp, Zea mays
  misc_feature: Ceres CLONE 371779-F
  misc_feature: Encodes the peptide sequence at SEQ ID NO. 8604
acgagacgaccgtacattcgttatcggactgggaagcagcggcggtacaaagtgtgggagagaaaggagaagagacttgatgtcctcgcagtttgtccaatagatctcctcgccgcctcacccgtctcctcctccgcagcttccccgcgatcccgaccatggagggcgacggtaccaaccttgatgcggcgatagagtcgctcctgaatgtcgagaagcagatgaggctggccggagatgtcgccggcactcggaaggccgtcatcgacatcgtcgagctctgctacaaggccggcgcgtggaagacgctaaacgaccagatcgttctcctatctaagaggagaggccagcttaagcaggctattactgctatggttcagaaagcaatggagtacattaatttgacaccaggcattgacacaagcatcgagctaataaaaacactgagcagtgtctctgctggcaaa

SEQ ID NO: 8604 - protein, 103 aa, Zea mays
  misc_feature: Ceres CLONE 371779-F
MEGDGTNLDAAIESLLNVEKQMRLAGDVAGTRKAVIDIVELCYKAGAWKTLNDQIVLLSKRRGQLKQAITAMVQKAMEYINLTPGIDTSIELIKTLSSVSAGK

SEQ ID NO: 8605 - DNA, 417 bp, Zea mays
  misc_feature: Ceres CLONE 371821-F
  misc_feature: Encodes the peptide sequence at SEQ ID NO. 8606
gtcgtcatctgctggtgcaggagcgccgagcgcagatccatcaggattggagtgttttcctcgtcttcaagcgagaagggtcttcaggacttgttttttgggcgggcgcagttgcggagatgcagaggctgggggatttcaggctccctcccttcttcaactaccctccttacttcactttgcagcctatgcgtgaaacacgggaaaagcaagtacagttatggaaaaatatgatactcgattactgtagaagtcaaaagatacatacaatatccctggaagaagatttccccatgttctccaatccaaagattgagagatctcttacctatgaagcaaaggaagtgttccttgcagctctcgtcagtgaaggtcgtgctgagtggatggacaaaggtcacaagaagtgcctagttc

SEQ ID NO: 8606 - protein, 99 aa, Zea mays
  misc_feature: Ceres CLONE 371821-F
  misc_feature (7)..(99): Pfam Name: ESCRT-II Pfam Description: ESCRT-II complex subunit
MQRLGDFRLPPFFNYPPYFTLQPMRETREKQVQLWKNMILDYCRSQKIHTISLEEDFPMFSNPKIERSLTYEAKEVFLAALVSEGRAEWMDKGHKKCLV

SEQ ID NO: 8607 - DNA, 456 bp, Zea mays
  misc_feature: Ceres CLONE 371823-F
  misc_feature: Encodes the peptide sequence at SEQ ID NO. 8608
acagaaaaagaagccatcaaagagcaaggcacagtgctatagaggtaaaacgggggagaggacgagcgaggccgaggacaatgggaacgagccttgcgcaggcggtgacggcgctgatgggcacgtgcgcgcggcagctgtcgcgggcggctcggcggctgcaccggcgcccgcgcgcgcggcagrcgctcgcggcgtccttgtcgtcgcgcgccatcgtgccgttcctcggcggcggcggcggcggagccatcgggtccaagatgaggaggaggcgcgaacaggatgagccgagcttggaggcagaggaggacggggtgtggaggaaggagataatgatgggggagcgctgccagccgctggaattctccggggccatctactacgacgccgagggccgccgcctcgagcagccgccgaccccgcgctcgccgcttcgcagcccgcttgccggtg

SEQ ID NO: 8608 - protein, 125 aa, Zea mays
  misc_feature: Ceres CLONE 371823-F
  misc_feature (36)..(36): Xaa is any aa, unknown, or other
MGTSLAQAVTALMGTCARQLSRAARRLHRRPRARQXLAASLSSRAIVPFLGGGGGGAIGSKMRRRREQDEPSLEAEEDGVWRKEIMMGERCQPLEFSGAIYYDAEGRRLEQPPTPRSPLRSPLAG

SEQ ID NO: 8609 - DNA, 462 bp, Zea mays
  misc_feature: Ceres CLONE 371831-F
  misc_feature: Encodes the peptide sequence at SEQ ID NO. 8610
atctataaacagagtgagagactggtagcagccgcatgtgctagagctagacagaagtcagtctccttcccctctctctagtgctcgccggctctttccgtcgccatggacgtcctcctctgctgctgcctgctgcttctcctggcctccgccgcgtccgccggcagcgagcggtgcgtgcggcaggggaaggcggcctactcttcctcgctctctccggcccctcacggtagcagcagcggagcgtgcgggtacggcgccatggccgccgagatcaatgggggcttcctcgccgccggcgggcccaggcagcaccgcgggggcctcggctgcggccgctgtttccagatgagatgccgagacgcaaagctgtgcagcggcgggggagtgcgggtggtgctgaccgacttccacaagagcaaccgtacggacttcctgctcgccgggccggcgttcgcgggc

SEQ ID NO: 8610 - protein, 119 aa, Zea mays
  misc_feature: Ceres CLONE 371831-F
  misc_feature (62)..(119): Pfam Name: DPBB_1 Pfam Description: Rare lipoprotein A (RlpA)-like double-psi beta-barrel
MDVLLCCCLLLLLASAASAGSERCVRQGKAAYSSSLSPAPHGSSSGACGYGAMAAEINGGFLAAGGPRQHRGGLGCGRCFQMRCRDAKLCSGGGVRVVLTDFHKSNRTDFLLAGPAFAG

SEQ ID NO: 8611 - DNA, 495 bp, Zea mays
  misc_feature: Ceres CLONE 371846-F
  misc_feature: Encodes the peptide sequence at SEQ ID NO. 8612
gtgagccagcggggaaggaaggaagcaacaccgagggtaggatgggggtaggcgagtgcaagagcaacgactacggcgccgccgcatactgggacgcccgctactcctccggctcgccagcttccgccgccgccggctgtgggttcttcgactggtaccagacgtacccggcgctgcggccgctcctccgcgcccgcgtcccgacctcctcccgcgtcctgatgctcggctgcggcaactcccttttgtcggaggatatggcgaaggatggttatgaagacattgtaaacatagacatttcatctgtggtcatcgagcaaatgagagagaaacacaaggagattagacagctaacatatatgcagatggatattagagatatgggatttttcggtgatgagtcatttgattgtgtccttgataaagggacctggatgctatgatgtgtgctgatgatgctcctcatggtgccttcaaaatgctagcagaagtggc

SEQ ID NO: 8612 - protein, 133 aa, Zea mays
  misc_feature: Ceres CLONE 371846-F
  misc_feature: SWISSPROT Homolog: EC 3.4.24.71 Endothelin-converting enzyme 1
MGVGECKSNDYGAAAYWDARYSSGSPASAAAGCGFFDWYQTYPALRPLLRARVPTSSRVLMLGCGNSLLSEDMAKDGYEDIVNIDISSVVIEQMREKHKEIRQLTYMQMDIRDMGFFGDESFDCVLDKGTWML

SEQ ID NO: 8613 - DNA, 452 bp, Zea mays
  misc_feature: Ceres CLONE 371899-F
  misc_feature: Encodes the peptide sequence at SEQ ID NO. 8614
ccacgaagcaaagcaaagccaaagcaatctcaagtgaatcaaaccgccagacttcgcagtcctcctccccactaccagagcatgcgcgttgccgcgacccgagccgccgccgccgctcaccctccgagcgccttcctgctcctcctgttactcctcggttgcgcgtccctcgcgatcggaggagcagccatggccggccacgtcctcggcggcgtgaaggagaacccagccgcggccaacagcgccgagtccgacgggctcggccgcttcgccgtcgatgagcacaacaggcgcgagaacgcgctgctggagttcgtgcgcgtggtggaggccaaggagcaggtggtggccggcacgctgcaccacctcacgctcgaggccgtcgaggccgggaggaagaagctctacgaggccaaggtctgggtcaagccatggctcgacttcaaggagct

SEQ ID NO: 8614 - protein, 123 aa, Zea mays
  misc_feature: Ceres CLONE 371899-F
  misc_feature (43)..(123): Pfam Name: Cystatin Pfam Description: Cystatin domain
MRVAATRAAAAAHPPSAFLLLLLLLGCASLAIGGAAMAGHVLGGVKENPAAANSAESDGLGRFAVDEHNRRENALLEFVRVVEAKEQVVAGTLHHLTLEAVEAGRKKLYEAKVWVKPWLDFKE

SEQ ID NO: 8615 - DNA, 474 bp, Zea mays
  misc_feature: Ceres CLONE 371905-F
  misc_feature: Encodes the peptide sequence at SEQ ID NO. 8616
gtacaaatcatcacacgcagccacgcaggtagaacacaagcgccgtgcacgcttgcgcaagcccaaggattgccgctctgctctgtctcctccggtggccgcaggggcaatggcgattggcgggaaggaggtcaaggatgacctggaggaggcgccgccgccggtcctggacgaggccatgcggccgcgccgcgtcgcgctcttcgtcgagccgtctccgttcgcatacatctctgggtataagaaccggttccagaacttcatcaaacacttgcgagaaatgggggacgaggtcattgttgtgaccaatcatgagggagttccccaagagttccatggcgccaaggttataggttcatggagcttcccatgccccatgtatggaaaagtacctctttcgctggcactcagtcctaggatcatttcggaggttgcgaagttcaaacctgacattattcatgcgtcttctcctgg

SEQ ID NO: 8616 - protein, 121 aa, Zea mays
  misc_feature: Ceres CLONE 371905-F
MAIGGKEVKDDLEEAPPPVLDEAMRPRRVALFVEPSPFAYISGYKNRFQNFIKHLREMGDEVIVVTNHEGVPQEFHGAKVIGSWSFPCPMYGKVPLSLALSPRIISEVAKFKPDIIHASSP

SEQ ID NO: 8617 - DNA, 443 bp, Zea mays
  misc_feature: Ceres CLONE 371929-F
atagtacttcaaaataactccaacgaccatgtaaatctctcttacgaatgagctgcactgcaacctacgcgtgcttgacttgcttggtagtcgaccagcaattattattgtaagggattggccctcatcgcactgctgtctcccaatgatttagcttctcatcaatggattctctgtatgaccattgacaacttccaaaccgtggcatgtatagcctccgccaaagaacccttctccttctgcttgtataaagctacctatagcgcagaagaggctgatcggctgagctcatcgcacaaaagatatataagaaccaccaattggtaaccacaagcaatcaatatatagagagtcaaccttgcagcggcgatgaagatagtgcttaaggtggcgatcacctgcaagaagtgcaaaacctgcgtccttgggatcacctcgaaagt

SEQ ID NO: 8618 - DNA, 646 bp, Zea mays
  misc_feature: Ceres CLONE 371970-R
  misc_feature: Pfam Name: Trehalose_PPase Pfam Description: Trehalose-phosphatase
ccaattgggtaccgggccccccctcgaggtcgacggtatcgataagcttttttttttttttttttggagggaggctgtgcactggactcagcctcaaagtactgccttccacggatcaggtaaatagcaccacaaaccaaagtactagagcatcactagattcaagccagctctcgagactagaccactggcaatacattacgctggaaagcatacctcatttacacacctaaactactcggcgaaagctccagccgagccaacaacacaaacagacattaccgcaggagcagcacgggaagggaacgctccttcctattcccacacgtcgtccaaagaggagtcctcgtcttcatcccgctggttcgccagcgccagctcctcggagacgtaggagagcccctgcatcagcctcaccacctccgccgcgtcgtcgaggtagtacttggccttgctgggcttgcggccgacggtgcacgcgaacacctccgccttggacgccagcgagtccccgcaggcagcggtggcgatcagctggaacatgtcctcgtcggacttgtcgtcgccgatgcacaggacgaagtccgggcactggccccgctccttcatcgacacaagcatgcgccgagccaccaagcccttgctc

SEQ ID NO: 8619 - DNA, 479 bp, Zea mays
  misc_feature: Ceres CLONE 371972-F
  misc_feature: Encodes the peptide sequence at SEQ ID NO. 8620
  misc_feature (216)..(216): n is a, c, t, g, unknown, or other
  misc_feature (217)..(217): n is a, c, t, g, unknown, or other
gaaagggctaaaatacaaaaaagsttggccgccacaacaatatcgcattgacatatcgttcatcggatccagtcctctcccgggatctcctccggctataaatttccggccccaattcacccaatccagatgcgcaaacatcgaatcgtctcgctagtggctgccctactcgtgctgcttgccctcgccgccgtttcctccacgcgcassatcaannggagtccgcggctgacaacgccgggatgttggcaggcggcatcaaggacgtgccggcgaacgagaacgacctccagctccaggagctcgcgcgcttcgccgtcaatgagcacaaccaaaaggccaatgctcttctggggttcgagaagcttgtgaaggccaagacacaagtggttgctggcacgatgtactatctcactattgaagtgaaggatggcgagtcaataagctctatgaagctaaggtctgggagaagccatggg

SEQ ID NO: 8620 - protein, 79 aa, Zea mays
  misc_feature: Ceres CLONE 371972-F
  misc_feature (4)..(79): Pfam Name: Cystatin Pfam Description: Cystatin domain
MLAGGIKDVPANENDLQLQELARFAVNEHNQKANALLGFEKLVKAKTQVVAGTMYYLTIEVKDGESISSMKLRSGRSHG

SEQ ID NO: 8621 - DNA, 390 bp, Zea mays
  misc_feature: Ceres CLONE 371975-F
  misc_feature: Encodes the peptide sequence at SEQ ID NO. 8622
cctcatgattgtagcgcagcaagaagaggctgatctgaatgctgctatagctgctaccttgatggacactgggggtccatttgccagctatgatgcagatcaagaatacagcaactcacaagatgctcctgccgctggaccagctcggagcaaagaagaagctgataaatctgagccgagcgcacctccctgtgaggaggaaactcaggagttggcttcaggaagcgacaccaaaagggaggtttcttctgtagaggagaaaggaacagcgagagaagaataggatggcacttttgatcagtctgtaactgagttagactatacacagagaaactgccctccatttcagtggagttatgccttttttggttcgaaaaaaaaaaaaaaaaa

SEQ ID NO: 8622 - protein, 93 aa, Zea mays
  misc_feature: Ceres CLONE 371975-F
LMIVAQQEEADLNAAIAATLMDTGGPFASYDADQEYSNSQDAPAAGPARSKEEADKSEPSAPPCEEETQELASGSDTKREVSSVEEKGTAREE

SEQ ID NO: 8623 - DNA, 467 bp, Zea mays
  misc_feature: Ceres CLONE 372039-F
  misc_feature: Encodes the peptide sequence at SEQ ID NO. 8624
ttttcgatacacggaccatatagatcgcctttcaagttgaacgggttgccggcctaccgctgacagacgattcaaccgtccgccaaatccaaacgcaccgatccattccagaccatggcgacgaccaaggaccccgcgaccaccggcggcgagcccgccatcggcattccctaccacccggcggcggattcccaggggcactactactacgcgccgccgccgaacccctacgcggcggggatgccgccgcccaacgcgatctacgccggcgcgcccaagggggtgccgctccagcagaccatgttccgcgacacgcccgcgcccttccactgccaggcctgcggtgaagccgccgtctcctccgtccggtcaaagccaagccttgcatccgtcgtggcttgcatgatgccattcatgctgggggtctgcttcctatgcccttcgatggactgcctctggcacaagta

SEQ ID NO: 8624 - protein, 117 aa, Zea mays
  misc_feature: Ceres CLONE 372039-F
MATTKDPATTGGEPAIGIPYHPAADSQGHYYYAPPPNPYAAGMPPPNAIYAGAPKGVPLQQTMFRDTPAPFHCQACGEAAVSSVRSKPSLASVVACMMPFMLGVCFLCPSMDCLWHK

SEQ ID NO: 8625 - DNA, 484 bp, Zea mays
  misc_feature: Ceres CLONE 372059-F
  misc_feature: Encodes the peptide sequence at SEQ ID NO. 8626
acgagcacgagcccaacttgcattgctcacagccttacctgatccttgacaattctgctccctcgccgccgccgccgccgtccgcccgtcgtcgctgcgcttcggtacccgcgamssaaggccccgcctcccgtgtacccgccgcctaagaagggagaggagcagatgaaggcggggaggaagaacctgcggcgggcgtgcgacgagggcgccgccgtcacgctcgccgagggagagagcatcatgcaggtcctcacgctgcgssgctccaacgtcatcgaggtgatggacggcgtgggcgtcaggtccctggccttgttccccgccaagttccagaagagcttctggatcaagaacgggagtttcgtggtcgtggatgccagcgggagggaccaggcgctggaatcggggagcaagatcgcgtgcgttgtctcgcgagtcctcttccacgaacaagttcgggccctgcagaagtctcgtactg

SEQ ID NO: 8626 - protein, 106 aa, Zea mays
  misc_feature: Ceres CLONE 372059-F
  misc_feature (21)..(92): Pfam Name: eIF-1a Pfam Description: Translation initiation factor 1A / IF-1
  misc_feature (34)..(34): Xaa is any aa, unknown, or other
MKAGRKNLRRACDEGAAVTLAEGESIMQVLTLRXSNVIEVMDGVGVRSLALFPAKFQKSFWIKNGSFVVVDASGRDQALESGSKIACVVSRVLFHEQVRALQKSRT

SEQ ID NO: 8627 - DNA, 403 bp, Zea mays
  misc_feature: Ceres CLONE 372060-F
  misc_feature: Encodes the peptide sequence at SEQ ID NO. 8628
akgatctggtttaacattttttgttggagttgctctaaactcaacggccgacataacccatctggggcccacgtttcggatgcccgttatttgaaccgggcctatcgtctgcttgcwatgcaaagtcgcacgaccgcaccctgcgctcctctcccaaactgaattcgctgcgctgcgctgcgctgcgcttccctcgtcggccccggccccggcccgtgcgcggcktaccggctctacctcacaaaatccgccatggctggcggttcgctcgagccaggccaaactggagccgcgcccaaccagcgcaagakgaaggctccggcccctaccgcagacgctgaggacgaggcggaggcggaggcggaggcggaggcggaggagctgcagagtgtggaggagctgg

SEQ ID NO: 8628 - protein, 50 aa, Zea mays
  misc_feature: Ceres CLONE 372060-F
  misc_feature (20)..(20): Xaa is any aa, unknown, or other
MAGGSLEPGQTGAAPNQRKXKAPAPTADAEDEAEAEAEAEAEELQSVEEL

SEQ ID NO: 8629 - DNA, 884 bp, Zea mays
  misc_feature: Ceres CLONE 372078-R
  misc_feature: Encodes the peptide sequence at SEQ ID NO. 8630
cgaattgcgtacggggccccccctcgaggtcgacggtatcgataagcttttttttttttttttttgggtcggcgcctcccaaattagcaaagccgcgcgcattacgttacattacatacaaacattcacagtttggccgtataattagccagcgctgacaaattaaccctcgtcttcgtcgcctgacccgccgccgaccgccgtacgtgacgcaccaaccaggctatagagctacctccagccgccggcccgcgcgtcgtccgccgcggtgtacgtacgtctgccgcggagccacgcgcgcggacatggctcaactgaaggccgcgcgcgccaccgacgtcccgcccgccatgccggacccggacccggacgtcgtcgccgccgacctcggcgcgtgcgtacgggacgggcgcgttgaccgtttggcagcaggaagcggcagggcggaggcgacggctacggcgacgaccaccgcggaggaggccgatcagggacgacaactgccgccgctggtggtggtacggcaccgcgccagagtgatgaacgcgctggcgtctccagactccgggctgcgctgtgacatcaaggagaacacccttcatggcttcaaggccatcgccggcaggcagcccgaccgtcgtctacgtcgagtgtcgacttcccggtaaagcatggcccctccgtttctttttttattgggcccccaaaacccaatcagggcattagatgtttaaaataaggatggtctttggggaaaggggttttttggcgaaatttcttgccgcccccggggggaatccccccggaattcttaaaaggtggccggccccccgggggggggggaaattttccgggcgttgttgttcccccccctttgaggggga

SEQ ID NO: 8630 - protein, 120 aa, Zea mays
  misc_feature: Ceres CLONE 372078-R
MAQLKAARATDVPPAMPDPDPDVVAADLGACVRDGRVDRLAAGSGRAEATATATTTAEEADQGRQLPPLVVVRHRARVMNALASPDSGLRCDIKENTLHGFKAIAGRQPDRRLRRVSTSR

SEQ ID NO: 8631 - DNA, 453 bp, Zea mays
  misc_feature: Ceres CLONE 372100-F
  misc_feature: Encodes the peptide sequence at SEQ ID NO. 8632
gaaaaactcaaagaacagtgatttgaaataattgggaataaatagttcgtgaatccctgaagcgtgcatatatatattcctgccaagataaaggtaatggagtcgtcacgcaggttccagccggccgtcatcctgcttctcctgctcattgtgtccaccgatatggcacaggcaagggaatgcgagaagtacagtgagcgatttgttggggcatgcatgatcgcagacaactgcgccaatgtgtgccgcggtgagggcttcttggccggcaggtgcagcaccttccgccgccgctgcatctgcactaggcagtgctaaacaagatcgctcgatcgcttgccatgcatcgacaacctattcttaataacgttcattatctcgttcttatttatgacgaatgtcatgtatgttctggtgactgtcatgtatattctgatgactgtcatgtatctt

SEQ ID NO: 8632 - protein, 73 aa, Zea mays
  misc_feature: Ceres CLONE 372100-F
  misc_feature (27)..(73): Pfam Name: Gamma-thionin Pfam Description: Gamma-thionin family
MESSRRFQPAVILLLLLIVSTDMAQARECEKYSERFVGACMIADNCANVCRGEGFLAGRCSTFRRRCICTRQC

SEQ ID NO: 8633 - DNA, 496 bp, Zea mays
  misc_feature: Ceres CLONE 372144-F
  misc_feature: Encodes the peptide sequence at SEQ ID NO. 8634
ctgacctgccataagccgtagcataagctcagttgaatcgccacgcccaaggcacacgtatgtctcgcgcgctcgcgcttgcggtcctcctcctggccgccgccgccgcggtggcgccgctggcctccgccggcaccgaggagttcaccagcgtcgggtccagcggcggcaagatgttcgacagggcggtcggagccgatcccgacccgtccccggccggcggcctgccggccgacccagcgcccgacgcacgcccctaaggccacgcgcacgcaccgccgtacgtccccgtttccgtgtacgctccacgcgctggtactctccgctccgcccgtttccgtcgcccctaagacgtagtgttcatgaacacgacgcgccttgtacatgtctctggaatgtgcagcctgcatgtgttttgcttgcgagcgtttttcctttggctgtcgaccgatcgtgaatccgtcacgcagcactcagcagtagtgagcttagcatt

SEQ ID NO: 8634 - protein, 66 aa, Zea mays
  misc_feature: Ceres CLONE 372144-F
MSRALALAVLLLAAAAAVAPLASAGTEEFTSVGSSGGKMFDRAVGADPDPSPAGGLPADPAPDARP

SEQ ID NO: 8635 - DNA, 404 bp, Zea mays
  misc_feature: Ceres CLONE 372195-F
  misc_feature: Translation starting site: 130
attttaatctgctcgacacgccaccggccactgacatcccatatcgccaagtccccttcgtcgtccccttccctcgcctcgcgttaggtagcctgcttccgacccgcacatctccctccggttctcgccatgggcgccggcgccaacaaccacgaggagtcgagccccctcatcccagctgcggttgccgcccccgcggacgagaagcccccgcagctccggcgccggagcgccaattactatgccgacggggtcccggtcgtgatgggcgagcccgtgtcggcccacgccttcggsgcgtcccgcgggakagctgggaactccggggatcctctcctgcctcggccgcaacgacgagttctgcagcagcgacgtcgaagtgttgtccttcttggaacggtagc

SEQ ID NO: 8636 - DNA, 488 bp, Zea mays
  misc_feature: Ceres CLONE 372217-F
  misc_feature (101)..(101): n is a, c, t, g, unknown, or other
  misc_feature (162)..(162): n is a, c, t, g, unknown, or other
  misc_feature (369)..(369): n is a, c, t, g, unknown, or other
  misc_feature (444)..(444): n is a, c, t, g, unknown, or other
gagaaaagaaaaggagaaaaagacgctgccttgctaacgaggtgagagagtgttggggccgccgctcttgagggatagaagaagaggatacagcaagcggnggttgcgaggaggcggcgaacgctatgggcaacgcgggagtgcgccggaccagcccaaganctcggcggatggggccggcgctgccgacgcggagtctcgccgcgggccgccgtctacggtgcgtttcttccccgatggggagcgccacaaggcacggcagccgccgccaataaagctcgaggaggaggagggcgtcccgcgccgcccgccaccgaggaggagatggccccgcgcaacctctggcaggtgtatgcgcttggggcgttncattgtgttgagatgggcctgggctaagaggaaggagaaccagggacagaaaggactcacctgatgctggggatnggaatgcaccggacagatcgacttaatctccggttgctgctgcg

SEQ ID NO: 8637 - DNA, 199 bp, Zea mays
  misc_feature: Ceres CLONE 372240-F
aattacaacgacgcaccaccgtccacccaagcgacgccaccgctttaaaatccccgcagccaccgaacggatacaagagctcccccacctcgccccccccatccagctccgaccctagggtttccatccggctcttccggaagcttccgaaaatggccaccgacgagctcgcccacgccgtcgcccccgccccggccgg

SEQ ID NO: 8638 - DNA, 451 bp, Zea mays
  misc_feature: Ceres CLONE 372332-F
  misc_feature: Encodes the peptide sequence at SEQ ID NO. 8639
acacacacaaaaacagcaccagagggatagagagagggcggcagtcacagtcaggcagtctgcaggcatccatggagtactactacgcctaccagcacagcagcagcggcggcttgagctcaaaggagaagaggccgccgctgaagcgggggcagctcaagcggcagatcgtgaggaccatcagcagcctcgtggtgccgaggcacgccgccgtcgctggcgctgctgctgctgctgggtcgagggagaaggaagatcgcggcagcggattcggcggaggacggagctacgactgacgatggatctctcggagaaggcgtgataagagatacgattcccagcgtcagtttgtgtgtacgtactacaactgatgaattagcttcgtagcagttccttttgtataatatgtacatcttgcggaatgaaagcttgttacatttacattgaaaaa

SEQ ID NO: 8639 - protein, 74 aa, Zea mays
  misc_feature: Ceres CLONE 372332-F
MEYYYAYQHSSSGGLSSKEKRPPLKRGQLKRQIVRTISSLVVPRHAAVAGAAAAAGSREKEDRGSGFGGGRSYD

SEQ ID NO: 8640 - DNA, 446 bp, Zea mays
  misc_feature: Ceres CLONE 372333-F
  misc_feature: Encodes the peptide sequence at SEQ ID NO. 8641
acgctcccgcactctctctcaactcattggcagcagcaaccgcagccgcgagggccaagctwggggggacaaggaaaagggccgacgaagagsaaaaaggaagaacgcgtcgcggagccatggggcttggccttggcgtgcgggcggcgcccttcacgtacgcggcgcacgcactggccgtcgcggcggcggccatggttctcgtctggtccatccagttccgcggcgggctcgccatcgagtccaccaacaagaacctcatcttcaacgttcaccctgttcttatgcttatcggttatgttattatcggcggtgaagctataatggtgtacagggtacttccaacatcgaatcatgacacaactaagctgatccatctaattctccacgggattgcacttgtccttggtgcggttggaatatactttgctttcaaaaatcacaat

SEQ ID NO: 8641 - protein, 109 aa, Zea mays
  misc_feature: Ceres CLONE 372333-F
  misc_feature (13)..(109): Pfam Name: Cytochrom_B561 Pfam Description: Cytochrome b561
MGLGLGVRAAPFTYAAHALAVAAAAMVLVWSIQFRGGLAIESTNKNLIFNVHPVLMLIGYVIIGGEAIMVYRVLPTSNHDTTKLIHLILHGIALVLGAVGIYFAFKNHN

SEQ ID NO: 8642 - DNA, 141 bp, Zea mays
  misc_feature: Ceres CLONE 372342-F
aaaagagagagaggagcagcagagagaagagggggaggcagtccagtgtccacgcacgtacgctccacagaagagagatggcgatgcggatggcggcggcggcggcagtggcgctggtggcggtgatgggcgtgctggcgc

SEQ ID NO: 8643 - DNA, 448 bp, Zea mays
  misc_feature: Ceres CLONE 372436-F
  misc_feature: Encodes the peptide sequence at SEQ ID NO. 8644
aaaaacacaagacctcctattcaccatgccgaccgaagagggttccgacggcggtggcggcgccggagccggagccggggagaagaagagctcgcaggcgcccgcaaagcctggagcgtgcggcgccgcaaagttcctcgcggggttgccgtcgcgcggcaacttctcttccggctccgccccctccaatctgggagggttcagggtttacgtctgcgagcacagcacagatcccccagaaggacaagttataaagacggattcaacgaatattttaatcaggcatctccagttgaacaagcagaagactgagggcaaagatgtggattccagaactgtcggcgaaaacaacagagggaaaagatctgctgccagaagtttggatgtcaacaattcagcaaagaaggctaacttgggtacttcatctggatcatcagcctatgaggaa

SEQ ID NO: 8644 - protein, 141 aa, Zea mays
  misc_feature: Ceres CLONE 372436-F
MPTEEGSDGGGGAGAGAGEKKSSQAPAKPGACGAAKFLAGLPSRGNFSSGSAPSNLGGFRVYVCEHSTDPPEGQVIKTDSTNILIRHLQLNKQKTEGKDVDSRTVGENNRGKRSAARSLDVNNSAKKANLGTSSGSSAYEE

SEQ ID NO: 8645 - DNA, 425 bp, Zea mays
  misc_feature: Ceres CLONE 372463-F
  misc_feature: Encodes the peptide sequence at SEQ ID NO. 8646
ggttccggtcagagtcataagccaggtcagactaggttaggatttacctgtgaggcctccttctcccctgccgccgccgccatgggacactccaacgtgtggaactcgcaccccaagaactacggccctggatctagggtttgccgtttgtccgctaacccccacggcttgatccggaagtacgggctcatgtgctgcagacagtgcttccgcagcaacgccaaggacattggcttcatcaagtaccgctgaaacttggggagctccaaagcacggcaataatggaggcacggatggggacctcaaagatagcatgtactcttattcttattataaaaccatgtaatgaattgtttggctttgtgtggacgaagttggtgtattctggatggtactcttgaatcttgatgcttccctgctatgca

SEQ ID NO: 8646 - protein, 56 aa, Zea mays
  misc_feature: Ceres CLONE 372463-F
  misc_feature (3)..(56): Pfam Name: Ribosomal_S14 Pfam Description: Ribosomal protein S14p/S29e
MGHSNVWNSHPKNYGPGSRVCRLSANPHGLIRKYGLMCCRQCFRSNAKDIGFIKYR

SEQ ID NO: 8647 - DNA, 356 bp, Zea mays
  misc_feature: Ceres CLONE 372467-F
  misc_feature: Encodes the peptide sequence at SEQ ID NO. 8648
  misc_feature (180)..(180): n is a, c, t, g, unknown, or other
  misc_feature (181)..(181): n is a, c, t, g, unknown, or other
  misc_feature (183)..(183): n is a, c, t, g, unknown, or other
  misc_feature (201)..(201): n is a, c, t, g, unknown, or other
aacagagcgatcggagctgacgacgatggccgggaaggcggcggccgcgacggcgcgaggtgggcggaggggtacckggaaggagaagctggcaaagtacaagggtgagctcgggaagggggtgtggggatactgggasctcggcgcgtggaagccgctcggcatcagcgctcgcaagcnncnccgcctccgcaagrttgnctcctcgccggcgagtactggagctacgatcctccccgcgggtatatgcktaccaagcgcaagggccacaagtgcgaccgcatctccgccgagaagcgagcaaatactgttgagctggatgaagaagatgccccagatgctgctcgactacaaga

SEQ ID NO: 8648 - protein, 110 aa, Zea mays
  misc_feature: Ceres CLONE 372467-F
  misc_feature (18)..(18): Xaa is any aa, unknown, or other
  misc_feature (38)..(38): Xaa is any aa, unknown, or other
  misc_feature (52)..(52): Xaa is any aa, unknown, or other
  misc_feature (53)..(53): Xaa is any aa, unknown, or other
  misc_feature (58)..(58): Xaa is any aa, unknown, or other
  misc_feature (59)..(59): Xaa is any aa, unknown, or other
  misc_feature (76)..(76): Xaa is any aa, unknown, or other
MAGKAAAATARGGRRGTXKEKLAKYKGELGKGVWGYWXLGAWKPLGISARKXXRLRKXXSSPASTGATILPAGICXPSARATSATASPPRSEQILLSWMKKMPQMLLDYK

SEQ ID NO: 8649 - DNA, 469 bp, Zea mays
  misc_feature: Ceres CLONE 372475-F
  misc_feature: Encodes the peptide sequence at SEQ ID NO. 8650
gaggtccgaaggcccaacaggcctaaacctagcccaatctgtccgttcagcccgtccgcgggccagagtcgcgcgactggagtaccgcggcggcgaaccaaagcgaaggcggcgaacggaaagccgcctggcgactccagatctctccggcctgctcctcggctcctcgctcctcctgcgccgccgcggaggcagatacaccctctggatcaagccccgctgcatctcagctgtggcttcctgcaggctggggactttggctgcttcctgcaggctggaggagtttctgaatggccaatcccaggcatgcggtggacgtcagctcctccatgtcggagctgaccgtagaagcagcgccttcatcgattgaggcccaagtcccccagcaggctaatggcggcgttgttgctgctgccgaactcgatgatgtatgggaggatgtttcaggttctcctcagcacgcggatac

SEQ ID NO: 8650 - protein, 59 aa, Zea mays
  misc_feature: Ceres CLONE 372475-F
MANPRHAVDVSSSMSELTVEAAPSSIEAQVPQQANGGVVAAAELDDVWEDVSGSPQHAD

SEQ ID NO: 8651 - DNA, 518 bp, Zea mays
  misc_feature: Ceres CLONE 372491-F
  misc_feature: Encodes the peptide sequence at SEQ ID NO. 8652
gcacgcaagggcaatttggtcttgttacggaacagaagagatatggttcccgggctccggcgacgagaggtaggcagaatcctttgccaaatcaacgccagcaacagcaaagcaactacagagagtaggagatgcttactctccacaccattcagtcatgcccctcgctgcgcagatcctctctgttccggcgtgctctgctaggcaggaagagatctttcatttctgccagcagttctgaggatgccgaatccggcactcccccgccgcttggtggcgacaaacaccagcaggaggttcttgcacagatcgccatgcttcagtacgcagaaggtgcgcatcacagacttcttggacgagcgctctgcttacctgaccaagttcgccaaggacgccgactcggagttcgacctgattgggcagaacgccatgawagaacttgatgcygttggtgaccagatactggagaggctcgacagcaagatgcaagccttcgagggagasggctgaggtacaac

SEQ ID NO: 8652 - protein, 88 aa, Zea mays
  misc_feature: Ceres CLONE 372491-F
  misc_feature (64)..(64): Xaa is any aa, unknown, or other
  misc_feature (87)..(87): Xaa is any aa, unknown, or other
MPNPALPRRLVATNTSRRFLHRSPCFSTQKVRITDFLDERSAYLTKFAKDADSEFDLIGQNAMXELDAVGDQILERLDSKMQAFEGXG

SEQ ID NO: 8653 - DNA, 500 bp, Zea mays
  misc_feature: Ceres CLONE 372513-F
  misc_feature: Encodes the peptide sequence at SEQ ID NO. 8654
aggacttccgctttggcaggaccgcaggaggcccagcccgactagggttctgtccaccttccaggtccttcgaacttccacgcattcctactactcctggctcccgcgacctaacgccgccactcctgacttcgccatccggcgatcaccagagccctagctccggcgtctctagcgatccccaaaacccactccgccgcatttctgccgacttggccggattggtcgcttattgaaatggctacgccacttatagcaggacttgcagttgcagcaactgctcttgctggtcgatatggtgtccaagcatggcaagcttataaggcaaggcctatagttccaaggatgcgcaaattctatgaaggtggctttcaacctacaatgaaccgaagggaagctgcattaatccttggtgtcagggaaactgccaacgcagagaaggtaaaagaggcgcacaagagggttatggtcgccaaccatccagatgctggtggaagtca

SEQ ID NO: 8654 - protein, 87 aa, Zea mays
  misc_feature: Ceres CLONE 372513-F
MATPLIAGLAVAATALAGRYGVQAWQAYKARPIVPRMRKFYEGGFQPTMNRREAALILGVRETANAEKVKEAHKRVMVANHPDAGGS

SEQ ID NO: 8655 - DNA, 1040 bp, Zea mays
  misc_feature: Ceres CLONE 372574
  misc_feature: Encodes the peptide sequence at SEQ ID NO. 8656
cttttttttctctcatccgaattcccaggcaggcaggtcggcgaggagggcaggaagaccgaagaccgagccgtgcgggggctcgggacgggaacgggacaggaccccaaaatctcagatccttcctgcccgcccgcccgtgcccgtcgacgcgtcgttcttgccggccgccccccacctccgccctctcctcctccagggggatcggatacgccacaggctgcgcgatggtgctgtgggtcttcggctacggctccctcatctggaaccccggcttcgacttcgacgacaaaatcctcggcttcatcaagggcacctttaatctcgcttgcattgaccacagaggcacaccggagcatccggcgaggacctgcacgcttgaaaccgacgacgaggccatatgctggggaattgcatattgtgtcaagggtggtccagaaaaagagctaaaagcaatgcagtacttggagagaagagagtgtgagtacgaccagaaaatatccattgatttctacaaggaaggagatcccttgaaaccagctgtgacgggcgtcttagtgttcgtttccactccagatccaattggcaacaagtactatcttggccctgctcctctgcaggatatggcaaggcaaattgctacagccaatggccctactggctataatagggattacctgttctcaatggagaaggcattagccagcattagccacgaagatgattcgatcatagagcttgcaaacgaggtgaggaaggtgctcaacagaacaaaggagaccaagatcactggtgccaatgcttccctgaaatcacatgcccctcttgtgcacctgtccgcgcttccagaaggcaccgttgtggactcgagatagcgacctctactcggaatttactttcagctcttgcatgtttgtggttgtggccatcatgtactgattttcccttttcaacagttgtcgtgaggctgtatcgtctggagtaaaaaaaaatgctaaaagccggcactaataatgatattaaccaaaaaaaaaaaaaaa

SEQ ID NO: 8656 - protein, 215 aa, Zea mays
  misc_feature: Ceres CLONE 372574
  misc_feature (3)..(178): Pfam Name: ChaC Pfam Description: ChaC-like protein
MVLWVFGYGSLIWNPGFDFDDKILGFIKGTFNLACIDHRGTPEHPARTCTLETDDEAICWGIAYCVKGGPEKELKAMQYLERRECEYDQKISIDFYKEGDPLKPAVTGVLVFVSTPDPIGNKYYLGPAPLQDMARQIATANGPTGYNRDYLFSMEKALASISHEDDSIIELANEVRKVLNRTKETKITGANASLKSHAPLVHLSALPEGTVVDSR

SEQ ID NO: 8657 - DNA, 451 bp, Zea mays
  misc_feature: Ceres CLONE 372617-F
  misc_feature: Encodes the peptide sequence at SEQ ID NO. 8658
aaacctagcgggtgcagaccttggtgggggagcgaggagtcgaaacaagaaccatgagtgaaacagggcacactgtacaagtcactaacctctcgagcagagtatctgaaagtgatctttatgagttctttttgttctctggccctattgaacatgttgaacttatcagatcaggagaatacggtgctactgcttatgtgacattcaaggagcgctttgccttggaaactgcggtattgctcagtggggctactattgtggatcagccggtatgcataacttattggggacaacctgaggagacttttaatttctgggacaggccaacttgggaggttgaagaggaaattgaatacacgagctatcaatcatgccagtacaacactactccgcagaagctcttacagtggctcaagatatcgtgaagacgatgctagcaaggggtacgtgc

SEQ ID NO: 8658 - protein, 123 aa, Zea mays; identical to SEQ ID NO: 1471
  misc_feature: Ceres CLONE 372617-F

SEQ ID NO: 8659 - DNA, 235 bp, Zea mays
  misc_feature: Ceres CLONE 372621-F
  misc_feature: Encodes the peptide sequence at SEQ ID NO. 8660
aaagaatcaggttgtagaaattgtattgggtttagggtttagtgttgagcagggtgttttcagaaaaaaaaaaagaataggagagtgtgggagggccggatgaaggggtaaatcgcgaatttctctgcttgcttgagaccacagcagtcgcaactcccaactcaggtcaggtgaggggtaggtgaagtgggaaggcgcgcggaggggaggagaggagaggaggatggctgcggca

SEQ ID NO: 8660 - protein, 33 aa, Zea mays
  misc_feature: Ceres CLONE 372621-F
KNQVVEIVLGLGFSVEQGVFRKKKRIGECGRAG

SEQ ID NO: 8661 - DNA, 474 bp, Zea mays
  misc_feature: Ceres CLONE 372624-F
  misc_feature: Encodes the peptide sequence at SEQ ID NO. 8662
agagctggctagctagtaggctcctcccctccccctcacctgttcgtctgttccccattctacaatacagctcgcaagggatcgcgttcacccctcagccgaccggctagcagctagaccttcaggaccttgctgcattcccccatgggaggcgccatgaggcagctgctacgctttctgggagcgagcaatggccgccccagggagaagaagacgaagaggacgacgctgcggcggcgcctgctggtgcccacggtggagctcagggtcaggatggactgcgagcgctgcgagcgcgaggtcaagaaagcgctctccggcatcagaggagtggaacatgtggaggtgaacaggccgcagcagaaggtcacggtgactggcgaggtggacccggtggcggtgctgcggagggcccagtccacgtggaagaaggcggagccatggcgggagcyggggcacgaccaggacactgcc

SEQ ID NO: 8662 - protein, 110 aa, Zea mays
  misc_feature: Ceres CLONE 372624-F
  misc_feature (39)..(99): Pfam Name: HMA Pfam Description: Heavy-metal-associated domain
  misc_feature (103)..(103): Xaa is any aa, unknown, or other
MGGAMRQLLRFLGASNGRPREKKTKRTTLRRRLLVPTVELRVRMDCERCEREVKKALSGIRGVEHVEVNRPQQKVTVTGEVDPVAVLRRAQSTWKKAEPWREXGHDQDTA

SEQ ID NO: 8663 - DNA, 453 bp, Zea mays
  misc_feature: Ceres CLONE 372684-F
  misc_feature (259)..(259): n is a, c, t, g, unknown, or other
cctggcgagccgcggctacagtatagccaccgcaacaccgcatctcaagcgcaagacctcctcgcggctatggcgaacgtctgatcccgtcgctgaactgggttctggtggagaagctgctgaagcccagcaagagcgccggcgcatcctcctcccggagaccaccaagcagctgtacgccgctaaagtcgttgctgttggccctggtgatcgtgatagggatggcaagctgatccctgtatctctgagcgaaggcgancactgttctgcttccggagtacagtgggacagaagtaaagcttgcagaaaaagagtaccttcttttcagagagcacgacatactggggaagctcgaggagtagctctggactgttaaratggagttgtttgaaagtaggtatgcaagagttttgccacggcttatcttttttttttgtacgggggaacaaatga

SEQ ID NO: 8664 - DNA, 418 bp, Zea mays
  misc_feature: Ceres CLONE 372687-F
  misc_feature: Translation starting site: 60
ctatataaaccgaccccaacgcatccattatattcagcttcttgatctcacacgaaggcatggcggagatccagggctactacgatgacggcaccgcstgggtgtcgttcgacgtgcacaacatcgamaccacgctgacgaacttgggcagcgtggtgagtggtggctgggtgagacctatcgcctccaccaccgcggccacatcgccggcctcgacgtggagtggcgccccgctcgcgtgccgggccccgtccccgcgccgtgctgcagatctgcgtcgaccaccgctgcctcgtattccagatcctccaagccgactacatccccgacgccctgtccaggttcctcgccgaccgccggttcaccttcgtgggggtcgggatcagcggcgacgtcgcaaagctgcgggccgggtaca

SEQ ID NO: 8665 - DNA, 463 bp, Zea mays
  misc_feature: Ceres CLONE 372690-F
  misc_feature: Translation starting site: 161
cttccactatcatatcgccggctagcttataaatactctccggccgtgacccctgctcaccaccatctccactattgctagtagatagtaagtagatcacgcagcgcagtagctctggattaattaataataattgctcgtgcgtgtgtccagagccgccatggctgcccatgtggacccgctggttgtggggagggtgatcggcgacgtggtggacttgttcgtgccgacggtggccgtgtcggcgcgcttcggcsscaaggacctcaccaacggctgcgagatcaagccatccgtcgccgcggccgctcccgccgtcctcatcgccggcaggccaacgacctcttcaccctggttatgactgacccagatgctccgagccctagcgagccaacgatgagggagttgctccactggctggtggttaacataccaggtggagcagatgcttctcaaggcggtg

SEQ ID NO: 8666 - DNA, 496 bp, Zea mays
  misc_feature: Ceres CLONE 372712-F
  misc_feature: Encodes the peptide sequence at SEQ ID NO. 8667
aagggtttatctcacgccgcaacctccctcgagcccgagcaaacaagggcggacgcggagccggcggcggagcggagatggcggagaagaagcgaggagccggcactcgcaaggatgaagtggtgacacgcgagtacaccatcaacctccacagaacgcctccacggatgcaccttcaagaagaaggcaccaaatgccatcaaggagatcaggaagttcgctcagaaggccatgggtactactgatgtccggattgacgtgaagctcaacaagcacatctggagcagtggtatccgcagtgtgccgaggcgtgtccgtgtcagaattgcccgcaaccggaatgatgaggaagacgccaaggaggaactctactccctggtcacagtagctgagatcccaccggagggtctcaaaggtttggghbactaaggttgttgaggatgaggattaagccctgtataccatgagataaatttgagaatgttgcttcagctta

SEQ ID NO: 8667 - protein, 64 aa, Zea mays
  misc_feature: Ceres CLONE 372712-F
  misc_feature (1)..(54): Pfam Name: Ribosomal_L31e Pfam Description: Ribosomal protein L31e
MGTTDVRIDVKLNKHIWSSGIRSVPRRVRVRIARNRNDEEDAKEELYSLVTVAEIPPEGLKGLG

SEQ ID NO: 8668 - DNA, 1174 bp, Zea mays
  misc_feature: Ceres CLONE 372747
  misc_feature: Encodes the peptide sequence at SEQ ID NO. 8669
ggtttggatagaacactctgcttccccgtccttcggtctagcccgagtggacgtaggaagggacgaggggtcttgacgccggcgagccatggcgggggctctcctctcctctccgcacactctcccgagccccacatctcagtccccgttccgccccaggagcaggggaccactccacgctggggcagcgcgtgttctgccaccgaggaggagggcctttgtgctcgcttcgtgctctcgcgagcctgccgctaggaaccgcgggttggaggtggagaggaggcgccttctcatgtccgggctcgtgtcttctttcgcaatcatgctccccatttcagaagcatatgctgtcatggagactgatgaagacgtgaagatgaacacacaaattgatgagatcaatgcatactcttttctttacccggtggaactgccagggaagaaatttgccttcaaatgggtagagtccagaaaaccagagcgatattcctctgcagcgccactatcgcctgatgcaaggcaacgtatcgtatcagagcgagttgacatgatacacaatgttgtcatctcggtctcgattgggccaccgaattcacgttttttgccttcaaaagacaagagctcgtgggatccaaaagatgttgctgattgcattttatctgatagatctaccatgaaggtgacaactggccagcgcatgacagagagttctgtccttgacgcacacgttgcagaggttgatggagaaccatactggtattatgagtatcttgttcggaaatcaccaacaaaatctgcaccagaaccaaatttgtttcggcacaatgtagcctgcactgctgagcgtgatgggtacctgtactcactgaatgcttccactcttagcaaacagtgggaatctatggggccctttctacaaaagaccgtggcatcctttcgccttctccccggtacagaaaactatgttcctccctacaaggatccttggagattttggtgaatggagattcttcttgtagycatcatttttatcccttcagakgactttatagcttcaggttttagaccatatttttcacgtcagatgtttagtgagtgtctgtcctttcagcttgacagataaaatcaggagmcccagtttggtatcagtttcgccaaaaaaaaaaaaaaaaaa

SEQ ID NO: 8669 - protein, 303 aa, Zea mays
  misc_feature: Ceres CLONE 372747
MAGALLSSPHTLPSPTSQSPFRPRSRGPLHAGAARVLPPRRRAFVLASCSREPAARNRGLEVERRRLLMSGLVSSFAIMLPISEAYAVMETDEDVKMNTQIDEINAYSFLYPVELPGKKFAFKWVESRKPERYSSAAPLSPDARQRIVSERVDMIHNVVISVSIGPPNSRFLPSKDKSSWDPKDVADCILSDRSTMKVTTGQRMTESSVLDAHVAEVDGEPYWYYEYLVRKSPTKSAPEPNLFRHNVACTAERDGYLYSLNASTLSKQWESMGPFLQKTVASFRLLPGTENYVPPYKDPWRFW

SEQ ID NO: 8670 - DNA, 518 bp, Zea mays
  misc_feature: Ceres CLONE 372826-F
  misc_feature: Encodes the peptide sequence at SEQ ID NO. 8671
ctgttctccaccagccccggaggtcgacacgtgcgccacaccatagggcagggcccagggagcccggcgacctccatctccatggccgagtgcgaggagctggtggagagcggcggcgccgaggaggacatgccccgcgtcgtggccgccctcgccggcatcctggagcgcgtcgcgaaccgcaacgacgcggcggcggccgcggaggtctcggccgtagccccggcgtcggcgttccgggcgacgacgaagccgggcatctcggtgcgcgcctacatggcgcgcatcgcgcggttcgctgggtgcagccccgcgtgctacgtcgtggcctacgtctacctggaccgcctcctgcgccgcggccgcctcctggcgctcgccgtcgactcctacagcgtgcaccgcctcctcattaccgccgtgctcgccgccgtcaagttcatggacgacatatgctacaacaacgcctacttcgcaaagtccggggcatcagcctggtggagatgaactacctggag

SEQ ID NO: 8671 - protein, 141 aa, Zea mays
  misc_feature: Ceres CLONE 372826-F
  misc_feature (18)..(136): Pfam Name: Cyclin Pfam Description: Cyclin
MAECEELVESGGAEEDMPRVVAALAGILERVANRNDAAAAAEVSAVAPASAFRATTKPGISVRAYMARIARFAGCSPACYVVAYVYLDRLLRRGRLLALAVDSYSVHRLLITAVLAAVKFMDDICYNNAYFAKSGASAWWR

SEQ ID NO: 8672 - DNA, 437 bp, Zea mays
  misc_feature: Ceres CLONE 372829-F
  misc_feature: Encodes the peptide sequence at SEQ ID NO. 8673
ctcttcccacttcccagtccccaatcgcgttctcttcctggccgacatggcggccgccaccggctacagcgacgccccaaccgacgagcaactgctggcgtactctgagctgcccatacatggccgcgacatggcggaggtgttcgccgtgcgcatcccggccatcgccggaggagacccgccgccccgtggcatcatctctttctacggcggccactgctgcagcgatttcatttacagctggaactcactggaagaggaagaagacacctcgaagcaaacctgcgacagccagggtaacctcgtgctaactgggccatcaatggccacctcggcagaaagtccaattgccttcaccttctacctccatgatggcagcccgcaagccggagaagccgctgaggacgacgaggacatcgggaggataatctgcgact

SEQ ID NO: 8673 - protein, 130 aa, Zea mays
  misc_feature: Ceres CLONE 372829-F
  misc_feature: SWISSPROT Homolog: EC 3.2.2.22 rRNA N-glycosylase
MAAATGYSDAPTDEQLLAYSELPIHGRDMAEVFAVRIPAIAGGDPPPRGIISFYGGHCCSDFIYSWNSLEEEEDTSKQTCDSQGNLVLTGPSMATSAESPIAFTFYLHDGSPQAGEAAEDDEDIGRIICD

SEQ ID NO: 8674 - DNA, 428 bp, Zea mays
  misc_feature: Ceres CLONE 372837-F
  misc_feature: Encodes the peptide sequence at SEQ ID NO. 8675
acccctagacaaaggaaaaaaaccaacacactctcgcttgcggcaagaatttccctgcccgaaatcgaaagcacccgcaccaatctctgcgtctcttcgtcttcggctgcgcggcgggcggcagcagcggaggaggttgaggagatgctgtccggcgacatccccccgaaccagaccatctacctcaacaacctcaacgagaaggtcaagaaagaagaattgaagagatcgctttatgccttgtgctcacagtatggaaggatactggatgtggtggccctgaaaacacaaaaattgagagggcaagcatgggtggcgtttagcgaaattacagctgctaccaatgctttccgtggattgcaagatttcgatttctatggcaaaaaaatgcgagtacaatatgcaaaaacaaaatcagactgtattgc

SEQ ID NO: 8675 - protein, 94 aa, Zea mays
  misc_feature: Ceres CLONE 372837-F
  misc_feature (12)..(84): Pfam Name: RRM_1 Pfam Description: RNA recognition motif. (a.k.a. RRM, RBD, or RNP domain)
MLSGDIPPNQTIYLNNLNEKVKKEELKRSLYALCSQYGRILDVVALKTQKLRGQAWVAFSEITAATNAFRGLQDFDFYGKKMRVQYAKTKSDCI

SEQ ID NO: 8676 - DNA, 453 bp, Zea mays
  misc_feature: Ceres CLONE 372877-F
  misc_feature: Encodes the peptide sequence at SEQ ID NO. 8677
  misc_feature (445)..(445): n is a, c, t, g, unknown, or other
aagaaaaaaaaaaggtccctcgttcagtcgttcctcaacctacctccgctgctccgcgctcgaccgcytttgcytgcyttcccattcccccgtctcctcttcccttccgccatggcccagcccgctttcctctcctctctccgctcccgccttctgctccgcgccgccgcccccgccgaaccatcgccttccagcctaggcgcggctaccacgtcgagctcggggctcgcgaaataagcgcttttggaggaggatgttgctttgaagaggttcaawtcatacaaaaacagtgtgaaaaggtctccaagatcgggaatgctctcactttagctgttgtacttgcttgmagctacgagcttgctgtgttggcgactagcacaaattgaaggaaaaytcggtcatgtggggggmacggttattccgggaagtgatccatcagcatganctggcact

SEQ ID NO: 8677 - protein, 41 aa, Zea mays
  misc_feature: Ceres CLONE 372877-F
MAQPAFLSSLRSRLLLRAAAPAEPSPSSLGAATTSSSGLAK

SEQ ID NO: 8678 - DNA, 343 bp, Zea mays
  misc_feature: Ceres CLONE 372879-F
  misc_feature: Encodes the peptide sequence at SEQ ID NO. 8679
acacaaccaagctcgatccatctcactctccgctggtcgctcactcttgcagctccacccttcactcagtcttagtctcttattagctctaggctctagctagccgcgccactccttcgtgtagccatcagccttctcatcgccaccaatggccactgccgaggtccagaccccgaccgtcgtggcggccgaggaagcgcccgtggtggagaccccgccgccggccgtcgtgcccgaggagtctgcccccgccgaggccgaggccgaggccgaggctgctgctcctgctgatcccgaggagcttcccgcggccgagcagcaggcagccgccgaggcggaggcc

SEQ ID NO: 8679 - protein, 65 aa, Zea mays
  misc_feature: Ceres CLONE 372879-F
MATAEVQTPTVVAAEEAPVVETPPPAVVPEESAPAEAEAEAEAAAPADPEELPAAEQQAAAEAEA

SEQ ID NO: 8680 - DNA, 474 bp, Zea mays
  misc_feature: Ceres CLONE 372888-F
  misc_feature: Encodes the peptide sequence at SEQ ID NO. 8681
agagagaataaaagcagcggcagtgggcagaggcgagagggcactcgactcctccagcgtccaacgccatccatcccgacctcgcaacgcaagcaaagaaagcccaggcaggcgtgtgcacggcgcggcggggcaaccaagggtgggtgaacccgcagagaggggcagctagcttccttccttcccaggcgcgcgggagagattagccgcagtataagtagccagccagccagccatgtcgtcggtgtcgtcgtcgctgaccaacttcctgctctgctgcttctacccgtcatccgccggccaccaccgcggcggcgcctactactacagcagccacccgatgagcgccagcaccctgcactaccacgagggcaccttcgccgggcgcagggccatgggccggagcagcaggccgctgtcgctgcagacggtggagctgaaggtgcgcatgtgctgctcgggctgcgagcgcgt

SEQ ID NO: 8681 - protein, 79 aa, Zea mays
  misc_feature: Ceres CLONE 372888-F
MSSVSSSLTNFLLCCFYPSSAGHHRGGAYYYSSHPMSASTLHYHEGTFAGRRAMGRSSRPLSLQTVELKVRMCCSGCER

SEQ ID NO: 8682 - DNA, 451 bp, Zea mays
  misc_feature: Ceres CLONE 372924-F
  misc_feature: Encodes the peptide sequence at SEQ ID NO. 8683
acataacacatctggtaagcgagcaccgagcagcaggtggtctcaacggtcgacgcgacaactttccttgtccatgcagcagatcactcgtcgtacgttccctatgctggctcctcctcggctccccctcgtcggggcgctcctgctgctcctcgccgtcgcgctcggcgcggtgccgtgcgagagcgccgcgctccgcctccgcggctccgtcgcctgcctcgactgcgacgaggaacacgatctctccggtgtggtcgtggcggtgaaatgcgccggcgacggcgacggcggcgcgggcctccacgcggcgcagaccgacgatcgcggcaacttcgacgtgaccgtgccagcagaagcgtcagcctcgggcgcgccgtgcgcggccagggtcctcggcgccacggagcagctctgcgcgctgtggggactcacggtcgcgcgcgtcgtc

SEQ ID NO: 8683 - protein, 126 aa, Zea mays
  misc_feature: Ceres CLONE 372924-F
MQQITRRTFPMLAPPRLPLVGALLLLLAVALGAVPCESAALRLRGSVACLDCDEEHDLSGVVVAVKCAGDGDGGAGLHAAQTDDRGNFDVTVPAEASASGAPCAARVLGATEQLCALWGLTVARVV

SEQ ID NO: 8684 - DNA, 428 bp, Zea mays
  misc_feature: Ceres CLONE 372987-F
  misc_feature: Encodes the peptide sequence at SEQ ID NO. 8685
atagaaggtccgagccaaccagaccaaactcccctgaaccagaccaccagcaaaaacccgttcacctcacaggttgcgttgcgatccggtgattgaaggcctcatcccgctgctctacaaggccatcaaggaccggcggagcaacgccggcggcggtgggcgatcctaccgcagcggaggtgccctcctctcctccgcgcccgtggacctggacgaccccgagcagaggaggcggtggctgcagcaggagctgcggtccccggtgcacgtgggccacacccacacggcgagggcggcggcggcggccgaggggtcgccgctgcaccggcggaacctgtcgcttgaggagctggcgggcgaggtggggctctcgcccgaccggcggctccgggtgccgctgcccaaggccaggagcgtccgcgccttcg

SEQ ID NO: 8685 - protein, 31 aa, Zea mays
  misc_feature: Ceres CLONE 372987-F
IEGPSQPDQTPLNQTTSKNPFTSQVALRSGD

SEQ ID NO: 8686 - DNA, 492 bp, Zea mays
  misc_feature: Ceres CLONE 372993-F
  misc_feature: Encodes the peptide sequence at SEQ ID NO. 8687
atggatggcccatgaaaggcgagcctgcctcgtcggccgtcgtcccttttggcatttcacaaacgcagagacgtttctccgcctccccgctcctcaccgccgcgccgcctcgtccactgcctcagccgcatcaattgatcccggaccacgcgaatggccgctgaagactcaaaagatatcctaaagaagcgtctcccaaagaaaatcagagaagtccctgactgctattttctccctcgtcgatcatggccttctgcactggcaatctacggtgctgtatgtgctgctagctttggtgcagggatgcttcttgaggtttggataaacaaaaagatcaaagaggacagtggcattatctgggagatggataaatgatgcaatgcatgctttgttgtggtgaatcccgcgttgtcatcatggacacagctagctctgaagatttctggtggaaattgacacagccttgtttctgtatctggatctattatgcat

SEQ ID NO: 8687 - protein, 73 aa, Zea mays
  misc_feature: Ceres CLONE 372993-F
MAAEDSKDILKKRLPKKIREVPDCYFLPRRSWPSALAIYGAVCAASFGAGMLLEVWINKKIKEDSGIIWEMDK

SEQ ID NO: 8688 - DNA, 482 bp, Zea mays
  misc_feature: Ceres CLONE 373007-F
  misc_feature: Encodes the peptide sequence at SEQ ID NO. 8689
tgaatgtcagtcatgaagaaatcgacgtcagccatcctgatttcttagcagcgctaagctgaatggatacaccccacccaataaagaggactgtggacagccaggattcaccccagcagagagacggcgttttggcaacatattattccaaggaaagctggtagatgcttacaggcacctgcacaaagaaaaggacatagacggtggcttctcttggtccggtcatccaattggcaagtaccgaggaaagagaatgaggatcgactacttccttgtttcggaacagttaaaggacagaatagtttcatgtgaaatgcatggccgtggcattgaattggatggattttatggaagtgaccactgccctgtttcgcttgagctttccgaagctgtagcagaagcaccaggacagcccaagccatccatctaaatatatttkcggtccttcattaaacctgactgttccatgcatttgcctactc

SEQ ID NO: 8689 - protein, 58 aa, Zea mays
  misc_feature: Ceres CLONE 373007-F
  misc_feature: SWISSPROT Homolog: EC 3.1.11.2 Exodeoxyribonuclease III
MRIDYFLVSEQLKDRIVSCEMHGRGIELDGFYGSDHCPVSLELSEAVAEAPGQPKPSI

SEQ ID NO: 8690 - DNA, 482 bp, Zea mays
  misc_feature: Ceres CLONE 373017-F
  misc_feature: Encodes the peptide sequence at SEQ ID NO. 8691
  misc_feature (457)..(457): n is a, c, t, g, unknown, or other
ctatccacaaacaggggacaaggaacaggggacaggcacagccgcacagccgccgccgctccatccacctctccacaccatctgacgctgcttccaccgaggtctccaaggctcactcctcaccagcttctgctctctccctcctcatctctgctctgctctggaccgttaactctccagctccccctcgctccgttcccttccgcccaaatcaccgggaccaccaccgccttcttcaagatcggcgggcgggcaccggccggcgatgacatccaccgtcaccacaaccgttgggtgcggggggctccccgtccgcccgttgtcgacagcgaccagaggacgcccacgcagatgcgccgtccgagcccaggccgcgggagcggatgcctccaatgataagtcagtggaggtcatgcgcaagttctccgagcagtacgcccgccgctccaacactttnttctgcgccgacaagacagtcactg

SEQ ID NO: 8691 - protein, 72 aa, Zea mays
  misc_feature: Ceres CLONE 373017-F
  misc_feature: Functional homolog of the protein sequence given in SEQ ID NO 96867
  misc_feature: Useful for making plants with high aluminum sensitivity
  misc_feature: Useful for making plants with modulated high pH sensitivity
  misc_feature: Useful for making plants with modulated low iron sensitivity
  misc_feature (64)..(64): Xaa is any aa, unknown, or other
MTSTVTTTVGCGGLPVRPLSTATRGRPRRCAVRAQAAGADASNDKSVEVMRKFSEQYARRSNTXFCADKTVT

SEQ ID NO: 8692 - DNA, 482 bp, Zea mays
  misc_feature: Ceres CLONE 373059-F
  misc_feature: Encodes the peptide sequence at SEQ ID NO. 8693
tccccgctccccccgccccttctcgtcgccacgagtgtgtgctagggttccggcgtccggcgcgggcggtggcggccattccgatggaggcggatacggggtgtcggttggaggtggacgacgtcctctccttcgccgacgacctcgtcgtagtgctccgccgcagcgacgacgccgacgccaacgcgcaggtgatcgcgggcgcggggttgctgcggaccgcctgccgctccgagtccgaccacctccacctgcagctgaaagattatcagcaaaagatatgctcctgcaaggacaggacagacaaagcaaaagctgaaacgattgctgctgatgaactgagtgtactgcaaaataaaatggaagaaaatcttcaggaagataaacaacttcgtgaagaattgagataagttgttgctctagcattggtattgcctgaaaagttgcatattagaacagatattttgagttatatgctatga

SEQ ID NO: 8693 - protein, 108 aa, Zea mays
  misc_feature: Ceres CLONE 373059-F
MEADTGCRLEVDDVLSFADDLVVVLRRSDDADANAQVIAGAGLLRTACRSESDHLHLQLKDYQQKICSCKDRTDKAKAETIAADELSVLQNKMEENLQEDKQLREELR

SEQ ID NO: 8694 - DNA, 437 bp, Zea mays
  misc_feature: Ceres CLONE 373061-F
  misc_feature: Encodes the peptide sequence at SEQ ID NO. 8695
  misc_feature (56)..(56): n is a, c, t, g, unknown, or other
  misc_feature (57)..(57): n is a, c, t, g, unknown, or other
  misc_feature (131)..(131): n is a, c, t, g, unknown, or other
acgatcaaaaacaaaaccaagctccaagcacccatagccacacaccacaccaagtnnagcaaggagctcgatcgacagcaacagcggccttcatgaactccagcttcatcgggctcaagccgctgcggcanrcccaggccaccgcggctgcctcatcgccgatgaagcagcaggtgcaggtcgcgcccgagggccgccgcgccgsctgctcggcctggcggcttcttcgccgccgtcaccgccaccacggccggatcagccaaggctgaggtcttcgacgagtacctcgacaagagcaagggctaacaaggasctgaacgacaagaagagggctggccaccagcgctgccaactttgcgcgcgcctacacagtcgagttcggcagctgccagttcccctacaacttcactgggtgccaggacctcgccaagcagaag

SEQ ID NO: 8695 - protein, 58 aa, Zea mays
  misc_feature: Ceres CLONE 373061-F
  misc_feature (13)..(13): Xaa is any aa, unknown, or other
  misc_feature (14)..(14): Xaa is any aa, unknown, or other
  misc_feature (38)..(38): Xaa is any aa, unknown, or other
MNSSFIGLKPLRXXQATAAASSPMKQQVQVAPEGRRAXCSAWRLLRRRHRHHGRISQG

SEQ ID NO: 8696 - DNA, 441 bp, Zea mays
  misc_feature: Ceres CLONE 373078-F
  misc_feature: Encodes the peptide sequence at SEQ ID NO. 8697
gacatcccatatcgccaagtccccttcgtcgtccccttccctcgcctcgcgttaggtagcctgcttccgacccgcacatctccctccggttctcgccatgggcgccggcgccaacaaccacgaggagtcgagccccctcatcccagctgcggttgccgcccccgcggacgagaagcccccgcaggctccggcgccggaggccgccaattactatgccgacggggtcccggtcgtgatgggcgagcccgtgtcggcccacgccttcggcggcgtcccgcgggagagctggaactccgggatcctctcctgcctcggccgcaacgacgagttctgcagcagcgacgtcgaagtgtgtcttcttggaacggtagcaccatgtgtgctctatggtagcaatgttgagaggcttgctgctggacaaggcacatttgcaaacagctg

SEQ ID NO: 8697 - protein, 114 aa, Zea mays; identical to SEQ ID NO: 8300
  misc_feature: Ceres CLONE 373078-F

SEQ ID NO: 8698 - DNA, 479 bp, Zea mays
  misc_feature: Ceres CLONE 373085-F
  misc_feature: Encodes the peptide sequence at SEQ ID NO. 8699
aaaaaactcccaaacaggacctgttgaactgtccttgcttctaaacggagtgagtagcgatagtgacgcagtcgtcttgccgccgccgtcccaaacgtccgcgcggtcgtcctcgatcttcccgtaccatcccgacgcgatggccgccggcgcgaagcccgataccgccgcgcccccgcaagcgccttcggcggcgaagggggtcttcatgcgccgcatcttccccttcctcctcgcgacgaacgtcttcatcggagtttatgtatttgccaagacctacaaaagagaccaggaaaagaaaaatgctcagactactgccgctgcagcattgtcatccccagcaagtacatctgccgaggctccagatcctgctcctgcacctgcgcccaaatcggttctcccacctctatccgaagatgagcagtggaatctgtacaaatggattctggaagaggagcggaagatcaaaccacgcaacg

SEQ ID NO: 8699 - protein, 113 aa, Zea mays
  misc_feature: Ceres CLONE 373085-F
MAAGAKPDTAAPPQAPSAAKGVFMRRIFPFLLATNVFIGVYVFAKTYKRDQEKKNAQTTAAAALSSPASTSAEAPDPAPAPAPKSVLPPLSEDEQWNLYKWILEEERKIKPRN

SEQ ID NO: 8700 - DNA, 646 bp, Zea mays
  misc_feature: Ceres CLONE 373145-R
  misc_feature: SWISSPROT Homolog: EC 1.2.3.4 Oxalate oxidase
  misc_feature (604)..(604): n is a, c, t, g, unknown, or other
  misc_feature (646)..(646): n is a, c, t, g, unknown, or other
cgattgggtaccgggccccccctcgaggtcgacggtatcgataagcttttttttttttttttttgctggcttgctttttttgaatttttatttgatattttcatggtttgttttctttttattaggaccccacggaaaactttcccttgaaatattccccgacctctgtctccacccgaagtgtcttgcccaccctcggttttgggggggctgggttgcaaccttcccccctggggggaatgaaaaccatgccggggttccgggtggtgaatgagacaaccttgttttcctcaggtcttaccgactctgcaactggaagatgcatgcacgccccaaagctatgattgaacgactcgccagcgagaaacaccctgggagaatatcttgtttccagacggaaggctaccaaggattcccacgagaaactctctctttcatcaccatacagatctccttgcctgggggaaagatgtttcaagaaatttgtgacccccgaccacgaagtccccaagattcatccatgggccccacccgtgcctacaggcccacttagccaccttccagaccttcccccccaaaacgttcgggggcgacgtgctgcaanccttggctctgttgcacaagaacagaagtcctcgccggcctn

SEQ ID NO: 8701 - DNA, 882 bp, Zea mays
  misc_feature: Ceres CLONE 373156-R
  misc_feature (20)..(20): n is a, c, t, g, unknown, or other
  misc_feature (22)..(22): n is a, c, t, g, unknown, or other
aaatccaatttacggcattngngatgatataaaccccgtaaagataaactattacacccaattgggtacgaggccccccctcgaggtcgacggtatcgataagcttttttttttttttttttgaatgaatgtggtagaaatacaaaggatatacatacgtacgtacaatagtaccacaaaaagaaagcacgcgacgcacgtacaaagagtactcaccaacaatgacatgactctcgcgtacgccggtcaccgcaccacctgtgcatggcgtggctacggcgaacgctaacctgcaggagcacatgtgtctaccccgatggacgcggtgccgcaaacggcatgcgcacgttctcggcccgggaccgaacgccattgtcggaaaggtcaaccttgtccgacaacggtttggaacaacaagacgcccatctctcggctcatgcccaaatttgcgcccattaacgtatggatttgagcgcggaaatcgaataagccaataaatacactggcccctcctccttaatatgcgcaaccagccccgataaatgaatccccccttaacccccctatttccaactccccacgccccctcatataccccccccatagccccccctataataaatgtccagcgttaaatacccccttcccctcccgtaaacgccccaaaatatcgcctccactccatctcacaataaactccaaaccgcaaaattatatattaaaccgcaccatccaataaaaacaatcattagaactcctttatcctcttttttgtaactattacatcccttacttaattattccctacctgataatacattcctttccctttttttttttccccctggcaccccgtgggtatcaccattatctctaaccacg

SEQ ID NO: 8702 - DNA, 987 bp, Zea mays
  misc_feature: Ceres CLONE 373199
  misc_feature: Encodes the peptide sequence at SEQ ID NO. 8703
gagactcgatcgagagctaatgcaagaaaagaaagaggtgcgagcaagagggatgaacggcgccggcaatggtgagccctcccttgtagttgtagcggaggaagggccgccgaacgatggcaacggcgccggggttcacgcacccaacttcggcgcgaatgaagcggacacgctgctggtggtggcgacactgatcacagcgctgacgtaccagctgggcaccaacatcccgggcgggtactggcaggacgatctcaaggggcacgacggcctcgcggggcacgtcgccggagacccgatcatgcgtgacaagcaccggcggcggtactggctgttcatggcggcgagctgggtggggttcggcacctcgatgctgctcacggtggggttcatcacgggggtgcccgcgaggtcgcgcttcgtccggttcgcgttcctgctggcctactccagcctcgtgctcacgttcgtgacgtcgcagccgcgcacgtcgctcttctgggacctcatcatytgggctgtcgtcatggcgctgctcgccatcgccaccaagtacctgcgcctcgacaggctccccagatgggcgcgtaccctgtgccctgctcctccatccgsgttytgctgctcacgttcgtgactcgtgagcgagctcaccatggacgatcgacctcgtcatytgggtcgccgtcatggcatcgacgcatcgtcgccatcgtcaccaagtaccagcacgtcgacagacctccccggctgggtgcacmccgtctatcttcagtaccagcttgctagtagcaacaatgtgtgtgttttcaaaaaaaaggaagaatgtgtttttatctttgtttaattttggccgtaatgtcttgtttagtggctgatgttcttgttctctgctactgtgtgcgtcctcattagttgatctgaatctgatgttaaatgtatcgctgttcagtmrgtgctgttcttgtacaaaaaaaaaaaaaaaaa

SEQ ID NO: 8703 - protein, 205 aa, Zea mays
  misc_feature: Ceres CLONE 373199
  misc_feature (165)..(165): Xaa is any aa, unknown, or other
  misc_feature (199)..(199): Xaa is any aa, unknown, or other
  misc_feature (200)..(200): Xaa is any aa, unknown, or other
MQEKKEVRARGMNGAGNGEPSLVVVAEEGPPNDGNGAGVHAPNFGANEADTLLVVATLITALTYQLGTNIPGGYWQDDLKGHDGLAGHVAGDPIMRDKHRRRYWLFMAASWVGFGTSMLLTVGFITGVPARSRFVRFAFLLAYSSLVLTFVTSQPRTSLFWDLIXWAVVMALLAIATKYLRLDRLPRWARTLCPAPPSXXCCSRS

SEQ ID NO: 8704 - DNA, 454 bp, Zea mays
  misc_feature: Ceres CLONE 373231-F
  misc_feature: Encodes the peptide sequence at SEQ ID NO. 8705
caggcatccaagcttaaagcaagcagatctaagctccaggcagcgtcgcgacagagtgagtgagtagcacgacaacaacaatggcttccctgaaggccgcgaagcccagcggagttgcggcgcagggcaaggagccggcgcccaagctcagcgagacggcgacgaagccgtcagccgcgaagagcggcggcgttaagaaggctgagcagaagccccgggaaaccaaaaggaaggtgaagagcagcaaaccggcggcggcggccaaaaagtgacgtacagtacgtgtggagtgtaatggagcttccatgcatgcatgagtggatccatgccatgttatgaatctagtccttcctttcttgtatcttccatgtgacgcggcgtgtgcgtcccttcatgtgcgatgatgccagatgaatactacaaataagacgttgtgactgtgccatcgtcgcct

SEQ ID NO: 8705 - protein, 63 aa, Zea mays
  misc_feature: Ceres CLONE 373231-F
MASLKAAKPSGVAAQGKEPAPKLSETATKPSAAKSGGVKKAEQKPRETKRKVKSSKPAAAAKK

SEQ ID NO: 8706 - DNA, 352 bp, Zea mays
  misc_feature: Ceres CLONE 373236-F
  misc_feature: Encodes the peptide sequence at SEQ ID NO. 8707
gaaaagtcgcctagcaattcccgaaatccccaaaagtcgcccttcccccaaccctatccaaccgaatccagcggcggcgcggcggctatggcggcggttacgaacgccgatgtggaggtggtcgacttcgactagacgacgacgacctcatggacgaggacgccgggccggatccagcgccggcccccacctcgcgtctccgctccaccatcgcgggcgacgacgcgccgstmaggaccaagggccgcggcttccgsaggaccccaactcctccgcgccccgcgactcgcgctttggcssggggtacgctccgacctcgactcgctcggcgcccgggacccatccaatcaat

SEQ ID NO: 8707 - protein, 67 aa, Zea mays
  misc_feature: Ceres CLONE 373236-F
  misc_feature (28)..(28): Xaa is any aa, unknown, or other
  misc_feature (51)..(51): Xaa is any aa, unknown, or other
MDEDAGPDPAPAPTSRLRSTIAGDDAPXRTKGRGFRRTPTPPRPATRALAXGTLRPRLARRPGPIQS

SEQ ID NO: 8708 - DNA, 385 bp, Zea mays
  misc_feature: Ceres CLONE 373238-F
  misc_feature: Encodes the peptide sequence at SEQ ID NO. 8709
  misc_feature (48)..(48): n is a, c, t, g, unknown, or other
  misc_feature (49)..(49): n is a, c, t, g, unknown, or other
aaggttcgttcagttcaagaccagacgaggaggaagagaggcgcgcannttccggtctcatggcgcccttccccgccctccgctcatcgtcgccggtggccgccgccgcggccgttcgctcggtcgcgtgtccggccacgcatctgcggcgcccagcaagaggcgcgtcgtctcctgcagggccgtcagcagcaggtcgctgtccatcatcaggtgcgagcagagccgaaagaagggcggcgggccggacacatggctgggccgcgcggcatggtcggcttcgctccgcgatcgccgtcgatgtggccaccggcaaggggcttcctccaggtagggaccgtcgtagattatgagtatcaacgtaacatcgacagcagcgaggaac

SEQ ID NO: 8709 - protein, 110 aa, Zea mays
  misc_feature: Ceres CLONE 373238-F
  misc_feature (16)..(16): Xaa is any aa, unknown, or other
RFVQFKTRRGGREARXFRSHGALPRPPLIVAGGRRRGRSLGRVSGHASAAPSKRRVVSCRAVSSRSLSIIRCEQSRKKGGGPDTWLGRAAWSASLRDRRRCGHRQGASSR

SEQ ID NO: 8710 - DNA, 471 bp, Zea mays
  misc_feature: Ceres CLONE 373253-F
aaaaaaaaatcccaaatttcccttctacagccccacatctgttatcctagtcgccgcccccatccatccgcctcgtcgccgctgccccatccagcctcctcttcgatccgctcctcattgcctggtcgtgatcaagatgccccttggaaggatggctagggcaaggacacgcacagatcttggtggtgacagctcactctcctccaactatccactacggtcccttctcagttgagccgcagatgatggtggaacaaaactacactctgcttctgtgaacaattcatgtagtggttaaggacacaatggaagcacttgtggctgagcctaaagtagaagggaaataatctaagacccctacagaagcagttggtcaagtattggcttcatcaaaatttcttcaaaatgtcggtcttgtatctgccacaaagagaaacaacaatggtggtgatcctacacacataagagaac

SEQ ID NO: 8711 - DNA, 343 bp, Zea mays
  misc_feature: Ceres CLONE 373270-F
  misc_feature: Encodes the peptide sequence at SEQ ID NO. 8712
  misc_feature (10)..(10): n is a, c, t, g, unknown, or other
gctgcagcgngcgcttgctgtgcgtcgcgtgggctcggccggagcccggagggaggcggasttcccccgggtctcgaagatggcggcgcgccggcgagggcccgggccgactacgactacctcatcaagctgctcctcatcggcgatasggtgttgggaaaakttgtctccttttgcggttctcagatggctctttcaccactagctttatcaccaccattgggattgacttcaaaataagaacagttgagcttgatggtaagcgcgtaaakttacagatatgggatactgctggtcaagagcgttttcgaactattacaaccgcctactacaggggtccaat

SEQ ID NO: 8712 - protein, 113 aa, Zea mays
  misc_feature: Ceres CLONE 373270-F
  misc_feature (50)..(113): Pfam Name: Ras Pfam Description: Ras family
  misc_feature (3)..(3): Xaa is any aa, unknown, or other
  misc_feature (20)..(20): Xaa is any aa, unknown, or other
  misc_feature (49)..(49): Xaa is any aa, unknown, or other
  misc_feature (54)..(54): Xaa is any aa, unknown, or other
  misc_feature (90)..(90): Xaa is any aa, unknown, or other
CSXRLLCVAWARPEPGGRRXSPGSRRWRRAGEGPGRLRLPHQAAPHRRXGVGKXCLLLRFSDGSFTTSFITTIGIDFKIRTVELDGKRVXLQIWDTAGQERFRTITTAYYRGP

SEQ ID NO: 8713 - DNA, 466 bp, Zea mays
  misc_feature: Ceres CLONE 373280-F
  misc_feature: Encodes the peptide sequence at SEQ ID NO. 8714
aaacctagcgggtgcagaccttggtgggggagcgaggagtcgaaacaagaaccatgagtgaaacagggcacactgtacaagtcactaacctctcgagcagagtatctgaaagtgatctttatgagttctttttgttctctggccctattgaacatgttgaacttatcagatcaggagaatacggtgctactgcttatgtgacattcaaggagcgctttgccttggaaactgcggtattgctcagtggggctactattgtggatcagccggtatgcataacttattggggacaacctgaggagacttttaatttctgggacaggccaacttgggaggttgaagaggaaattgaatacacgagctatcaatcatgccagtacaacactactccgcaggaagctcttacagtggctcaagatatcgtgaagacgatgctagcaaaggggtacgtgctcagcaaggacgc

SEQ ID NO: 8714 - protein, 137 aa, Zea mays
  misc_feature: Ceres CLONE 373280-F
MSETGHTVQVTNLSSRVSESDLYEFFLFSGPIEHVELIRSGEYGATAYVTFKERFALETAVLLSGATIVDQPVCITYWGQPEETFNFWDRPTWEVEEEIEYTSYQSCQYNTTPQEALTVAQDIVKTMLAKGYVLSKD

SEQ ID NO: 8715 - DNA, 527 bp, Zea mays
  misc_feature: Ceres CLONE 373295-F
  misc_feature: Encodes the peptide sequence at SEQ ID NO. 8716
agcgttgtgttctcggtgcccttcattctagggaaatccgtggcgtcttcctaggcgggacgggaattaggtgtccccttggttggccttcgattcgatatggtggaattcatgaagaatcttgctaggatggacgtggatatgagtgctgaagaaaggcatttgttctcagttggtttcaagaacactattggagcaaagagagcatcatggagaatcatttgttcacatgagcaaaaggtcgcagctgatcgtcagactggtgtgatgatagatgcctataagaagaaagtagaagaggaactaaggaaggtttgcaatgaagtattgtcagtcattgctattcactgccttcccttggccagtacgggtgaaaatatcgtattcttttataagatgaaaggtgactactaccgttacttggctgaatttagcactggaactgaaaagaaagctgcctctgatcagtcacttatggcctatcagcatgccatggttgtcgcctccaagtgagctctcactgctca

SEQ ID NO: 8716 - protein, 137 aa, Zea mays
  misc_feature: Ceres CLONE 373295-F
  misc_feature (1)..(138): Pfam Name: 14-3-3 Pfam Description: 14-3-3 protein
MVEFMKNLARMDVDMSAEERHLFSVGFKNTIGAKRASWRIICSHEQKVAADRQTGVMIDAYKKKVEEELRKVCNEVLSVIAIHCLPLASTGENIVFFYKMKGDYYRYLAEFSTGTEKKAASDQSLMAYQHAMVVASK

SEQ ID NO: 8717 - DNA, 497 bp, Zea mays
  misc_feature: Ceres CLONE 373320-F
  misc_feature: Encodes the peptide sequence at SEQ ID NO. 8718
ttttcttcctcccttcttacagccgccgccgccgcatcccagcctccatcaccgtttccgtctcgttgccatgggtaaggtgcacggatcgttggcgcgcgccgggaaggtccgcgggcagacccccaaggtggcgaagcaggacaagaagaagaagccccgcggccgcgcgcacaagaggatgcagtacaaccgccgcttcgtcaccgccgtcgtcggcttcggcaagaagcgcgggcccaactcctccgagaagtaggcgccgctcggctcgtaccggttcctcatccttcctgctctccgtatgcttatgctcttgatggtactagtttcgttgttcgcaagcagaggaagaaccttctgtagattcggttttgttgtccatgtgctcagatgggaacttgagattgtatgaatttgagatatggtgatatgagctgatgatttttattatgcttattgttgctcctctgagctgtcatttttgaacgctatcc

SEQ ID NO: 8718 - protein, 62 aa, Zea mays; identical to SEQ ID NO: 6893
  misc_feature: Ceres CLONE 373320-F
  misc_feature (3)..(61): Pfam Name: Ribosomal_S30 Pfam Description: Ribosomal protein S30

SEQ ID NO: 8719 - DNA, 444 bp, Zea mays
  misc_feature: Ceres CLONE 373361-F
  misc_feature: Translation starting site: 103
  misc_feature (14)..(14): n is a, c, t, g, unknown, or other
  misc_feature (243)..(243): n is a, c, t, g, unknown, or other
  misc_feature (315)..(315): n is a, c, t, g, unknown, or other
ataaacagagtgangagactggtagcagccgcatgtgctagagctagacagaagtcagtctccttcccctctctctagtgctcgccggctctttccgtcgccatggacgtcctcctctgctgctgcctgctgcttctcctggcctccgccgcgtccgccggcagcgagcggtgcgtgcggcaggggaaggcggcctactcttcctcgctctctccggcccctcacggtagcagcagcggabsngcgggtacggcgccatggccgccgagatcaatgggggcttcctcgccgccgssggcccaggcagcaccgcgngggcctcggctgcggccgctgtttccagatgagatgccgagacgcaaagctgtgcagcggcgggggagtgcgggtggtgctgaccgacttccacaagagcaaccgtacgacttcctgctcgccgggccg

SEQ ID NO: 8720 - DNA, 321 bp, Zea mays
  misc_feature: Ceres CLONE 373366-F
  misc_feature: Encodes the peptide sequence at SEQ ID NO. 8721
  misc_feature (152)..(152): n is a, c, t, g, unknown, or other
gcatccgcctctggtttttcagagcagcagtccaggcgcggaattgaattccggtagatttgagagcggasaagcgagaggagaggagaagaaggcggtaggcggggaagatggagatgccggcagggagcggggccccagcgctggcgcgncagggctcggtctactcgctcacgttcgacgagttccagaccacgctcggcggcgccagcaaggacttcggctccatgaacatggacgagctgctgcgcaacatctggacagccgaggagtctaacgccatggctgckgccgccccggcaacggccacggccacggcgg

SEQ ID NO: 8721 - protein, 70 aa, Zea mays
  misc_feature: Ceres CLONE 373366-F
  misc_feature: The sequence is a functional homolog of SEQ ID NO 352 in the 10/666,642 US patent application
  misc_feature: The sequence is a functional homolog of SEQ ID NO 374 in the 10/412,699 US patent application
  misc_feature: The sequence is a functional homolog of SEQ ID NO 867 in the 11/479,226 US patent application
MEMPAGSGAPALARQGSVYSLTFDEFQTTLGGASKDFGSMNMDELLRNIWTAEESNAMAAAAPATATATA

SEQ ID NO: 8722 - DNA, 413 bp, Zea mays
  misc_feature: Ceres CLONE 373417-F
  misc_feature: Translation starting site: 161
  misc_feature (264)..(264): n is a, c, t, g, unknown, or other
ccctcgttatttccgggctccctcctgtgtacaccactcccgccccgcsstaccattttatccccgcctctcctggcctctgccgccccgtcgcacagaatcgcttggtgcaccctgcgagggcctcctcgaaaccctagcttgcccagcccctccggccatgggcaagtacatgcgcaaggccaaggcttccagcgaggttgtcatcatggatgtcgccgccgctccgctcggagtccgcacccgagcgcgcgccctcgstgncaagcgtctgcaggagcagcagacgtatgggaggaaggtgctggcggcgagtacctggagctaaggaaccggagctcgagaagctgccgccgccgccggagccacgaggaggtcgggcgggaggaaagcggcaccgaggccgccgcaac

SEQ ID NO: 8723 - DNA, 469 bp, Zea mays
  misc_feature: Ceres CLONE 373440-F
  misc_feature: Encodes the peptide sequence at SEQ ID NO. 8724
atttccaggttgcatttctttgtttatatataaggatctggccagcaggagggaacaccatacctgadacttcactgcctttttgtcaggcacgctggtcaggaaatcagtagcctgttttggctgctgttcctaatcagttgggagagggggagatggccaggaggaacatcggagtcgcagtggacttctcgtcgtgcagcaaagcggctttgcggtgggcgtcgacgaaccttgcgaggaacggcgacaggctcatactcatccacgtgaacagctcctgccagaacgagcggggcgccgttcatctctgggagcagagcgtttccccattgatccctctggccgagttttcagacgtcgccaggacatacggtgtgtcaccggacaaggagacgatcgagatcctcactcaagcggcaaatcatagagggatcgaagtctttgcaaaggtgttctacggcgaccc

SEQ ID NO: 8724 - protein, 104 aa, Zea mays
  misc_feature: Ceres CLONE 373440-F
MARRNIGVAVDFSSCSKAALRWASTNLARNGDRLILIHVNSSCQNERGAVHLWEQSVSPLIPLAEFSDVARTYGVSPDKETIEILTQAANHRGIEVFAKVFYGD

SEQ ID NO: 8725 - DNA, 447 bp, Zea mays
  misc_feature: Ceres CLONE 373467-F
  misc_feature: Encodes the peptide sequence at SEQ ID NO. 8726
aaaaataaaacaagcaccagggacaggtagtggctagaccgcagcaattgcgattgcgagtcctccaaaccatggcgctcgccctggcctctccaatggcgtctctctccttccactccgggaggatctcggcggcgtctatcggaggcgtcggccgcactcgcagggcggccccggtgggcgtatccgcctcgccgttcctccggagctccttcgtctcgtcctcctccacgtcgtccgcctccgcctccgcctcccccgcttcgctcgcggcggctgtctcggcgtctctggcatttacgtcctcctccgcgtttgcgggttcatctttgggaatcgagttcagctacagtataatgacaacacggagatcccgtggtatgcagattagggctggaaaggctgccctctgcatgaccaagaggtcaaggtctaggaagtcacttg

SEQ ID NO: 8726 - protein, 125 aa, Zea mays
  misc_feature: Ceres CLONE 373467-F
MALALASPMASLSFHSGRISAASIGGVGRTRRAAPVGVSASPFLRSSFVSSSSTSSASASASPASLAAAVSASLAFTSSSAFAGSSLGIEFSYSIMTTRRSRGMQIRAGKAALCMTKRSRSRKSL

SEQ ID NO: 8727 - DNA, 417 bp, Zea mays
  misc_feature: Ceres CLONE 373510-F
  misc_feature: Encodes the peptide sequence at SEQ ID NO. 8728
aacgcaatcrctcgctcgctcgctcgatatttagccgtggagaggggccgagggagggagcctgctccgctctgcagcacgaacatgatgaagccatcgtgtgtactgcttgtttccagccttcttgtagccactcttgcagctgcttcttcgtcctctcctccgtattccgtcggcaagcacccagggtggctgctggttctaggtcgcaaaggcagagaactcggccagtcgtcagggtacattaccagcatcagagcaagcagcccgagctssagggagtggctatggaggtaaakaaacccgaggaggaggcgacggcgaggcggacggctgatcagagcggggacgccgaggcagggctgatctacagcgcagactacagcagcgtggccatgcatgctgcctctccgccga

SEQ ID NO: 8728 - protein, 138 aa, Zea mays
  misc_feature: Ceres CLONE 373510-F
  misc_feature (3)..(3): Xaa is any aa, unknown, or other
  misc_feature (92)..(92): Xaa is any aa, unknown, or other
  misc_feature (99)..(99): Xaa is any aa, unknown, or other
RNXSLARSIFSRGEGPREGACSALQHEHDEAIVCTACFQPSCSHSCSCFFVLSSVFRRQAPRVAAGSRSQRQRTRPVVRVHYQHQSKQPELXGVAMEVXKPEEEATARRTADQSGDAEAGLIYSADYSSVAMHAASPP

SEQ ID NO: 8729 - DNA, 463 bp, Zea mays
  misc_feature: Ceres CLONE 373522-F
  misc_feature: Encodes the peptide sequence at SEQ ID NO. 8730
tcgaaaaggacagacgggcgcgaactcaaaccctagaaacggtagccatggattcgggaggcggaggagggagcggcgcgcacaaggcggcctcgggctccgcgccctcgccggcgcctaaccccacggcgatgctttcggcgctcatgagcaagcgcgccaagctccaggaggagctccgctccatcgagcgccaggtttatgatatggagaccacctacctacaggagactaatcaatttggaagtgtgctgaagggtttcgaatcttttttgtcatcctcaaaaaacacctctaaccttaagcgctctcggaaatttcaggctgacgagaggttattctccctgtcatccgttacttctccagcggttgatgaacatttggctggacgagatgatggaagagagtatggagcaggtcgttctaagggtggaagcacccctgcgaacgggcaaggcaaacc

SEQ ID NO: 8730 - protein, 138 aa, Zea mays
  misc_feature: Ceres CLONE 373522-F
  misc_feature (25)..(106): Pfam Name: NuA4 Pfam Description: Histone acetyltransferase subunit NuA4
MDSGGGGGSGAHKAASGSAPSPAPNPTAMLSALMSKRAKLQEELRSIERQVYDMETTYLQETNQFGSVLKGFESFLSSSKNTSNLKRSRKFQADERLFSLSSVTSPAVDEHLAGRDDGREYGAGRSKGGSTPANGQGK

SEQ ID NO: 8731 - DNA, 330 bp, Zea mays
  misc_feature: Ceres CLONE 373537-F
aaggggcgttgtgtgaagacgtgtctggatggcacgavsctgcgctttgcattgcattgagtttgcaactgggccggctagactggtgcggtgcacacaactgctaccagctgcaaccgcttctatatatatgccgagcctccaaggcacgcaaccgagcagtgcaagccaagcattctcctcacacacgtacttccgccagcgcvskagctagctgttctcttcttgccatcatctctcgtctgtgatcgaacgccggcgcgcggccagcatggagatgatcgacgcggactgcgtcttggcccgcccgggagcaacaacagcgacgtc

SEQ ID NO: 8732 - DNA, 461 bp, Zea mays
  misc_feature: Ceres CLONE 373558-F
  misc_feature: Encodes the peptide sequence at SEQ ID NO. 8733
ctttacaggctgtacgtagggccgtgccgtcgcccctccttccttcgtcgatctctctctcggcgacgactgggcgaccgctgcctcctgttgccctggtctccattgggccctttgccagattttctttcgcctctccgccggcgacgaacaccaccaccaggaatgggcttgtggacgttgctggagggttttttgcttcttgcaaatgcgttggctatattgaatgaagaccgctttctcgctccaaggggatggagcatgtctgaagtatcaggaaatgggcaaacgaagtcgttgaagggccagatcgtggggctaatctatgctacacaatttctgaggatgcccttaatagcactcaatgttctgatcattgttgtgaaactggtgtctggctgaggctcattatctagttttcactgttgtgttggattgatatctgttccagcatgatgtaa

SEQ ID NO: 8733 - protein, 78 aa, Zea mays; identical to SEQ ID NO: 8422
  misc_feature: Ceres CLONE 373558-F
  misc_feature (3)..(78): Pfam Name: Yos1 Pfam Description: Yos1-like

SEQ ID NO: 8734 - DNA, 660 bp, Zea mays
  misc_feature: Ceres CLONE 373561-R
cgaggtcgacggtatcgatattttttttttttttttttgtgaagttcccttttattcgatcaaattacatggtagccacacaagcaaatacaaagcacgccaacaaagatatctctgagagtgtgtgttagttgttggcgacgactccctggaacacggcgatcagctcggcttcttccagcacgtgcccgtcgatcgcctccatgagcttatccctggtcaccttgttgccgaggtgcacctcgtcgtcgagcgcgtagagcttgaactggatgcggtggccgtgggagggcggcacgggcccgcgccagccgggctgcttccagtcgttgaccccctcctgcaggccgccgagctggtcgcggcccgcccccgcccccggtcccgcggcccccgacaacccctctgggaggcccctggttgtccccgcgaaccttggccatccccccccgcttcccctttcccgctgagttccgccgtttacgtcctgcacaacccatttcagccaaccgcgagtacccccgtttgatcttaccaccccccgccgttgcctaaaatactcatacccttggaatcctttccccctcccttttacgtacctggctcccgtctacctctacattaactgtgcgacccgtcgaaacaggtattcttaacccc

SEQ ID NO: 8735 - DNA, 314 bp, Zea mays
  misc_feature: Ceres CLONE 373564-F
  misc_feature: Encodes the peptide sequence at SEQ ID NO. 8736
  misc_feature (203)..(203): n is a, c, t, g, unknown, or other
  misc_feature (207)..(207): n is a, c, t, g, unknown, or other
accctcgcgccttcgssattctctctctttctctcgagtctcgacacaccacagcggaassctcgactcgctgagtgacaagacgcgacsssacgccaagccaagaccaaattaccaaaccctaccccttcgccgcgaccgssatcccccacatcgttggcgatgagctcctcctccaacagcgggaagaagccggcgcccgnsgtnccgcggggggcccaccatccgcacgctcgccgacataaaccgtggccctgccggtttcccaggtgccggassgcagcagcgatgacgacgagccccaggagtactac

SEQ ID NO: 8736 - protein, 50 aa, Zea mays
  misc_feature: Ceres CLONE 373564-F
  misc_feature (14)..(14): Xaa is any aa, unknown, or other
  misc_feature (39)..(39): Xaa is any aa, unknown, or other
MSSSSNSGKKPAPXVPRGAHHPHARRHKPWPCRFPRCRXAAAMTTSPRST

SEQ ID NO: 8737 - DNA, 259 bp, Zea mays
  misc_feature: Ceres CLONE 373570-F
  misc_feature: Encodes the peptide sequence at SEQ ID NO. 8738
ctcgctcgccgcatacggccgcagccagacagccaacgtactcggggcggctaccgggccggggtccgcgatcgatggcggcgcggcggagcaggggctgggcgcgcggcgcggcggcrttagcrgccgtggcgctgrcrgtgggcgcggggcggaagtacgggtgggacggtgcctccgcggtggcggcrttccgcgaggcccagaggcrctctaggggcactgggcggcgccaagcctacgtggccgcgcacgcgct

SEQ ID NO: 8738 - protein, 61 aa, Zea mays
  misc_feature: Ceres CLONE 373570-F
  misc_feature (22)..(22): Xaa is any aa, unknown, or other
  misc_feature (46)..(46): Xaa is any aa, unknown, or other
MAARRSRGWARGAAALAAVALXVGAGRKYGWDGASAVAAFREAQRXSRGTGRRQAYVAAHA

SEQ ID NO: 8739 - DNA, 118 bp, Zea mays
  misc_feature: Ceres CLONE 373581-F
  misc_feature (95)..(95): n is a, c, t, g, unknown, or other
aagaaaagcctccattcccgagtctccagccaaccgcatccagtccacgccatccccctcgaacccgacaaccccgagtcccgacccgatggcgncaaggccgagaagaagccagcgg

SEQ ID NO: 8740 - DNA, 466 bp, Zea mays
  misc_feature: Ceres CLONE 373610-F
gccatgttcttgttttagttttccatgctctacatattgtatcaaattgttgcatggatgaggtttccatgctctctagattgatgtaaagatgaaagttaccttacctggagtacatgatgcctctggatttttctagctacttatcagtagcacattgtataccgagatgtgtttgtgatgttattttagtagtgtgataagtgttgtctgttatgctcttaaatggaggcatttgaccatccaatttagcttttctatgtgaagtcaatgaagcagaacctcttttttttgtgtgtgcacgtaatgtacctgggccttgtaaagtacggagcgtttgggattatgtcggtttacattttgttttgctctttacattacagaaccacggcaatcctacgagccataaaccagagctagtactgaacaatttcactacacgccttggtcatcgtgttggaaggta

SEQ ID NO: 8741 - DNA, 134 bp, Zea mays
  misc_feature: Ceres CLONE 373611-F
gtgctcacctcgcctgcaggsscgcagccgctggaagaacacgaagacgacgggagtgcggggtggcgtcgcgctggagcaccactgtagccgccggtaggcctccgcgccgctctccgtggccaacgcgccgt

SEQ ID NO: 8742 - DNA, 464 bp, Zea mays
  misc_feature: Ceres CLONE 373615-F
gagtcctcctaattcctaaagtcctaaccctagccgccgcccgccaggctccagcagatcccggtccggcactccgccgcccctcatctccgacctgatcacctgagcgcgccgccccgcctctccctcgggcactgacgcgctgtccgcgcctccacgatccgccggtccgcccagggcacaggcagttgctgcctgcctgccttgctgtcgtctgcccgtccggcgtccgccaggccgcccacactacttctacggccagccacccagccacactagttgatcattgcatcaataacaaacttccttaacgtttcaactgatccggcaacttttgttcagggagcacttccccatattcttgagaacacaaaggaagattttttcaggaggatcattggtctactagcagaaacctcagagatatgttacagagaaataaaggacatcaagtgcatcacctg

SEQ ID NO: 8743 - DNA, 423 bp, Zea mays
  misc_feature: Ceres CLONE 373629-F
  misc_feature: Encodes the peptide sequence at SEQ ID NO. 8744
  misc_feature (108)..(108): n is a, c, t, g, unknown, or other
aactacgacacccaacggcagctgcagcacagcagaggaaggcaggaaggaagaagatatcagaccagtgtgaagccaagccagcgcgtctctctctctctctctctngtcgcttggtcggtccatcggaggatcagctcggcggtggccatggcaatggcgcagcaagcgagcctcccctgctcgactgccaccacatggagagagctcacgaacacgagctggagggacgacgactacaggcggatggtgatggcgtacctgatcgaggcggtgtacctgctggagctggagcggcaggagcgccgggacgcggcggcggtggcgcagcagtggtggaagccgttccacttccgcctggcgcacgagctggtggacgaccgcgacggctccgtgttcggcgccygtcttcgagcgcgacca

SEQ ID NO: 8744 - protein, 91 aa, Zea mays
  misc_feature: Ceres CLONE 373629-F
  misc_feature (86)..(86): Xaa is any aa, unknown, or other
MAMAQQASLPCSTATTWRELTNTSWRDDDYRRMVMAYLIEAVYLLELERQERRDAAAVAQQWWKPFHFRLAHELVDDRDGSVFGAXLRARP

SEQ ID NO: 8745 - DNA, 371 bp, Zea mays
  misc_feature: Ceres CLONE 373651-F
  misc_feature: Encodes the peptide sequence at SEQ ID NO. 8746
  misc_feature (148)..(148): n is a, c, t, g, unknown, or other
  misc_feature (329)..(329): n is a, c, t, g, unknown, or other
ccttccgtagagaaacggactgaggtgctcagctgacgccggtcgcctccagtggcaagtgmccgagcgatgcagcagataatcagcgcctgcaagctgcctcacacgcaacgggccgccgcgctcctgccgcagaggccatcgctcnggcgccttccagtcccaggaggtgcgccgccgccgcssattttggtagtcaggaggagatgccaggaagaggataagcagcagcaagaggccgaggagggaagcggccctgacgagcaggagcaggagcagcagaagcgaacgttcctgagcctggagggagggccgggctggtggagatntccgggcctcagcacgcacgagsgtttcctctgccgcctcac

SEQ ID NO: 8746 - protein, 100 aa, Zea mays
  misc_feature: Ceres CLONE 373651-F
  misc_feature (27)..(27): Xaa is any aa, unknown, or other
  misc_feature (39)..(39): Xaa is any aa, unknown, or other
  misc_feature (87)..(87): Xaa is any aa, unknown, or other
  misc_feature (95)..(95): Xaa is any aa, unknown, or other
MQQIISACKLPHTQRAAALLPQRPSLXRLPVPGGAPPPXILVVRRRCQEEDKQQQEAEEGSGPDEQEQEQQKRTFLSLEGGPGWWRXPGLSTHEXFLCRL

SEQ ID NO: 8747 - DNA, 449 bp, Zea mays
  misc_feature: Ceres CLONE 373656-F
  misc_feature: Encodes the peptide sequence at SEQ ID NO. 8748
  misc_feature (176)..(176): n is a, c, t, g, unknown, or other
gagaagaaagagactaatattattgttttttctgaactggaatggggcacatttctcttctggaacataagtagcgtgcaaacttcgaccgggaccggcgatatccgccatggccaccaccactgccgccgctcgctggagcttccccgcccgtctccagctcctcaccagccgsngcttttgcttccccgcctcctctgccgcgccgcccagttctgtagcggggttcagttgggccgacgcctccgcgtcgctggggacggcgggcgcgsscgacgagtccgacctctccgggtacttccggaaggtcaagagctgcaaccgcggaatggataaaaaagggcagttcgtgaagttctctgtggaggatcaggtcgtggggtacatccacaagggatttatcgaacacatcagagactttcatgatgtttttaccattgtcatgtatg

SEQ ID NO: 8748 - protein, 113 aa, Zea mays
  misc_feature: Ceres CLONE 373656-F
  misc_feature (23)..(23): Xaa is any aa, unknown, or other
  misc_feature (55)..(55): Xaa is any aa, unknown, or other
MATTTAAARWSFPARLQLLTSRXFCFPASSAAPPSSVAGFSWADASASLGTAGAXDESDLSGYFRKVKSCNRGMDKKGQFVKFSVEDQVVGYIHKGFIEHIRDFHDVFTIVMY

SEQ ID NO: 8749 - DNA, 495 bp, Zea mays
  misc_feature: Ceres CLONE 373683-F
  misc_feature: Encodes the peptide sequence at SEQ ID NO. 8750
atcgccccccattgctcgccaagagttcttcttgtttaggcaaaggcaaaagcaggagcaaaaaggtttcgttggcgatggcgagctcgtggacgcttcctgaccacccgaagctccccaaggggaagccggtggctgtcgtcgtgctggacggatggggcgaggccaaccccgaccagtacaactgcatccatgtcgctcagactcctgtcatggactcgttaaagaatggtgctcctgagaaatggagactagtgaaggctcatggaacagctgtgggtctcccatctgatgatgacatgggcaacagtgaagttggtcacaatgcacttggtgctggtcggattttcgcccaaggtgctaagcttgttgatcaagctcttgcctcaggaaagatttatgatggagatgggttcaactacatcaaagaatcttttgaaaatggtactcttcaccttattgggttgttgagtgatggtggtgtccactcccgcc

SEQ ID NO: 8750 - protein, 139 aa, Zea mays
  misc_feature: Ceres CLONE 373683-F
  misc_feature (15)..(139): Pfam Name: iPGM_N Pfam Description: BPG-independent PGAM N-terminus (iPGM_N)
  misc_feature: SWISSPROT Homolog: EC 5.4.2.1 Phosphoglycerate mutase
MASSWTLPDHPKLPKGKPVAVVVLDGWGEANPDQYNCIHVAQTPVMDSLKNGAPEKWRLVKAHGTAVGLPSDDDMGNSEVGHNALGAGRIFAQGAKLVDQALASGKIYDGDGFNYIKESFENGTLHLIGLLSDGGVHSR

SEQ ID NO: 8751 - DNA, 477 bp, Zea mays
  misc_feature: Ceres CLONE 373698-F
  misc_feature: Encodes the peptide sequence at SEQ ID NO. 8752
  misc_feature (426)..(426): n is a, c, t, g, unknown, or other
aaaaagcggcgtgatgcagttcctccgaggcagcggcggcgcgggcgggggcggtgggttcccgggggtggcgtgggaggtgttgcggcggcacttctctaagaagcggtccgtggacgtgaggcggatcaaccccaaggtgcccaaggaggaggccgtcgccatttccggccgactcctccagatcctctccgaccatgggcccctcaccgtcggcaacacctggaaccacgccaaggatgctggcatcgctggtctgaacagcaagacgcacatgaagatcctgctgaaatggatgacggggagaaatgtcgtgaagctgacctgcgtgcacgtgggcaacgcgaagaagttcctctactccccgtccactgaaagcagcagcagcgccggcgcatcaccgtcatccacatcggcctcgcagtnacggtcagtcgccgttaagccttggtgtggttcttgatgttgctttgtgga

SEQ ID NO: 8752 - protein, 149 aa, Zea mays
  misc_feature: Ceres CLONE 373698-F
  misc_feature (138)..(138): Xaa is any aa, unknown, or other
MQFLRGSGGAGGGGGFPGVAWEVLRRHFSKKRSVDVRRINPKVPKEEAVAISGRLLQILSDHGPLTVGNTWNHAKDAGIAGLNSKTHMKILLKWMTGRNVVKLTCVHVGNAKKFLYSPSTESSSSAGASPSSTSASQXRSVAVKPWCGS

SEQ ID NO: 8753 - DNA, 793 bp, Zea mays
  misc_feature: Ceres CLONE 373760-R
  misc_feature (19)..(19): n is a, c, t, g, unknown, or other
  misc_feature (36)..(36): n is a, c, t, g, unknown, or other
  misc_feature (74)..(74): n is a, c, t, g, unknown, or other
  misc_feature (83)..(83): n is a, c, t, g, unknown, or other
  misc_feature (86)..(86): n is a, c, t, g, unknown, or other
ttgcctagccctcactccnctccccaaaaaacaaantaaacatcccccatcctcacaccttcctttgttttttncccccgggnggnccgaattggtaccggtcccccctcgaggtcgacggtatcgataagctttttttttttttttttgcgtcgatttaacttatattcacttattagttattagataaatctctttatgtacagaaggtgctgagagcccatcgaacaaacattgaatctccgcttgaaagttaactaaatttgaagggacaacatgaattggacaatgtcctcgggtttccacctttaagaccagatgctgagatgcatctgctatgatatgaaatcccgaggtaggtctgtgagtatgtaactgatgcgatgcaggagattccgctggtgccatgggaaattgtattgttttttagtacgggtggagaatgatcgccacttccgttggaaacagcattgccttcttcctgactttgcctttgaggttgaatgaaaataatagcccaagagcatcaaatagcttggtaagtaaaaaatatcaagcgggtccccaaagacaatagggacgaaaaacagcccgaccgccaccattcctccctcccttccctggttaggaaagggttcaaggggacgcccctccggacccccaaagggcccatccaaaaatccccaaactctagaaggggccaaaacccccaggacagggtatactggcccgccttggcagtaatatttacatcggtcgcttccaaccttccacgccctccccgcgcgcctct

SEQ ID NO: 8754 - DNA, 972 bp, Zea mays
  misc_feature: Ceres CLONE 373760-R2
cgaggtcgacggtatcgataagctttttttttttttttttgcgttgatttaacttatattcacttattagttattagataaatctctttatgtacagaaggtgctgagagcccatcgaacaaacattgaatctccgcttgaaagttaactaaattcgaaggcacaacatgaattgcacaacgtcctcgtgtttccacctttaagaccagatgctgagatgcatctgctatgctatgcactcccgaggtaggcctgtgagcctgtcactgatgtgatgcaagagattccgctggtgcccccgcaaattggattgttcctccgcccgggtgcataaagatcgccacttccgtctgaaaccagcattgcttcctcccggtctttgcctttggacgctgcctgcatcccaatatccccacccataaaaacaccatgggccattaaaaaataccaacggctccttaaaagaaattcgcggcggaaataagcaaaaaggcatccacccttccatccctcccttggctaaccaaatgggccaaagcgtatggcccttccgcaagcaaaaagcgccccctccaaacctccaaaaaatatatgaacggggccaacaccccacaccaccccgtcacatggttacattccgccccacattatcaaacccgaccccccaccactcacaagaaaccggtgttttcccccccaccccacctttcacccacaactcctcgggtactatagttaatatcccacaaggctttcgccaaaaaatggggccaacctcctcccccgttctactcctctatcgagaagttctctcacaattacaacccggcggttgggtagaccagaacacccccccttaacccaccttctgtgtccatttcccaccaatctatcctctttctcccagtccccaaacgtaccacaatttctcgcgagaatcatacagcgcgcccaccgtcatacacacgctcc

SEQ ID NO: 8755 - DNA, 407 bp, Zea mays
  misc_feature: Ceres CLONE 373765-F
  misc_feature: Encodes the peptide sequence at SEQ ID NO. 8756
  misc_feature (239)..(239): n is a, c, t, g, unknown, or other
  misc_feature (352)..(352): n is a, c, t, g, unknown, or other
aatctggcatcggtgaagagcgggcgctagagcagagtgagcgtgcgggttcttggtcatggtggagcgcggtgccgtcgtccttccgctccagggcgccggggttgggcgcgtcctcctccccgtgcaggtgcgggtacggtcgttcttgaggagcaggagggcgacggagcggcggcgcaggcttgcgagttccgcggcgccggcgaggtgcagcaagatgtacgttcccggctttngggagggttcaccggagcggaaggcgccgatcaacctccagcacttctttaactacatcgctgtcagcattgtcctagcacagcttgagagttacaatakggaagcgtacttngagctgaaggagttcatcagccgcacctctctgaatgacgccgagattttctgcg

SEQ ID NO: 8756 - protein, 116 aa, Zea mays
  misc_feature: Ceres CLONE 373765-F
  misc_feature (61)..(61): Xaa is any aa, unknown, or other
  misc_feature (94)..(94): Xaa is any aa, unknown, or other
  misc_feature (98)..(98): Xaa is any aa, unknown, or other
MVERGAVVLPLQGAGVGRVLLPVQVRVRSFLRSRRATERRRRLASSAAPARCSKMYVPGFXEGSPERKAPINLQHFFNYIAVSIVLAQLESYNXEAYXELKEFISRTSLNDAEIFC

SEQ ID NO: 8757 - DNA, 418 bp, Zea mays
  misc_feature: Ceres CLONE 373795-F
  misc_feature: Encodes the peptide sequence at SEQ ID NO. 8758
gatcccaaaaggctgccatctttttcctgaaaaccacgagcagttcactacccatccgccatagtccgaaagttaccaaatcctcctgcgaggccccagcaccgaatgccccagcacaacaaggcggcgtcgtttgagaggaagcggctagaggacctgctgccgggctagatgacggaagtggcgggacssccgggacgtcgggcggcctggcgctgcgggcgggccagttcgtcttcgccgccgcgtccatctgcgccatggcctccgcgcccgggttcaccaactacacagccttctgctacttggttgcatctatgggactacaagcactatggagcttggggcttggatgtcttgattactatgccttgacattgagaagagatcttcagcaagctcttctcatgagcttatt

SEQ ID NO: 8758 - protein, 52 aa, Zea mays
  misc_feature: Ceres CLONE 373795-F
MASAPGFTNYTAFCYLVASMGLQALWSLGLGCLDYYALTLRRDLQQALLMSL

SEQ ID NO: 8759 - DNA, 456 bp, Zea mays
  misc_feature: Ceres CLONE 373815-F
  misc_feature: Encodes the peptide sequence at SEQ ID NO. 8760
  misc_feature (445)..(445): n is a, c, t, g, unknown, or other
gcggccccgggagttccttgattcggcgggcatcgcatggggagggcgtcgctggctagctgtggtaacctgacctcgccgctgcagctctgtaggtagctagtattccagaggtgatttctcctctcctgatcgacggaggtcaaatctggttcgtgacccccagtatcagagagggccacggttttgactatcaatgcgttaggacttaggagttaggaccaagtactggagctttcgtggttccgatggagtctaagtgtgtgaacgaccaggacgccttgatcgacctggagagtggcaacggcactgcagtgatcaaccatagcaacgacctggagagtggttgcgtgtgtgcgtgcgccaacggatgtgacaggaacaaccagcacatggactgctcttcgcccgcttcggacgctgttgctagaagtggagacgacangaagtccgagg

SEQ ID NO: 8760 - protein, 69 aa, Zea mays
  misc_feature: Ceres CLONE 373815-F
  misc_feature (66)..(66): Xaa is any aa, unknown, or other
MESKCVNDQDALIDLESGNGTAVINHSNDLESGCVCACANGCDRNNQHMDCSSPASDAVARSGDDXKSE

SEQ ID NO: 8761 - DNA, 184 bp, Zea mays
  misc_feature: Ceres CLONE 373820-F
  misc_feature: Encodes the peptide sequence at SEQ ID NO. 8762
  misc_feature (149)..(149): n is a, c, t, g, unknown, or other
agctctgctcactctmatmacttssgctcmaagccagtgctagcccggccccttgtgtacgtgagagacggcatcgtaccgtagagcagcatccatggcggctcagggaagtggcagtgctcgtggcagcggcgccgcgcgsgctttgncgctggtcctcctctgcgtgctcctccacggcgag

SEQ ID NO: 8762 - protein, 30 aa, Zea mays
  misc_feature: Ceres CLONE 373820-F
  misc_feature (19)..(19): Xaa is any aa, unknown, or other
MAAQGSGSARGSGAARALXLVLLCVLLHGE

SEQ ID NO: 8763 - DNA, 456 bp, Zea mays
  misc_feature: Ceres CLONE 373844-F
  misc_feature: Encodes the peptide sequence at SEQ ID NO. 8764
aatctggagagttccagtgagactacgaatcgtccgccgtcttctgaaaaggtcactcaaaggcccgccgtctgcagcgctggcgaccgcagagccggcgaccaccgtgcgtcctgtctcctcgtctgctccgtccatctccacagcttgtgcaggtcgctgaaacacttggatcaaaacagagctttagatgaagcactacaccctgaaggatcagggtgtttatgctcttccatctactgcaaaatccaattggaaggatatctactgcatctacttccaaaacagcatgatgcaatacttgacgacaaaggaaaaggtccaaccgttacaattgaatctccacccaaaaggttcaaaatggacctctacgtattaaagaaaggtcggacacaagatcttccaacaactgaagattttctcagattatcagcagcttttaaggttgtagaatgt

SEQ ID NO: 8764 - protein, 62 aa, Zea mays
  misc_feature: Ceres CLONE 373844-F
MKHYTLKDQGVYALPSTAKSNWKDIYCIYFQNSMMQYLTTKEKVQPLQLNLHPKGSKWTSTY

SEQ ID NO: 8765 - DNA, 406 bp, Zea mays
  misc_feature: Ceres CLONE 373855-F
  misc_feature: Translation starting site: 191
  misc_feature: Pfam Name: DUF1070 Pfam Description: Protein of unknown function (DUF1070)
  misc_feature (282)..(282): n is a, c, t, g, unknown, or other
aggcctaggcttttttgaggagcgcggactagggagtagggaggacgggacgggagagagagagagaggcgcgtgcgttcgtggtcggtgccggtgcgtgcgtggcgtggtggccgctgccgtacgtgatccgtccaccccctctcctcttccgacgccggcgacassgggaggtactccggggggaggaatggccgtggcaagggctccgctcggcgcggttgctgcgatggcggtggccgctctcgtcttcgccatactcatgaccgccgccgctgcgcnagggcaccggcgcccgcgccaccagcgacggcacatcaatcgacctggggtattgcgtacatccttatgctggttgccctagtgctcacctacctgatccacccgcttgasgcgtcctccccct

SEQ ID NO: 8766 - DNA, 433 bp, Zea mays
  misc_feature: Ceres CLONE 373881-F
  misc_feature: Translation starting site: 85
  misc_feature (169)..(169): n is a, c, t, g, unknown, or other
aagaggggaaagagagagaggagcagcagagagaagagggggaggcagtccagtgtccacgcacgtacgctccacagaagagagatggcgatgcggatggcggcggcggcggcagtggcgctggtggcggtgatgggcgtgctggcgcccgagcggcggcgcagrcgancttgcgcggagaagctgatcccgtgctcgccgtacatgaacacgacggggacgccgccggatacctgctgcggcccgctcaaggacgccgtcagaacgacctcaagtgcctctgcgacctctacgcctcgccggagatcttcaaggccttcaacatcagcctcgaccaggccctcggctctccaagcgttgcggcctcagcgacaccaccgccgcctgcaaggcctttctcctacgcagtctcctccaggttcgccgccatcag

SEQ ID NO: 8767 - DNA, 459 bp, Zea mays
  misc_feature: Ceres CLONE 373885-F
  misc_feature: Encodes the peptide sequence at SEQ ID NO. 8768
gtttgttggcatcgttccattcccctctaaaccctagccgcctagcgcctcgatccgagcagccctaggtctcgcggaggtagttcttgttgatttggtccaagatggcggaggaaaaggtggggcggatcttcgtcggcgggctgtcgtggaacaccacggagcgcacgctcgagcgcaccttcggtcagtacggcaaggttatcgaggctcaggttgtagtggaaagggagacaggccgctctaggggatttggatttgtcacattttcagaacctcgggctgtggatgctgccattcggggaatgcataacggagaactggatggccgcaatatttctgtgaacaaagctgaacctaggaactctgatggctatggatatggtggtggtggtrgtggtggttactcgtccggtggtagaggtggatatcgtagtggagctgatgtagttccagcag

SEQ ID NO: 8768 - protein, 118 aa, Zea mays
  misc_feature: Ceres CLONE 373885-F
  misc_feature (9)..(80): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (98)..(98): Xaa is any aa, unknown, or other
MAEEKVGRIFVGGLSWNTTERTLERTFGQYGKVIEAQVVVERETGRSRGFGFVTFSEPRAVDAAIRGMHNGELDGRNISVNKAEPRNSDGYGYGGGGXGGYSSGGRGGYRSGADVVPA

SEQ ID NO: 8769 - DNA, 212 bp, Zea mays
  misc_feature: Ceres CLONE 373944-F
  misc_feature: Encodes the peptide sequence at SEQ ID NO. 8770
  misc_feature (166)..(166): n is a, c, t, g, unknown, or other
  misc_feature (167)..(167): n is a, c, t, g, unknown, or other
gcggtcaacagagagaacagcactgtctccgtctatactcgtcaggcatcatcaccgccttctcccgaggctttcgagatggcggcggcggaassttcgaggacttcggaggcccgccgtgacgccgtgttcgggcggtgggtcgtcttctcgccggcgcgctcgnncccaccgacctcaagtcccacaaccccaccaaccctagcccgggc

SEQ ID NO: 8770 - protein, 70 aa, Zea mays
  misc_feature: Ceres CLONE 373944-F
  misc_feature (32)..(32): Xaa is any aa, unknown, or other
  misc_feature (56)..(56): Xaa is any aa, unknown, or other
AVNRENSTVSVYTRQASSPPSPEAFEMAAAEXSRTSEARRDAVFGRWVVFSPARSXPPTSSPTTPPTLAR

SEQ ID NO: 8771 - DNA, 491 bp, Zea mays
  misc_feature: Ceres CLONE 373955-F
  misc_feature: Encodes the peptide sequence at SEQ ID NO. 8772
gcttctcccagaagtcacgcaccaaacaccaccaccaaagaaggcgagaacgctccccttcccctccagtctccaggaccgtctcctcgcctgctcatctaccgctgctccccttctctgggctcggagaatcggagagaagcgcgcgcgaccatggcgtccagcgcctctcggttcatcaagtgcgtcacggtcggcgacggtgccgtgggcaagacatgtatgctcatctgctacaccagcaacaagttccccactgactacatacctacggtgttcgacaatttcagtgcaaatgtagttgtggatggcaccactgtgaatttgggcctttgggataccgctgggcaggaagattacaaccgcctgaggcctctaagctaccgaggtgcagatgttttcgtgcttgcattctcacttgtgagccgagctagctatgagaatatcatgaagaagtggataccagagcttcaacattatgcacctggggy

SEQ ID NO: 8772 - protein, 112 aa, Zea mays
  misc_feature: Ceres CLONE 373955-F
  misc_feature (10)..(112): Pfam Name: Ras Pfam Description: Ras family
MASSASRFIKCVTVGDGAVGKTCMLICYTSNKFPTDYIPTVFDNFSANVVVDGTTVNLGLWDTAGQEDYNRLRPLSYRGADVFVLAFSLVSRASYENIMKKWIPELQHYAPG

SEQ ID NO: 8773 - DNA, 152 bp, Zea mays
  misc_feature: Ceres CLONE 373959-F
acrgcctctcggcggggcccggcaacagaccgggcagcagcacggcagccatggcgtcgagttcgaccctggatttggcgatgggccccggcgccctcctcmccccctcgcggtcccgtaacgcctccttcgctccaggaaggggaaggagc

SEQ ID NO: 8774 - DNA, 364 bp, Zea mays
  misc_feature: Ceres CLONE 373967-F
  misc_feature: Encodes the peptide sequence at SEQ ID NO. 8775
  misc_feature (113)..(113): n is a, c, t, g, unknown, or other
accaagttttggattccagcagcggcgcccccaggccaggccccacccgctcagcctcctcagctgcccaaccttctccccatctgctcagcctcagctgtcattcccgcgancgtctcccggctctatcgatggaccgagtcgccgccctcgtcgtcgcgctcctcgccctcttcttcgccgccggggccacggcgcaggccccggcctcgtcgcccaagcgcactccagcgccassccacccaggacggccttcctcccgccgccgccggccagggcgcctatggcctccccgccctcgcctcccgcgatggcgccggtgcccgcgcctccgccggcgtgccgccacgagccccgtcggcgc

SEQ ID NO: 8775 - protein, 77 aa, Zea mays
  misc_feature: Ceres CLONE 373967-F
  misc_feature (36)..(36): Xaa is any aa, unknown, or other
MDRVAALVVALLALFFAAGATAQAPASSPKRTPAPXHPGRPSSRRRRPGRLWPPRPRLPRWRRCPRLRRRAATSPVG

SEQ ID NO: 8776 - DNA, 383 bp, Zea mays
  misc_feature: Ceres CLONE 373978-F
  misc_feature: Encodes the peptide sequence at SEQ ID NO. 8777
  misc_feature (74)..(74): n is a, c, t, g, unknown, or other
  misc_feature (79)..(79): n is a, c, t, g, unknown, or other
  misc_feature (80)..(80): n is a, c, t, g, unknown, or other
accaaaacgtccattccgaagccgaggagagatctcatctcggcttctccgccgccgtcgccgccatgcctccntcccnntcttccgccggtgcggcgccgcctcgccttccggttccgcgtccgcttccggctccgacccgaccccgtcttggtgggagtccgtctcgcaggctcggtcccgcatcctggcgctctcctccatcctgcccgcggcggtctcccacgacgtgcggcgctggccgacgcgaccgcccggcgcgcgcgctcctccgctcgcccgctgcctattcggcgctctccgacgcgctccgggcgggcgggggcgcgacgacccggcctgccactggctctatgacacgctcctctccgccgacccggacc

SEQ ID NO: 8777 - protein, 127 aa, Zea mays
  misc_feature: Ceres CLONE 373978-F
  misc_feature (25)..(25): Xaa is any aa, unknown, or other
  misc_feature (27)..(27): Xaa is any aa, unknown, or other
PKRPFRSRGEISSRLLRRRRRHASXPXFRRCGAASPSGSASASGSDPTPSWWESVSQARSRILALSSILPAAVSHDVRRWPTRPPGARAPPLARCLFGALRRAPGGRGRDDPACHWLYDTLLSADPD

SEQ ID NO: 8778 - DNA, 479 bp, Zea mays
  misc_feature: Ceres CLONE 373996-F
  misc_feature: Translation starting site: 183
  misc_feature (414)..(414): n is a, c, t, g, unknown, or other
acgactctttcccggctacccacaccgcgcgakatctccgatccccgcccaaatcccacgacgccggcggsccatgggcggcaaggacctgacggaggaccagatcgcctcgatgcgggaggccttctcgctgttcgacggacggggacggccgcatcgcgccctcggagctgggcgtcctcatgcgctccctcggcgggaaccccacgcaggcgcastccggggacatcgcggcgcaggagaagctcaccgcacccttcgacttcccgcgctttctcgacctcatgcgcgcccacctcaagcccgagcccttcgaccgcccgctccgcgacgccttccgcgtcctcgacaaggacgggctccggcaccgtcgccgtcgccgacctccgccacgtcctcacctccatcggcganaagctcgagggcccacgagttcgacgagtggatccgcgagtcgacgtcgcgcccggaggcaccat

SEQ ID NO: 8779 - DNA, 814 bp, Zea mays
  misc_feature: Ceres CLONE 373997-R
  misc_feature: Encodes the peptide sequence at SEQ ID NO. 8780
caattgggtaccgggccccccctcgaggtcgacggtatcgataagctttttttttttttttgtaatataatttgtattggattttgtatagtgtgcagcttttcaaaatctatggagaaccaaaaacacctatgcaagaagacataactacatgtctacattggggccatttccgaaatggacctcgatagagaatagaataggaatagcctaatcaaatcagttggttctttcttttctagtctagaagcaaaagagaaattgctaatgctatttttacccgttttgtctttatcctttccgcgtccgacgagtgcgcggcggccggtaatgacaggtcgcgacaggcgtgccgcggggcccgcaggaccgtgccctgtggatcaatcccgatccttctcccgccttcggccttccccgcgcgcgcgcgcacgcgcacgcaccaggaccaccgcgatataaagcccgccaccaatccgctcgtggtcgtcgtcatcatcccgattcccgacacgcttgtgttgtcgccattggcaagctccgcggctcgtggcagcgggaacgtacgaggcgaaggagagcgagggcgaccgcgcggatcgcatcgcagctctgggcggagatgctggcggtgttcgatcgggcagtggcgcccagcccggaagtgctgcggcagccgggcgccgcgaggggcggcagcgcggctagcctctcggaccggttcatacatgcgcgggccgacgcagtcacgtcaacgttggcggagtctgtcgccctgtcgttctctcaagcacaaaaaccccatagcacttta

SEQ ID NO: 8780 - protein, 64 aa, Zea mays
  misc_feature: Ceres CLONE 373997-R
MLAVFDRAVAPSPEVLRQPGAARGGSAASLSDRFIHARADAVTSTLAESVALSFSQAQKPHSTL

SEQ ID NO: 8781 - DNA, 177 bp, Zea mays
  misc_feature: Ceres CLONE 374003-F
agccgcgtacacataacacatctggtaagckagcaccgagcagcaggtggtctcaacggtcgacgcgacaactttccttgtccatgcagcagatcactcgtcgtacgttccctatgctggctcctcctcggctccccctcgtcggggcgctcctgctgctcctcgccgtcgcgctcg

SEQ ID NO: 8782 - DNA, 481 bp, Zea mays
  misc_feature: Ceres CLONE 374006-F
  misc_feature: Encodes the peptide sequence at SEQ ID NO. 8783
acggccaccacacatcccttcctctctctctctcctcgagcattcgtgctgctccgaccccaccgccacaggctcggcggtccggcgatctcgctcaccggcgggtacatgactacttcaaggcgccttgctgacaggaagactgcaaagttccagaagaacatcaccaggaggggttctgtgcctgaaaccactgtcaagaagggaaatgactaccctgttggccctctattgcttgggttcttcatctttgtcgtcattggatcatcgttgtttcagatcatcaggacggcgaccagcggcggggtggcttgagagccggcccacatctaatccccagtatagagagttgcttgttatacatgcatccagctaggattgggtacagctaaaatgttaaacgtgacaagactgccctgcattccgttcatttggtgggccttgaatctggaactgaaccataaggcagaatcatgtacct

SEQ ID NO: 8783 - protein, 68 aa, Zea mays
  misc_feature: Ceres CLONE 374006-F
  misc_feature (1)..(64): Pfam Name: RAMP4 Pfam Description: Ribosome associated membrane protein RAMP4
MTTSRRLADRKTAKFQKNITRRGSVPETTVKKGNDYPVGPLLLGFFIFVVIGSSLFQIIRTATSGGVA

SEQ ID NO: 8784 - DNA, 228 bp, Zea mays
  misc_feature: Ceres CLONE 374050-F
  misc_feature: Encodes the peptide sequence at SEQ ID NO. 8785
  misc_feature (189)..(189): n is a, c, t, g, unknown, or other
  misc_feature (191)..(191): n is a, c, t, g, unknown, or other
agttcccatccgccgcccgcgcgcttcttccttccggcacagcacacaggacaccgtagacagattcatcgcgacgatggggctcgacgtcgtggagatcgggatgggcgccgatttgagcmtggatctgaggcacttcgcctccaaggccgtgcggcagaacaaggactacgcgccggcgccggccgnancatggacgcctgcatccgccgcctcgaggaggagcgg

SEQ ID NO: 8785 - protein, 50 aa, Zea mays
  misc_feature: Ceres CLONE 374050-F
  misc_feature (16)..(16): Xaa is any aa, unknown, or other
  misc_feature (38)..(38): Xaa is any aa, unknown, or other
  misc_feature (39)..(39): Xaa is any aa, unknown, or other
MGLDVVEIGMGADLSXDLRHFASKAVRQNKDYAPAPAXXWTPASAASRRS

SEQ ID NO: 8786 - DNA, 838 bp, Zea mays
  misc_feature: Ceres CLONE 374053
  misc_feature: Encodes the peptide sequence at SEQ ID NO. 8787
gacaaatctcgcccgcggaagagaactggtggcgtgctggcctttggcaccttccagaagattcctctatctgcctccgttccgctcatggcgtccgcgccgagcaccacggcgcccaccctcgcgccctctctgcgcacgcccttctcttcagccccccgcggggcccgccttgcggccgcgccccgcctgtcccgcgctcagcccgggcaggccggatgccgcgcggcgccaggtcggctcgctcgccctcgctcgcgcgttcggtgcggcgcggcggcccggttcattgggcagggcgagttccccgcggaggtgctggagtcggagctgcccgtgctcgtggacttcgtcgccgactggtgcgggccgtgccgcctcatcgcgcccgtcgtcgactgggcctccgaggaatatgacgggcgagtaaaaatcgtcaagatsgatcacgacgccaatccgcagctgattgaagagtacaaggtytatggtctcccgactttgattttcttcaagaatggccgagaggtagcagatagccggcgagaaggggcaatgacaaaagataagttcaagcaatacctggaacctctcttgactacgacagtcacttaagaccattccctgcggcttcagcaccgaccaccgaggatgccaatgggaatgttgaaggaatttccttttatgagtttagcttgtaattaactatgctgcggggtcatttgcgtatatttggtacagtatacatgaagagctaattttgatacaagcaagtttgtttttcgacatctttgtgacacacaatggtatgtttgtttgtccaaaaaaaaaaaaaaaa

SEQ ID NO: 8787 - protein, 175 aa, Zea mays
  misc_feature: Ceres CLONE 374053
  misc_feature (69)..(169): Pfam Name: Thioredoxin Pfam Description: Thioredoxin
  misc_feature: SWISSPROT Homolog: EC 1.8.1.9 Thioredoxin-disulfide reductase
  misc_feature (119)..(119): Xaa is any aa, unknown, or other
  misc_feature (133)..(133): Xaa is any aa, unknown, or other
MASAPSTTAPTLAPSLRTPFSSAPRGARLAAAPRLSRAQPGQAGCRAAPGRLARPRSRVRCGAAARFIGQGEFPAEVLESELPVLVDFVADWCGPCRLIAPVVDWASEEYDGRVKIVKXDHDANPQLIEEYKXYGLPTLIFFKNGREVADSRREGAMTKDKFKQYLEPLLTTTVT

SEQ ID NO: 8788 - DNA, 469 bp, Zea mays
  misc_feature: Ceres CLONE 374098-F
  misc_feature: Translation starting site: 103
  misc_feature: SWISSPROT Homolog: EC 5.2.1.8 Peptidylprolyl isomerase
accgtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgctgggccacggacgaccgactccctccacaacgccttcagcacctacggcgaggtcctcgagtccaagatcatcctcgatcgggagacgcagaggtcccgcggcttcggcttcgtcaccttctccacggaggaggcgatgcggaacscatcgagggcatgaacggcaaggagctggacggccgcaacatcaccgtcaacgaggcccagtcccgcggcggccgtggaggcggcggcggtgggtacggtggtggccgtggaggcggcggctacggcggtggcggaacaagacgcacacgctctgcatccgctgcggccgccgc

SEQ ID NO: 8789 - DNA, 376 bp, Zea mays
  misc_feature: Ceres CLONE 374129-F
  misc_feature: Encodes the peptide sequence at SEQ ID NO. 8790
  misc_feature (338)..(338): n is a, c, t, g, unknown, or other
cacacaaccaagctcgatccatctcactctccgctggtcgctcactcttgcagctccacccttcactcagtcttagtctcttattagctctaggctctagctagccgcgccactccttcgtgtagccatcagccttctcatcgccaccaatggccactgccgaggtccagaccccgaccgtcgtggcggccgaggaagcgcccgtggtggagaccccgccgccggccgtcgtgcccgaggagtctgcccccgccgaggccgaggccgagscgaggctgctgctcctgctgatcccgaggagcttcccgcggccgagcagcaggcagccgccgaggcgnaggccgcgggctcctgctggtgccgaggagcccgtcgc

SEQ ID NO: 8790 - protein, 75 aa, Zea mays
  misc_feature: Ceres CLONE 374129-F
  misc_feature (41)..(41): Xaa is any aa, unknown, or other
MATAEVQTPTVVAAEEAPVVETPPPAVVPEESAPAEAEAEXRLLLLLIPRSFPRPSSRQPPRRRPRAPAGAEEPV

SEQ ID NO: 8791 - DNA, 381 bp, Zea mays
  misc_feature: Ceres CLONE 374132-F
  misc_feature: Encodes the peptide sequence at SEQ ID NO. 8792
  misc_feature (45)..(45): n is a, c, t, g, unknown, or other
gactcagtggcacgggagcggacgctgccactcgcgatatttgcnagagagagagagagagagagggcccgagarccgaggacgagtgcagtctggctggcgtgatgctgcttcggagcgcgtcctcgccgctgctcaactgcgggcgcgcgccggctgccgcggcgtcggtcgagcacctcgcggtggtttcgccgttgttatcaccggcagtggcggcgcttaggcaggggccggtgctgtgccgcgccatgtccgagggggactcgccgcgccgctcgtgcccaagaaggacgatggacacgggagggcgccgaggctgtcggcgtccttgtcctcgtccgcctccatcttcgtcgaggaggaggacggcgagggcga

SEQ ID NO: 8792 - protein, 92 aa, Zea mays
  misc_feature: Ceres CLONE 374132-F
MLLRSASSPLLNCGRAPAAAASVEHLAVVSPLLSPAVAALRQGPVLCRAMSEGDSPRRSCPRRTMDTGGRRGCRRPCPRPPPSSSRRRTARA

SEQ ID NO: 8793 - DNA, 506 bp, Zea mays
  misc_feature: Ceres CLONE 374169-F
  misc_feature: Encodes the peptide sequence at SEQ ID NO. 8794
aataaaatacgagggtcaaatctctcgtcrtcgctcggctcctctgggcccacagcggccagcaaactgcctccgtcctccctgcgggctgtgccgcctcttcttcgcgtcggcgccgccctcctcccttctcttctgctgctgatggaactggatcctcgcctctacgagaacgtctctgtcagcgacaacgatgtccgaaacatagttctatcttatcttatgcacaactgttttaaagggacggcagaggcattcctatctagcactgggttgaatttacctgtcgactatagtgtggatgtggataagcgtaaagcaatttttaattttgtgctagaagggaatgcccttaaagccatagagctgacagaagaaatggcacctaacttgctagagaatgatatggatctacattttgatcttcttagtctccacttcattgagctagttcgctcaaaaaaattcacagaagctcttgactttggccagaaaaaattgacatc

SEQ ID NO: 8794 - protein, 120 aa, Zea mays
  misc_feature: Ceres CLONE 374169-F
MELDPRLYENVSVSDNDVRNIVLSYLMHNCFKGTAEAFLSSTGLNLPVDYSVDVDKRKAIFNFVLEGNALKAIELTEEMAPNLLENDMDLHFDLLSLHFIELVRSKKFTEALDFGQKKLT

SEQ ID NO: 8795 - DNA, 852 bp, Zea mays
  misc_feature: Ceres CLONE 374174-R
cgattgggtaccgggccccccctcgaggtcgacggtatcgataagcttttttttttttttttttcgcaaccattatgtccattaattgatcaacaagcacatcagcaaacaatccggacacataccatggactgaactgagctgctagtagcactgaaggagctggctgactaataaacacttgtgggtagttgagagcactaatccaatgctcaaaaagaaagaaaaaaaatcatatagatagataggacgggagggagagctgatgcagctcctccttgcttgattgctcactgggatggagtggaaggccacccaattcgggtggccaacactgatctgaactgaaccccaaaaaaagaaatggagagttgggcgagagtgacactgtctatcccggattgagccacacacagagagactgggaattgacgacccttagcgggcggtctcctcctcggcccgtccggcggccgctgtgggagcaggcccgccggagaaggaggccagcaggttgaggttgccctgcgctacgcggaggtagttgccgaccctgccggcggacgcctccccggccatgcccggcgctgctgctgcagccgcggcgaccatcatctccggcgcgtccgcgaagctccagagccgtccgaagtcggtccgcaccggcagcgcccagaacccctgggccggggtgccgtgcggctgcacgccgctctgcgctggacgagcatcatcgaagccacgaccgggacgaagctggaaaaggacgccgccgtgaagccgttgccgaagacatctatgaggtatgcacggcccgcctgaaaaaccactcgaagacacggacaacggcat

SEQ ID NO: 8796 - DNA, 133 bp, Zea mays
  misc_feature: Ceres CLONE 374187-F
  misc_feature (40)..(40): n is a, c, t, g, unknown, or other
  misc_feature (76)..(76): n is a, c, t, g, unknown, or other
aaacgcagagaaaagaaaaccgctccaatccgggagctgnaaatagcagaagaatccagaggcgactccaggtttntcggcgatgctgcgagcgggaggcaggcggctcctcgccccggggctccgtcggctc

SEQ ID NO: 8797 - DNA, 125 bp, Zea mays
  misc_feature: Ceres CLONE 374200-F
  misc_feature (55)..(55): n is a, c, t, g, unknown, or other
  misc_feature (56)..(56): n is a, c, t, g, unknown, or other
gacacacgccgctgctccaagaaaccaccgccgagcccaaccgcacaagcgcgcnnggcaggagagagagagaggcggggagcaaaacaatggaggggaaagaggaggacgtgcgcctcgggcss

SEQ ID NO: 8798 - DNA, 376 bp, Zea mays
  misc_feature: Ceres CLONE 374226-F
  misc_feature: Encodes the peptide sequence at SEQ ID NO. 8799
accagagtcatcgcggcgtgttcaaatcccacaatcttcttgtagcacaccactgtcttcgtccaactcggcggcgatgtctgggcgcggcaagggcggcaaggggctgggcaagggtggtgcgaaacgccaccgtaagttctccgcgacaacatccagggtatcacgaagccggcaatccggagctggcgaggaggggcggcgtgawgcgtatctccgggcttatctacgaggagacccgcggcgtgctcaagatcttcctcgagaatgtcatccgcgacgsstcacctcgtagataagcccggagatacgctccacgccactcccccacccccgctaaccagcccgccatgcccctgccaacgtacgttgcagc

SEQ ID NO: 8799 - protein, 98 aa, Zea mays
  misc_feature: Ceres CLONE 374226-F
  misc_feature (69)..(69): Xaa is any aa, unknown, or other
  misc_feature (94)..(94): Xaa is any aa, unknown, or other
QSHRGVFKSHNLLVAHHCLRPTRRRCLGAARAARGWARVVRNATVSSPRQHPGYHEAGNPELARRGGVXRISGLIYEETRGVLKIFLENVIRDXSPRR

SEQ ID NO: 8800 - DNA, 437 bp, Zea mays
  misc_feature: Ceres CLONE 374255-F
  misc_feature: Encodes the peptide sequence at SEQ ID NO. 8801
  misc_feature (392)..(392): n is a, c, t, g, unknown, or other
aaaaacttagcagtccgtacattccgctcaccggtggccttcctcacctgcgtcagacagagaaagccgagattagcggcggcggcgatggcactcccggcgtcgagctccggcctcttccgcttcgtatccccccgcagccgtccccagtccactgacatcgtggccgctgcctcctggggagtcttcgccggcaccgsgcttctacctcgtccagccatttgactggattaagaagactttcttcgataaacctgaaccagaggcatgagtctccaggcagaaaatgctgcaaatctgcaacttttggtacaccactttttgtccgggatgattcctgatgataactcagcaaataatatgagaccctctcgtctttcctkgttggattntatccagatgtaggcatccctcttgcatgtaatcttcacgagggg

SEQ ID NO: 8801 - protein, 45 aa, Zea mays
  misc_feature: Ceres CLONE 374255-F
  misc_feature (38)..(38): Xaa is any aa, unknown, or other
MALPASSSGLFRFVSPRSRPQSTDIVAAASWGVFAGTXLLPRPAI

SEQ ID NO: 8802 - DNA, 139 bp, Zea mays
  misc_feature: Ceres CLONE 374257-F
acacgcacaccgcgacccagtccagagccagtacgtgcgamgccacgcacgctgctggtccgcgtacgcagacgacggtcaggtcggccggtgcttttcagtttggaataatgacggcgacgacgacgacagccgccgg

SEQ ID NO: 8803 - DNA, 457 bp, Zea mays
  misc_feature: Ceres CLONE 374319-F
  misc_feature: Encodes the peptide sequence at SEQ ID NO. 8804
gatctgagatcgacatcgatccaccgaggtttcttgtgcgtgccgccatggccatggcagtagctcaccttcttcctcagctctccgccgamrattgggagctagcaggaacagaatggccattctcttgattcttcagctttttctcttgacggcgctaggcgtggatggagcggcgtcgttcatcttcaccaacgcctgcaagcacgcggtgtgggtgggcgcgctccacggcgccactcgccgccgctcgcgcggtcgggcttctacctggcgccgtccgccacgtccagcatggsscggccgtcgtcggggacatggtccggcacgttgtgggcgcgcacgggctscgtggccgaccccgccaccgggcgcttctcctgcgccacggccgactgcggcacgggcgacgtcgcgtgccagggccgcggggcggcgcctccgggtctcgctcgtc

SEQ ID NO: 8804 - protein, 54 aa, Zea mays
  misc_feature: Ceres CLONE 374319-F
  misc_feature (2)..(2): Xaa is any aa, unknown, or other
  misc_feature (19)..(19): Xaa is any aa, unknown, or other
MXRPSSGTWSGTLWARTGXVADPATGRFSCATADCGTGDVACQGRGAAPPGLAR

SEQ ID NO: 8805 - DNA, 164 bp, Zea mays
  misc_feature: Ceres CLONE 374325-F
  misc_feature (121)..(121): n is a, c, t, g, unknown, or other
acaacaccaagaagcaagawaactagaaaaggctcctcccgaccgcaacgcccctcatctccctcgaccccgacatccccgacccgatggcgcccaaggcggagaagaagccagcggagwngtaagccggcggccgagtgagaaggcggagaagacgaccgcag

SEQ ID NO: 8806 - DNA, 444 bp, Zea mays
  misc_feature: Ceres CLONE 374336-F
  misc_feature: Encodes the peptide sequence at SEQ ID NO. 8807
atgacgtgtttatttatgggcggcgcttcgtctccactccccaccggaggaaggaagcgagaagaccagaaggtgagaagagagagagagagtgtgtgtgatcggtacaaggatcaccgctgtgcctgcgcgtgctgcttcaccgaatcgagtcagatcctgtccgaatccgagctaagggatggcaaccggtagtgaagcctcgaaggcagctgaggctgtggttgactggcataaacacgacagcaagaggatgctccatgcggtttaccgtgttggggatctggaccgcacaatcaagtactacacggaatgctttgggatgaaactgctgaggaaaagggatgttcctgatgagaagtacaccaatgccttccttgtagtacttgattgtgcggtccagttccccaacatcccctggggaccgccagcccttctcggccc

SEQ ID NO: 8807 - protein, 87 aa, Zea mays
  misc_feature: Ceres CLONE 374336-F
  misc_feature: SWISSPROT Homolog: EC 4.4.1.5 Lactoylglutathione lyase
MATGSEASKAAEAVVDWHKHDSKRMLHAVYRVGDLDRTIKYYTECFGMKLLRKRDVPDEKYTNAFLVVLDCAVQFPNIPWGPPALLG

SEQ ID NO: 8808 - DNA, 447 bp, Zea mays
  misc_feature: Ceres CLONE 374357-F
  misc_feature: Encodes the peptide sequence at SEQ ID NO. 8809
acttcccgaatcccgatccatccgcatagcactgagggcggcggccgcttcctctcctccgcggccgaggtcgctcccccgcccgccgcctcttgcccgcggccgatctcttccctccgctcgcagcgtcgcagcccgtaacgagaccgcgctcggttgagcaccacctggggcccagcgccccagcgtcctcgtgaccacctcggcgcggcatccgccctctgcagccccggtgtctccgcgaccggctccggtgcgtccggaacgcagctccacaggagcatcattatttatagaatacgatctactttatagctgatgacaatgtctgcttctactgctgcaattcgtactgcgaatacaaatggaaaccatgcagtaagttcggattcacattctagccaagatgctaggcagcgaacagctggtattacaaaaagaaaagca

SEQ ID NO: 8809 - protein, 41 aa, Zea mays
  misc_feature: Ceres CLONE 374357-F
MSASTAAIRTANTNGNHAVSSDSHSSQDARQRTAGITKRKA

SEQ ID NO: 8810 - DNA, 467 bp, Zea mays
  misc_feature: Ceres CLONE 374392-F
  misc_feature: Encodes the peptide sequence at SEQ ID NO. 8811
gtggcagtggctggccacccaatcgtctgtctcgttcgtcatctacctctccctcctccaacccaagctaagctaaacagcttacagctcgctccgccatcaccgtatcgagagagacagagacaggctagcgagggaatggagaggatgctggccaggctgatgcggcggcggactccgtgcccctgtccggcctcctccaccacggaggagcgcccgccccgctgcaggccgccggcgccactggggcctccccgctgatcttctcgcaccagcagcagcagcagcacacggccgccgccgccgtcctgccggggctcaagatcagggactccgcgtcccagctgatcgggaggaccccgatggtgtacctgaacaaggtgaccgaggggtgcggcgcccgggtggctgccaagctcgagttcctccagccgtccttcagcgtcaaakacagaccggcgatctcg

SEQ ID NO: 8811 - protein, 35 aa, Zea mays
  misc_feature: Ceres CLONE 374392-F
  misc_feature: SWISSPROT Homolog: EC 2.5.1.47 Cysteine synthase
  misc_feature (30)..(30): Xaa is any aa, unknown, or other
MVYLNKVTEGCGARVAAKLEFLQPSFSVKXRPAIS

SEQ ID NO: 8812 - DNA, 430 bp, Zea mays
  misc_feature: Ceres CLONE 374401-F
  misc_feature: Encodes the peptide sequence at SEQ ID NO. 8813
gttttttccatcccattttctctcctctctccgtcgccgcctcgggccaaaccctacgcagggagttgattgatcgattgcagccatgagtaagttgcattccgagcttctcaaggattgcatctcccagatagttcaggatgccaagaagaataggaagttcactgagactgttgagcttcagattagtctgaagaattatgatccacaaaaggacaagcgtttcagtggctctgttaagttgcctcacatccctcgtccaaagatgaaggtgtgcatgcttggtgatgcccagcacgttgaggaggctgagaagatgggacttgactacatggatgttgaggccctcaagaaaatgaacaagaacaagaagcttgttaagaagcttgccaagaagtaccatgcttttttggcatcagagaccatcatc

SEQ ID NO: 8813 - protein, 115 aa, Zea mays
  misc_feature: Ceres CLONE 374401-F
  misc_feature (9)..(115): Pfam Name: Ribosomal_L1 Pfam Description: Ribosomal protein L1p/L10e family
MSKLHSELLKDCISQIVQDAKKNRKFTETVELQISLKNYDPQKDKRFSGSVKLPHIPRPKMKVCMLGDAQHVEEAEKMGLDYMDVEALKKMNKNKKLVKKLAKKYHAFLASETII

SEQ ID NO: 8814 - DNA, 454 bp, Zea mays
  misc_feature: Ceres CLONE 374457-F
  misc_feature: Encodes the peptide sequence at SEQ ID NO. 8815
ctatccatcccttgcattggtattgtcatctggggcagggcaggggagggcaggagaagctatctattggccatctatccagcagccgctctccccagccccactctctccatctagagctccctaactgcaccggccgccacaccaccgtaccccgacccctcgacaacaatggccaccgtcctaggcagcccccgcgcgccggccttcttcttctcgccgtcctccctccgtgccgcgccggcgcccaccgccgtggcgctgcctgcggccaaggtgggcatcatgggccgtagcgccagcagcaggggcaggctgcgcgcgcaggccacctacaacgtgaagctgatcacgccggagggggaggtggagctgcaggtgcccgacgacgtgtacatcctggaccaggccgaggaggacggcatcgacctgccctactcctgccgcgcggggt

SEQ ID NO: 8815 - protein, 94 aa, Zea mays
  misc_feature: Ceres CLONE 374457-F
MATVLGSPRAPAFFFSPSSLRAAPAPTAVALPAAKVGIMGRSASSRGRLRAQATYNVKLITPEGEVELQVPDDVYILDQAEEDGIDLPYSCRAG

SEQ ID NO: 8816 - DNA, 327 bp, Zea mays
  misc_feature: Ceres CLONE 374460-F
  misc_feature: Encodes the peptide sequence at SEQ ID NO. 8817
  misc_feature (140)..(140): n is a, c, t, g, unknown, or other
gaggaaaaatctcgcattcgcaaaccaagcaaatggaggcatgagctccgccgcctccccgtctctcgccgatctcccccaaaccctagcctcgacctgaccgccagcgggcccgcagcggagaaggagtcggagtcgcnccacccacccaccctctgccgcgggcggggagcgggcggcggacgagatgccgtcgcacggggatctggaccggcagatcgcgcacktgcssmtctgcaagtacctgcccgaggcggaggtcaaggtgctctgcgagcaggccaaggccatcctcatggaggaatggaacgtggcagcccgtgcgct

SEQ ID NO: 8817 - protein, 46 aa, Zea mays
  misc_feature: Ceres CLONE 374460-F
  misc_feature: SWISSPROT Homolog: EC 3.1.3.16 Phosphoprotein phosphatase
  misc_feature (14)..(14): Xaa is any aa, unknown, or other
  misc_feature (15)..(15): Xaa is any aa, unknown, or other
  misc_feature (16)..(16): Xaa is any aa, unknown, or other
MPSHGDLDRQIAHXXXCKYLPEAEVKVLCEQAKAILMEEWNVAARA

SEQ ID NO: 8818 - DNA, 483 bp, Zea mays
  misc_feature: Ceres CLONE 374464-F
  misc_feature: Encodes the peptide sequence at SEQ ID NO. 8819
atcccttgatcaaaaacccacaggccacaacaccaagaaaccagcatcttctgcagctctgaagaaaactcgatcaccatggacatgccttctcttgttctcctcctgctcgtcttcattgcaacaggcagccgcgccgcggggcaggtgttctgccgctcgcagttcaacctggccaacgaggcctgcagcctgcgcaccttctccgggcccaacccggcgcaaccgctgcagctgcacagcaatcagctcctcggcatcctacgagatacaggcggaccaccacgagcacgagcacagccacgagcacgagcacgagcacgagcatagccacgagcacgagcacgagcacagccacgaacacgagckykasctkagcacacgcacagccggcggcacggcttcgggcacggcggccgcgacccctacgacaccgcctgctgccgccgcctcatgggcatcgacaacgcctgcatctgccag

SEQ ID NO: 8819 - protein, 83 aa, Zea mays
  misc_feature: Ceres CLONE 374464-F
MDMPSLVLLLLVFIATGSRAAGQVFCRSQFNLANEACSLRTFSGPNPAQPLQLHSNQLLGILRDTGGPPRARAQPRARARARA

SEQ ID NO: 8820 - DNA, 216 bp, Zea mays
  misc_feature: Ceres CLONE 374488-F
  misc_feature: Encodes the peptide sequence at SEQ ID NO. 8821
aacaaccgtagcctgtasscttcatccgttkcgctgcgcccggttccctcgcgcggtgcggaatttaacatggccgtgcggagtggtggtcgacggcgtsstcttcccgccggtggcccgcccgccgggtccgccggctccgcacttcctcggcggcgcaggcgtgcgaggcgtcgagatcggaggcaacttcatcaagttcacggccatcggcgt

SEQ ID NO: 8821 - protein, 71 aa, Zea mays
  misc_feature: Ceres CLONE 374488-F
  misc_feature (6)..(6): Xaa is any aa, unknown, or other
  misc_feature (10)..(10): Xaa is any aa, unknown, or other
  misc_feature (34)..(34): Xaa is any aa, unknown, or other
TTVACXLHPXRCARFPRAVRNLTWPCGVVVDGVXFPPVARPPGPPAPHFLGGAGVRGVEIGGNFIKFTAIG

SEQ ID NO: 8822 - DNA, 463 bp, Zea mays
  misc_feature: Ceres CLONE 374517-F
  misc_feature: Translation starting site: 86
  misc_feature: SWISSPROT Homolog: EC 1.11.1.15 Peroxiredoxin
ctcagcactagtctcctcttcgcacgagcgcaacaccatccacccaccagttcgaagcggaggcgaccggcaacctgcggcggagatgtcaggcaggggcaagggcggcaaggggctcgggaagggcggcgcgaagcgtcaccggaaggtgctgcgcgacaacatccaggggatcacgaagccggcgatccggaggctggcgaggaggggtggcgtgaagcgcatctccgggctgatctacgaggagacccgcggcgtgcttcaccccacccattcactcgccttgcgcttcctcgccgccccagttccccaccccctgctcacccacccgtcccctcctgctcgcccatggctcccatcgctgtcggcgacgccctccccgacggccagctcgggtggttcgacgagaacgaccagctgcagcaggtctccgtccacgcgctcgccgccggcaagaaggtca

SEQ ID NO: 8823 - DNA, 474 bp, Zea mays
  misc_feature: Ceres CLONE 374541-F
  misc_feature: Translation starting site: 161
  misc_feature: SWISSPROT Homolog: EC 5.2.1.8 Peptidylprolyl isomerase
  misc_feature (441)..(441): n is a, c, t, g, unknown, or other
ctactcgattggatttaaacccgggtttgggtggcgtcgctttcatcatttcccccctcgtgctctctctcgaaccttcttccaaagcacccgaaccctagtgatctcggaaccctagccgcgcgcggatctcggcttttccccttcctccacgccagccatggacgaggacttcgagatgcctcccgccggcgccgatgagatgatgggcgacgacgagatgggcgacttcggcggcgacgagggcccggtgatgaaggtgggcgaggagaaggaggtcggcaaggaggggctcaagaagaagctgctcaaggagggcgagggctgggagactcccgaggtcggcgacgagggttgaagtgcattacacgggcacgctccttgatgggacaaaattcgactcaagccgtgatcgtggagaacccttcaagttcaagcttngacaaggtcaagtgataaagggttcggatcaag

SEQ ID NO: 8824 - DNA, 1053 bp, Zea mays
  misc_feature: Ceres CLONE 374552
  misc_feature: Encodes the peptide sequence at SEQ ID NO. 8825
aggcatagattcttcgtcattttcctcgcaaaaggaagccggtgagccggagagattcccgtcgtttcgacgcaccggatcgcgggacctctcgcctcccctcccttcccttccctgcgccgcccacggcagaatggcgggagccgacggggcgcagcaacaccatccttgcagcatctgcatggagcccatggcgccctccgcggcccaccgcggcggcgccgcctgcacgcacgcattctgcggcgcgtgcctgtccggtcacgtccgcgccaagctagagtgcggcggcggcggcgccgtggtgcggtgccccgacgcgtcctgcgctgccacgctcgacccggagctctgccgcggcgcgctcccctccgaagtcttcgagcgctggtgcgccaagctctgcgagtccctgttcctcggagcgcgccgcacctactgcccgttcccggactgctctgagatgatggtggccgacgacgacggcgaggagtgcgtgacccagtccgagtgccacgggtgccggcggctgttctgcgcgcggtgcgcggtgccgtggcacgccggcttgacctgcgaggagattgcgcggctcggtgagggggagcgcgagcgggaggacctgctgctcgtgaaggccgcccgggagggcagctggaagcgctgcccgcgctgcaggttctacgttgagaagtccagtggctgcctgcacataacctgcaggtgcggatatgagttttgctatggatgcggtcagcaatggcagctgatacatgacggctgtcctggagcatgaaacagggcttcgagctctcctgtggcttcgttaagcaatgggagctgatacgtgaatcacgtgatgagggtttcaaggatggagtaggtattgatgttgctatcagtatggtttctgtagtcccatggaacaatggtccatggatagtctgacaaccttctctacagaactttggaacattcttctctcatgtatgttgtctgtcttcagttaacatgccagacataatatctttcttcaaaaaaaaaaaaaaaaaa

SEQ ID NO: 8825 - protein, 220 aa, Zea mays
  misc_feature: Ceres CLONE 374552
  misc_feature (84)..(148): Pfam Name: IBR Pfam Description: IBR domain
MAGADGAQQHHPCSICMEPMAPSAAHRGGAACTHAFCGACLSGHVRAKLECGGGGAVVRCPDASCAATLDPELCRGALPSEVFERWCAKLCESLFLGARRTYCPFPDCSEMMVADDDGEECVTQSECHGCRRLFCARCAVPWHAGLTCEEIARLGEGEREREDLLLVKAAREGSWKRCPRCRFYVEKSSGCLHITCRCGYEFCYGCGQQWQLIHDGCPGA

SEQ ID NO: 8826 - DNA, 165 bp, Zea mays
  misc_feature: Ceres CLONE 374575-F
atacgggcccgtgtctcagcgcacacctcttcgtgctcgctcccatggaggccaccccgatctccatgaagccaccggcgccggcgcgcccamcccccggtcactctggagcccatagaattgtcaacgcatgccgtcggagtgaccgagctgggagcgattcca

SEQ ID NO: 8827 - DNA, 467 bp, Zea mays
  misc_feature: Ceres CLONE 374615-F
  misc_feature: Encodes the peptide sequence at SEQ ID NO. 8828
  misc_feature (360)..(360): n is a, c, t, g, unknown, or other
  misc_feature (377)..(377): n is a, c, t, g, unknown, or other
atctcacaccacgcctgctgcagcacctcgctctccgctccgttggccccatggagtccgtcgcgtccgccgcgatcgccaccacctcccgctctctcccgctccccttctcttctaccccggtccaccgccggcgccgtgccgccttcctccccgttgccgcctccaagcgtcacgacgacgacaaggaggccgcgaaagggtccggctcggaaccacggcgcgasscaccagcctcgcgccgtacggactctccatctcgccactctccaaggacgcggccatggggctggtggtgagcgctgccacggggagcggctggacgacgggatcggggatggagggcccgccgacggcagncaaagccggtggggcgngcaggccggagtgtcgacgctgccttggtccctcttcacgaaatcaccgcggcggcgcatgcgggggtggccttcacctgcaacgttgtg

SEQ ID NO: 8828 - protein, 82 aa, Zea mays
  misc_feature: Ceres CLONE 374615-F
  misc_feature (59)..(59): Xaa is any aa, unknown, or other
  misc_feature (60)..(60): Xaa is any aa, unknown, or other
MESVASAAIATTSRSLPLPFSSTPVHRRRRAAFLPVAASKRHDDDKEAAKGSGSEPRRXXPASRRTDSPSRHSPRTRPWGWW

SEQ ID NO: 8829 - DNA, 497 bp, Zea mays
  misc_feature: Ceres CLONE 374619-F
  misc_feature: Encodes the peptide sequence at SEQ ID NO. 8830
gattattgttagggaagaggtgctcctctctctctatctcctccacgctctccgttccttcccctccccgatctccccaatccgaccagaccggcaggcaccttcgactcgagcggagcaggcgaggcagagatggcgatgcgacgggcgctcctcagatcggtcgacttctcccccgacagcaaggctgcagttgagtacttttattctttctcaagggcacagtctgcttgttctctcaatggtgctggtctttgtcctgctagtagatcatttagcacccaggctgccactacgtcaagcacaccacagcctccacctccaccaccccctccagagaagactcactttggtggcctcaaagatgaggatcgcattttcaccaacctctatggtctgcatgacccttttctgaaaggcgcggtgaagagaggtgactggtataggaccaaggatttggtgattaagggggcagactggatagtttatgaaatgaa

SEQ ID NO: 8830 - protein, 121 aa, Zea mays
  misc_feature: Ceres CLONE 374619-F
  misc_feature: SWISSPROT Homolog: EC 1.6.99.5 NADH dehydrogenase (quinone)
MAMRRALLRSVDFSPDSKAAVEYFYSFSRAQSACSLNGAGLCPASRSFSTQAATTSSTPQPPPPPPPPEKTHFGGLKDEDRIFTNLYGLHDPFLKGAVKRGDWYRTKDLVIKGADWIVYEM

SEQ ID NO: 8831 - DNA, 446 bp, Zea mays
  misc_feature: Ceres CLONE 374625-F
ctcacacaaccaagctcgatccatctcactctccgctggtcgctcactcttgcagctccacccttcactcagtcttagtctcttattagctctaggctctagctagccgcgccactccttcgtgtagccatcagccttctcatcgccaccaatggccactgcgaggtccagaccccgaccgtcgtggcggccgaggaagcgcccgtggtggagaccccgccgccggccgtcgtgcccgaggagtctgcccccgccgaggccgaggccgaggccgaggctgctgctcctgctgatcccgaggagcttcccgcggccgagcagcaggcagccgccgaggcggaggccgcggctcctgctggtgccgaggagcccgtcgcggccgaaccggccgccgaggcggaggctgctgctcctgctggtcccgaggagactcctgcggtcgagca

SEQ ID NO: 8832 - DNA, 474 bp, Zea mays
  misc_feature: Ceres CLONE 374630-F
  misc_feature: Encodes the peptide sequence at SEQ ID NO. 8833
  misc_feature (131)..(131): n is a, c, t, g, unknown, or other
  misc_feature (310)..(310): n is a, c, t, g, unknown, or other
  misc_feature (399)..(399): n is a, c, t, g, unknown, or other
gtttttcatttcgaaatcaaaccacgacgatgccgccmdttggcggacgcgcgacgctctccgccctcgctctctttgcctcccgcctctcctgtcgcaggttcggggacgaggacctccgggtgctggangccgcgctgtccgccggcgccgacgtccccgcgctgctcgccacgcgctcggcggcccggcgcctgctgcgatcgcgcgcggcggaggcactcgcgttcaccgcggcgggtgcatcgctggatggtggggatgagagacggagcctcgccgtcgccgacttcttctcacgcgccttcgnttgwtaggcgatgtcgagagctgccttgccatggagatacggaggcactgttgcttcgagacgctaaatactgcaacgaccttcacttncaaktttcccgtcagagtkggcttaacttttccaacggattstcttgataatggctttctacaccattgcctcca

SEQ ID NO: 8833 - protein, 93 aa, Zea mays
  misc_feature: Ceres CLONE 374630-F
  misc_feature (4)..(4): Xaa is any aa, unknown, or other
  misc_feature (34)..(34): Xaa is any aa, unknown, or other
MPPXGGRATLSALALFASRLSCRRFGDEDLRVLXAALSAGADVPALLATRSAARRLLRSRAAEALAFTAAGASLDGGDERRSLAVADFFSRAF

SEQ ID NO: 8834 - DNA, 408 bp, Zea mays
  misc_feature: Ceres CLONE 374644-F
  misc_feature: Translation starting site: 289
  misc_feature: SWISSPROT Homolog: EC 5.2.1.8 Peptidylprolyl isomerase
  misc_feature (356)..(356): n is a, c, t, g, unknown, or other
ctctccgtgctttctcagaggcgggttggcttctcctcccccaccggttcgtgttcaggttctggttcgtgggctagagggaagagatggcggcgtcggacgttgagtaccgttgcttcgttggcggcctcgctgggccaccgacgaccactccctcaacaacgccttcagcacctacggcgaggtcctcgagtcgaagatcatcctggatcgggagacgcagaggtcccgcggcttcggcttcgtcaccttctccacggaggacgcgatgcgcasgccatcgagggcatgaacggcaaggagctcgacggccgcaacatcaccgttaacgaggcccagtcccgcggcggccgcgnaggcggggttggcggatacggtggcggggcgcgtgatggaggcggcctacgg

SEQ ID NO: 8835 - DNA, 285 bp, Zea mays
  misc_feature: Ceres CLONE 374681-F
  misc_feature (140)..(140): n is a, c, t, g, unknown, or other
  misc_feature (201)..(201): n is a, c, t, g, unknown, or other
atgcatcccatccccattcccatccatagagctgcgggcggcctgcgctgcatgcagccaacaagctcatcagctcaccgtacctaggaggacgaccgagcagctaaggtagtagtagctagctagccagtgatggcggngctacaaagcgcagggcggggcgctcgtcgtcgtcctggctgtcgccgcgctcttcgcggncacgatggcgatggcggtggacgacgagcacatgtaccactggaagtgctttcaagtcgtgcacggggaactgccgcaacgagg

SEQ ID NO: 8836 - DNA, 233 bp, Zea mays
  misc_feature: Ceres CLONE 374686-F
  misc_feature: Encodes the peptide sequence at SEQ ID NO. 8837
  misc_feature (137)..(137): n is a, c, t, g, unknown, or other
  misc_feature (202)..(202): n is a, c, t, g, unknown, or other
gagtaaaaataaagtaacctaaaactcggaggaaagcagaaggggaagagtcagcaatggaggcgagggttgcaggagtgcccgaagacgaagagtctggcctcctcccccgcccgtccgcagccggccgacggctncctcccgcggcccccgcttcccgcctccaccggcagcctgggcgacggtggacggtcccctcggncttccgctggaggacgcggagggccacgccg

SEQ ID NO: 8837 - protein, 59 aa, Zea mays
  misc_feature: Ceres CLONE 374686-F
  misc_feature (49)..(49): Xaa is any aa, unknown, or other
MEARVAGVPEDEESGLLPRPSAAGRRLPPAAPASRLHRQPGRRWTVPSXFRWRTRRATP

SEQ ID NO: 8838 - DNA, 149 bp, Zea mays
  misc_feature: Ceres CLONE 374724-F
  misc_feature (104)..(104): n is a, c, t, g, unknown, or other
aataaattctctctcgctgcccaccgttcaaccaccccgcttcccccgaccgcgktctcggagmacccttctcaaccgcatcctgcctctgctcggtgtcgccntctcgaytgcaggagaggggagcgccccgtcgccgatctgatcgg

SEQ ID NO: 8839 - DNA, 291 bp, Zea mays
  misc_feature: Ceres CLONE 374729-F
  misc_feature: SWISSPROT Homolog: EC 3.4.25.1 Proteasome endopeptidase complex
  misc_feature (252)..(252): n is a, c, t, g, unknown, or other
gaactgacttcagaagtcaccaacgcacccagcacagacataagaccctcgccggacgctcgctctcgccggggacaactcaatcacgaggccaggatggccgctacgatcgckcgatcaccgtgttctcacccgacggccacctcttccaggtcgagtacgccctcgaggccgtccgcaagggcaacgccgctgtcggtacmgcggcgtcgacaccgtsstcctcggcgtcgagaagaagtccacccccangctccaggactccaggtcgtgcgcaagatcgcgagchtg

SEQ ID NO: 8840 - DNA, 368 bp, Zea mays
  misc_feature: Ceres CLONE 374736-F
  misc_feature: Encodes the peptide sequence at SEQ ID NO. 8841
  misc_feature (49)..(49): n is a, c, t, g, unknown, or other
  misc_feature (112)..(112): n is a, c, t, g, unknown, or other
atcatcatttcaacctctctccctcggcctcgcssgcggcacagcgcanttccactgttgggtgtggtggatttcctccgcccccgaacgatcgatcttttgcatggcakcngcggctagctccaaggggcgggcgatcgctgggagcttcgtcagccgcgtcctggccggcaaggcgcctccccgaggagggccgtgcacgcctcgtcgtacgacaagaacccggagagcaggtgcgcccggcgttcgttgccggacgatgtgatcggcggcgcggggagccccgacaaggtactggagcccccaccccaagaccggcgttttcggcccggcggcggtggacaccaaccagctgggcgtcgcgctga

SEQ ID NO: 8841 - protein, 53 aa, Zea mays
  misc_feature: Ceres CLONE 374736-F
  misc_feature (3)..(3): Xaa is any aa, unknown, or other
MAXAASSKGRAIAGSFVSRVLAGKAPPRGGPCTPRRTTRTRRAGAPGVRCRTM

SEQ ID NO: 8842 - DNA, 328 bp, Zea mays
  misc_feature: Ceres CLONE 374756-F
  misc_feature (54)..(54): n is a, c, t, g, unknown, or other
agagattttggactagattcgtgcaaaacasstgaaaaagaaaaggccatcganaacgccgccgccgcctctgakgctttccgccgtgcgatgtggtgmccttcgccggtgacgcccgccgccgcacctcctcccacgcatcctttcctcctcctttggtacatctcccgcgcgaccacaggtgggggcgccctgggagctcccggaggtggagaaggtactgcgcgamgtacgagcgggtggcgtgcgcgtattccccgtcggcgagagcggtctgcamggcggggcctgcgccgactacatggtcgtcgccacaggscgctccgat

SEQ ID NO: 8843 - DNA, 447 bp, Zea mays
  misc_feature: Ceres CLONE 374759-F
  misc_feature: Encodes the peptide sequence at SEQ ID NO. 8844
attgggagctcactcgctggtcgttgcctgctgcggattgcccccaggcggccccactcactccgctgttgatatttcgtttggttctcctttccgtcttgtccgtcgccgaggccttcttcccctcgctccccagctccagcaggcagatcagatccatccaaccacgaacaggaaggtaggaggcctgaggggctgaagttgaaccatgagtgccgtcgcggtttcgtcgtcgctgaacccgaacgcgccgctcttcatcccggcggcgctgctgcaggtggaggacttctcgccgcagtggtgggacctcatcaccaccaccgccttggttccgcgaccactggtcccgcgagcacgcccacctggacgagatagccgagcagctcgagttggtcgccctccttgcctacgatgaggatgaggacctcttctacggcgagcagg

SEQ ID NO: 8844 - protein, 69 aa, Zea mays
  misc_feature: Ceres CLONE 374759-F
MSAVAVSSSLNPNAPLFIPAALLQVEDFSPQWWDLITTTALVPRPLVPRARPPGRDSRAARVGRPPCLR

SEQ ID NO: 8845 - DNA, 119 bp, Zea mays
  misc_feature: Ceres CLONE 374760-F
aaaaataggacaagccccagcagtttgccactcccacgcgaaacagaagccccagcaggcgtcactcccgacgcgacgcccctgcttgccggccgggaggtcactcgactctgcctcca

SEQ ID NO: 8846 - DNA, 419 bp, Zea mays
  misc_feature: Ceres CLONE 374761-F
  misc_feature: Translation starting site: 165
  misc_feature (97)..(97): n is a, c, t, g, unknown, or other
ctcttcgcttctaactccgctgggccaccassttttgaccgccgcctcccttcccctccgctactgctcctccccaccccactcccccgcagagcgncggcggcggcggcgaggtcgtaccccacatcggcgagcggcggcgkcaccgcgatgssaaaggcaagatgttcgggcgckckccgaagaagagcgacaacaccaagtactacgagatcctcggggtgcccaagtcggcgtcccaggacgatctcaagaaggcctaccgcaagctgctatcaagaaccaccccgacaagggcggtgaccccgagaakttcaagggagctcgcacaagcctatgaggttttgagtgatccagagaaacgtggagattttatgatcagtatggtgaagatgcccttaaggaagggaatgggcggt

SEQ ID NO: 8847 - DNA, 656 bp, Zea mays
  misc_feature: Ceres CLONE 374770-R
ccaattgggtaccgggccccccctcgaggtcgacggtatcgatattttttttttttttttttgagtcataaaatctcagctcttcaaagatccagttataatgatgtacacgcatggtccactacaacaaaatactactactgtctcggaaaacaatccatgcatggagatatcccataccctaacaggcacataccagagggagaccagccatgtcgcttcttattatggctctctctctctctctcacacacacaaaacacaatcactttcttccatcaccagagctgctagacgccacacgcaagaccagctgccatcccagacgccgagcgagagctgagccgaaacagcaagctgtcatgtcaaaagcgatctaggggaagaagaacgggtttgtagtagccgggaactgcgccggcgggtgagacggcaggggcatgccgccgttggccccggcggcggtagagaatcctgatgatgctgcagagtggtgcaacggcacgtgaggggagccctgcgcttgccatgcccatgaggggaatggctgggcgcccagctcaggccttcgctccaccggcctttcctggacctggtggttcggaaagaagccatgacaagctgacgagtacaagcgctgatggtgagatgacact

SEQ ID NO: 8848 - DNA, 127 bp, Zea mays
  misc_feature: Ceres CLONE 374778-F
gctgcgggctgttgccttgcctccgtcccctcccctcgtcgcctccgtactccacctcccctccccggttctctgagagakggagcccggacccggagaccgccagcatagcgcgaggcagaggagg

SEQ ID NO: 8849 - DNA, 209 bp, Zea mays
  misc_feature: Ceres CLONE 374780-F
  misc_feature (65)..(65): n is a, c, t, g, unknown, or other
  misc_feature (139)..(139): n is a, c, t, g, unknown, or other
atcttgctctgaacgcattcctcccatctcccaagacctcctcagacccgagaagcgcakgcggnccatggacgccaccggcactggagctggagggaaggcgaagaagggagcggccggtcgcaaggccgcgggcganggaagaagtcggtgacgaggtccttgaaggccgggctccatttccccgtcggccgcatcgggcgctacct

SEQ ID NO: 8850 - DNA, 286 bp, Zea mays
  misc_feature: Ceres CLONE 374847-F
  misc_feature (126)..(126): n is a, c, t, g, unknown, or other
atcaaacaaaaaccctagccgccgcgccgccccgctccctagtggtcctccctcccccaccactgcagctccgtcccggcggccccaagagttgcggcgaggatgaacgtgaagggcggcacgganttccggtaccccctccgggccagcgcgctggtcaaggtggccgtgttcggcggcgcsscsstgttacgctgccatgaacagcctctacaacgtcgagggtgggcaccgcgccatcgtcttcaaccgcatccagggggatcaaggacaaggtataccccga

SEQ ID NO: 8851 - DNA, 730 bp, Zea mays
  misc_feature: Ceres CLONE 374856-R
  misc_feature (1)..(1): n is a, c, t, g, unknown, or other
ncgattgggtaccgggccccccctcgaggtcgacggtatcgataagcttttttttttttttttttgttctgcccaatctgctcctgcataaatagtggtgcgttgtttcccatgctcgtgcaggagttcaatttgtatctgtgagcagtcccagggaaatcagtgatgatcccgtccaccttagcaccttgcacataggcattaatctgtgaagtggcgtctgcgaagaagtcattcggctgagatgcaaactcattcatgagcacatagacgtaaacttggaggcccgcagactgaagggacgtgacaagcttattggtctggtttgtcaaataataatgggtctgtggtaaaacagatgtggtgctaacagagacggcattagcaaacttcttaatgtctgcaagggatgaaggtgcggcatctctgacaccttcttcaatcatgtagacaaggctgtacttggtttcctgcttgaacttctttagcaccgagctgttggttgactgaatcataacattctgggcagtctgtttgctataaccagagtcatcaagtgctttgaccactgcgtctaccactccaaatccaagcttctctgccatgaatgcagcatgctcaacagttatcatgattcctgacaaatcctttccctttgcaaacgtcaaaaagtcagataatctcatgaaatttcctgcattcttgtttctgggatttctgtacagtttat

SEQ ID NO: 8852 - DNA, 336 bp, Zea mays
  misc_feature: Ceres CLONE 374907-F
  misc_feature: Encodes the peptide sequence at SEQ ID NO. 8853
aaaaaaaatttcctccacctcccgaaccctaccggcggcgcmsagcattcacaactctatccacccgaagatggtgaagtttctgaagcccggcaaggccgtaatcctcctccagggcagattcgccggccggaagsssgtgatcgtgcgcgtgttcgaggagggcacccgcgaccgtccctatgggcactgcctcgtcgccggcctggccaagtaccccaagaaggtgatccgcaagactccgccaagaagacggccaagaagtcccgcgtcaagtgcttcatcaagctcgtskaatttcactcacctcatgcccacccgctacaccctcgabsg

SEQ ID NO: 8853 - protein, 87 aa, Zea mays
  misc_feature: Ceres CLONE 374907-F
  misc_feature (7)..(40): Pfam Name: KOW Pfam Description: KOW motif
  misc_feature (23)..(23): Xaa is any aa, unknown, or other
  misc_feature (75)..(75): Xaa is any aa, unknown, or other
MVKFLKPGKAVILLQGRFAGRKXVIVRVFEEGTRDRPYGHCLVAGLAKYPKKVIRKTPPRRRPRSPASSASSSSXNFTHLMPTRYTL

SEQ ID NO: 8854 - DNA, 435 bp, Zea mays
  misc_feature: Ceres CLONE 374915-F
  misc_feature: Encodes the peptide sequence at SEQ ID NO. 8855
  misc_feature (93)..(93): n is a, c, t, g, unknown, or other
  misc_feature (94)..(94): n is a, c, t, g, unknown, or other
  misc_feature (96)..(96): n is a, c, t, g, unknown, or other
  misc_feature (417)..(417): n is a, c, t, g, unknown, or other
aactccgttcattgcggcaggccggcagccaaatcgagatctcgcccgtgctgaatcccaccactctcgccgacccggccgcagcaagcgcannantcgacaggagccgaagaaccgaagaggagatggcgtcggcgctgtcctccctgcgctacggcgacassytctcggtggtgggcatctccgccgcgacggccgtgctctgcgaggccatktcctggctcctcatctaccgcaccgccacctacaactccctccgcgcctccatcgagcgccactcccgcaagctagacgccatgaagtccggctccacctccgcctcctccggcaccgcgccttccttccgcgcmssccgcatcgtcgcgggctaagaagatggaccgcgtcggagaccagccttaaggacgctgcgcgggnagctctcgctcgccaagc

SEQ ID NO: 8855 - protein, 81 aa, Zea mays
  misc_feature: Ceres CLONE 374915-F
  misc_feature (13)..(13): Xaa is any aa, unknown, or other
  misc_feature (14)..(14): Xaa is any aa, unknown, or other
  misc_feature (30)..(30): Xaa is any aa, unknown, or other
  misc_feature (76)..(76): Xaa is any aa, unknown, or other
MASALSSLRYGDXXSVVGISAATAVLCEAXSWLLIYRTATYNSLRASIERHSRKLDAMKSGSTSASSGTAPSFRAXRIVAG

SEQ ID NO: 8856 - DNA, 358 bp, Zea mays
  misc_feature: Ceres CLONE 374916-F
  misc_feature: Encodes the peptide sequence at SEQ ID NO. 8857
  misc_feature (230)..(230): n is a, c, t, g, unknown, or other
  misc_feature (303)..(303): n is a, c, t, g, unknown, or other
  misc_feature (322)..(322): n is a, c, t, g, unknown, or other
atcttgctctgaacgcattcctcccatctcccaagacctcctcagacccgagaagcgcmkgcggccatggacgccaccggcactggagctggagggaaggcgaagaagggagcggccggtcgcaaggccgcgggccgagggaagaagtcggtgacgaggtccgtgaaggccgggctccagttccccgtcggccgcatcgggcgctacctcaagaagggccgctacgscancgtcggcagcggtgcccccgtctacctcgcggccgtcctgggagtacctcgcccgctgaggtcctggagctcnccggcaacgctgccaaggncaacaagargacgcgcatcgtcccgcgccacgtgct

SEQ ID NO: 8857 - protein, 97 aa, Zea mays
  misc_feature: Ceres CLONE 374916-F
  misc_feature (54)..(54): Xaa is any aa, unknown, or other
  misc_feature (55)..(55): Xaa is any aa, unknown, or other
  misc_feature (86)..(86): Xaa is any aa, unknown, or other
  misc_feature (89)..(89): Xaa is any aa, unknown, or other
MDATGTGAGGKAKKGAAGRKAAGRGKKSVTRSVKAGLQFPVGRIGRYLKKGRYXXVGSGAPVYLAAVLGVPRPLRSWSSPATLPRXTRXRASSRATC

SEQ ID NO: 8858 - DNA, 228 bp, Zea mays
  misc_feature: Ceres CLONE 374951-F
ctctcaacctccgccgccgctcgcccggggcgtcacccacccgcgcagaaggcccccgccgctcaaattaccggtgccctaaaccccgatatcttcttcgcctccctttcctcctcagcaccccaaaccctgaccttcagggttccgccgccatgccgcaggagaccacatcgagcttcaccagaagcgccatggcaagcgcctggaccacgatgaacgcaagcgcaa

SEQ ID NO: 8859 - DNA, 450 bp, Zea mays
  misc_feature: Ceres CLONE 374952-F
  misc_feature: Encodes the peptide sequence at SEQ ID NO. 8860
aataaaatacgagggtcaaatctctcgtctcgctcggctcctctgggcccacagcggccagcaaactgcctccgtcctccctgcgggctgtgcgcctcttcttcgcgtcggcgccgccctcctcccttctcttctgctgctgatggaactggatcctcgcctctacgagaacgtctctgtcagcgacaacgatgtccgaaacatagttctatcttatcttatgcacaactgttttaaagggacggcagaggcattcctatctagcactgggttgaatttacctgtcgactatagtgtggatgtggataagcgtaaagcaatttttaattttgtgctagaagggaatgcccttaaagccatagagctgacagaagaaatggcacctaacttgctagagaatgatatggatctacattttgatcttcttagtctccacttcattgagctagt

SEQ ID NO: 8860 - protein, 102 aa, Zea mays
  misc_feature: Ceres CLONE 374952-F
MELDPRLYENVSVSDNDVRNIVLSYLMHNCFKGTAEAFLSSTGLNLPVDYSVDVDKRKAIFNFVLEGNALKAIELTEEMAPNLLENDMDLHFDLLSLHFIEL

SEQ ID NO: 8861 - DNA, 256 bp, Zea mays
  misc_feature: Ceres CLONE 374972-F
  misc_feature: Encodes the peptide sequence at SEQ ID NO. 8862
atggccaagtgcattgccaccgtgctcgccgtcgcggccgtgctcacgtcggtgcagccatcggtggcggcgagcaacccggcggacgsatcgcgctccggttccctggccgcccgggcagcaggccgcgtaaccccgtgttcccggggtaccgagatcgaggccgtcgccgccggtgtccagcggctcgtcctccccggtggtgccgtcacccatgcccggcctgccgtcgtcgtcgggtccagtgtcgccggcg

SEQ ID NO: 8862 - protein, 85 aa, Zea mays
  misc_feature: Ceres CLONE 374972-F
  misc_feature (30)..(30): Xaa is any aa, unknown, or other
MAKCIATVLAVAAVLTSVQPSVAASNPADXSRSGSLAARAAGRVTPCSRGTEIEAVAAGVQRLVLPGGAVTHARPAVVVGSSVAG

SEQ ID NO: 8863 - DNA, 750 bp, Zea mays
  misc_feature: Ceres CLONE 374995-R
tcgaggtcgacggtatcgataagcttttttttttttttttttacacgatggaaagtctggcggtgctttattcttattcctcggagcaaacagagtacaaaacagtcggtgctctcggcgacaataatgaaccaataggtagtttgtacataggggggatgaataccttaaacaatcaatttgacaaaaacaggcggagttccttatgaaatggaagcctgcctaggcgctgcgcgggatggagcgcgagatagccgacccccccgcgtcgtcgatccccgccgccgagcccctctcggaaatggcccaggactgggagggggaggccgccgccgaagcagtggggttcaccctcatcacccacaacatctacgcctctaacaactttatcgacagcccacccccttcgtttatcagtaacagcaaaaaaagcaaccaaaaccgctttagattggaaagacatctacgcacctgctcaagttcccaagtcaacaacacatcagttgaatgcaactatcttgaaaaccatggaaactgacatacttgggtccctccaccgcatcagaaattcatgttgatacattgttataactgccccccaaatctttgccaaaaagttcaatctaaagaaggcttccataaagacctctgccaacaagaaactcccggctaaacatattttgcgcccttatataactctcctaaattccctctatatccccttcagccatggggaccaagtcaacaaaa

SEQ ID NO: 8864 - DNA, 444 bp, Zea mays
  misc_feature: Ceres CLONE 375009-F
  misc_feature: Encodes the peptide sequence at SEQ ID NO. 8865
  misc_feature (263)..(263): n is a, c, t, g, unknown, or other
  misc_feature (327)..(327): n is a, c, t, g, unknown, or other
agtccaaacacgcaacgcaacactcgccttcccctcccaaccctccgaaccgaagcagcaaagctagacgatgacgctgacgatcccggacgaggtgcgcgccaaggcggaggtgtacgtgggcgaygcggcggggcaggagawgaygcggctkctcctccaggagaycgggcctcccgawdcwrggctgctcccgctgcgggacatcatcgagtgcggctacgtggaggagacgggcttcgtgtggctccggcagcgcscanaggtggaccactacttcgccaaggccggccgccacgtgtcctacggcgccgaggtgtcggcggntggccgaaaggggccggctcaagaagatcacgggcgtcaaggccaaggagatmctgctgtgggtcacctccacgagatctgcgtcgacgacccgcccacgggtaagctccactgcaa

SEQ ID NO: 8865 - protein, 124 aa, Zea mays
  misc_feature: Ceres CLONE 375009-F
  misc_feature (25)..(25): Xaa is any aa, unknown, or other
  misc_feature (26)..(26): Xaa is any aa, unknown, or other
  misc_feature (33)..(33): Xaa is any aa, unknown, or other
  misc_feature (37)..(37): Xaa is any aa, unknown, or other
  misc_feature (38)..(38): Xaa is any aa, unknown, or other
  misc_feature (39)..(39): Xaa is any aa, unknown, or other
  misc_feature (64)..(64): Xaa is any aa, unknown, or other
  misc_feature (65)..(65): Xaa is any aa, unknown, or other
  misc_feature (86)..(86): Xaa is any aa, unknown, or other
  misc_feature (104)..(104): Xaa is any aa, unknown, or other
MTLTIPDEVRAKAEVYVGDAAGQEXXRLLLQEXGPPXXXLLPLRDIIECGYVEETGFVWLRQRXXVDHYFAKAGRHVSYGAEVSAXGRKGPAQEDHGRQGQGDXAVGHLHEICVDDPPTGKLHC

SEQ ID NO: 8866 - DNA, 206 bp, Zea mays
  misc_feature: Ceres CLONE 375010-F
  misc_feature: Encodes the peptide sequence at SEQ ID NO. 8867
  misc_feature (66)..(66): n is a, c, t, g, unknown, or other
  misc_feature (141)..(141): n is a, c, t, g, unknown, or other
atcttgctctgaacgcattcctcccagtctcccaagacctcctcagacccgagaagcgcmkgcggnccatggacgccaccggcactggagctggagggaaggcgaagaagggagcggccggtcgcaaggccgcgggccganggaagaagtcggtgacgaggtccgtgaaggccgggctccagttccccgtcggccgcatcgggcgc

SEQ ID NO: 8867 - protein, 46 aa, Zea mays
  misc_feature: Ceres CLONE 375010-F
  misc_feature (25)..(25): Xaa is any aa, unknown, or other
MDATGTGAGGKAKKGAAGRKAAGRXKKSVTRSVKAGLQFPVGRIGR

SEQ ID NO: 8868 - DNA, 343 bp, Zea mays
  misc_feature: Ceres CLONE 375016-F
  misc_feature: Translation starting site: 121
ayagcacaagaacactcctagctagctgaagatctcgagtgcaassaacgttggcgcttggcggccagtagtagcagctaatttagcgtcgctccttcctagacgagagatcgakaaaccatggcyaagctcyaagtcactcctggcgccgcgttcaccgagtgcaatgaactcaacttccagggcctgtacctgtaccacacgcccctgggccccaakgcaaccaagctgcgatcgtagagagcaaggccaakatcggcatcggtgccaccgtggttaacaactgggcagtgtatgacgggccagggccaggcgctaagctcgtcggccgtgcgcagggctt

SEQ ID NO: 8869 - DNA, 492 bp, Zea mays
  misc_feature: Ceres CLONE 375017-F
  misc_feature: Encodes the peptide sequence at SEQ ID NO. 8870
  misc_feature (420)..(420): n is a, c, t, g, unknown, or other
  misc_feature (421)..(421): n is a, c, t, g, unknown, or other
gcggatgggctcggtctcgcggggctagggtttggtcggtcgtctcgtcggcgtcgagggcgccggcgctgctagctagtagtagctcgctcgcgctagggttctcaggagccatggtgatgcagcgcttctcgtggccgtacggaggccggagcgcctccttgtgcggcagcttcaccgggtggagggagtatcccatggggctggtcggggccgagttccaggtcgtcttcgatctgcctcccggggtttaccagtaccggtttttggttgatggtgtctggaggtgtgatgagacgaaaccctttgtatgtgatgaatatggactgatcagcaatgaagtgcttgtggaaaacaatgtgcaacctgttgtgcagccagagccttctatcagaggaactaatttggatgagggtaccnntttgacaacaatgcccccggagtcatcatctcagaacccaggcgtgcaaatagcagtttttaagataacaa

SEQ ID NO: 8870 - protein, 126 aa, Zea mays
  misc_feature: Ceres CLONE 375017-F
  misc_feature (103)..(103): Xaa is any aa, unknown, or other
MVMQRFSWPYGGRSASLCGSFTGWREYPMGLVGAEFQVVFDLPPGVYQYRFLVDGVWRCDETKPFVCDEYGLISNEVLVENNVQPVVQPEPSIRGTNLDEGTXLTTMPPESSSQNPGVQIAVFKIT

SEQ ID NO: 8871 - DNA, 368 bp, Zea mays
  misc_feature: Ceres CLONE 375054-F
  misc_feature (247)..(247): n is a, c, t, g, unknown, or other
  misc_feature (347)..(347): n is a, c, t, g, unknown, or other
ataaatggagttctttgtgtcaaatgaacgctagctgaaccctagccggcggatctccgcgggcggcagtcaggagtggaggcgtggtcgcacgggcgaggtcgcaataggagaggctcagagagatggggcggccttacgcggtgaaggggcggaagaagaagcgcaactcgaggaggcggcggcggcggcctcggacgctgccccgcccgtcgaagaagcggaggagctgccaccgccagatgtnagaagcggcgaggaaaagagcagcgaggaggatgaggcagcagcgggggaggaggagcacgcggcggcggacgggctcccaatcctaccaaggacggttnatgggaagckgcgacccggcg

SEQ ID NO: 8872 - DNA, 401 bp, Zea mays
  misc_feature: Ceres CLONE 375082-F
  misc_feature: Encodes the peptide sequence at SEQ ID NO. 8873
aaaaagtgctctctcagaggtgggctggcttctcctccccctcttaccaagtcctcttcgggttagggttacttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggcggtcgcggcggcgg

SEQ ID NO: 8873 - protein, 102 aa, Zea mays
  misc_feature: Ceres CLONE 375082-F
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAAADVEYRCFVGGLAWATSNESLENAFASYGEILDSKVITDRETGRSRGFGFVTFSSENSMLDAIENMNGKELDGRNITVNQAQSRGGGGGGGGYGGGRGG

SEQ ID NO: 8874 - DNA, 480 bp, Zea mays
  misc_feature: Ceres CLONE 375118-F
  misc_feature: Encodes the peptide sequence at SEQ ID NO. 8875
aatgaagtcgccgaaccacctcctatcggtaccaaactagcagcgccaatggggtcagggtgagaccgccgacgctgttcctcaacttcgccatcggtcggagtctgccaggcggccgggtttgggaacgccaatgccgggagagaaattaagatcgacctgtgtggatcttcctcaagcgcgagatgtagggatggatggcctcggccatggtgttcccttgccggtgcgggtctcgccgcggtgccgcaaccccgacgtggaccgatctcgtctcaaccttgtcgctgacgagcaagctacagaggattctgaggttcagctggtagagactgctgagcaggagctcgttgaaggagaagaataggtggttcaagtggagccaagtatcgaggagttcgattcgatctaggtggcgtctcccagtcagctttctggcgccaaggatagattttagatcctgcgatatttatctcttat

SEQ ID NO: 8875 - protein, 77 aa, Zea mays; identical to SEQ ID NO: 7792
  misc_feature: Ceres CLONE 375118-F

SEQ ID NO: 8876 - DNA, 190 bp, Zea mays
  misc_feature: Ceres CLONE 375130-F
  misc_feature (137)..(137): n is a, c, t, g, unknown, or other
acgatcacacaccactccacagcagtagcaagagggatagagcaaggccacacacacacacacaccactaggctaggttagmcwtttaatcgtcgtcgagaagcaagaagggcgcgcacgctaagctagggcaagcnagaagagagccgatcgaccgagagctagcacgcgatggcgaggtcttccaagg

SEQ ID NO: 8877 - DNA, 247 bp, Zea mays
  misc_feature: Ceres CLONE 375135-F
  misc_feature: Encodes the peptide sequence at SEQ ID NO. 8878
  misc_feature (117)..(117): n is a, c, t, g, unknown, or other
  misc_feature (118)..(118): n is a, c, t, g, unknown, or other
accgcgtcaaaccccagcacaaatcaaccgcccgccgcctccgctcccctcccgtcccgaatcagccgccgcggtgycaatccggccgatcccccctcctatccgccgcagaggssnncctctggggcmtaccccgatgtatagcaacttcaaggagcaggcgatcgagtacgtcaagcaggcggtccaggaggacaatgccggcaactacgtcaaggcgttccctctctacatgaacgcggctcga

SEQ ID NO: 8878 - protein, 37 aa, Zea mays
  misc_feature: Ceres CLONE 375135-F
MYSNFKEQAIEYVKQAVQEDNAGNYVKAFPLYMNAAR

SEQ ID NO: 8879 - DNA, 404 bp, Zea mays
  misc_feature: Ceres CLONE 375150-F
  misc_feature: Encodes the peptide sequence at SEQ ID NO. 8880
  misc_feature (134)..(134): n is a, c, t, g, unknown, or other
  misc_feature (138)..(138): n is a, c, t, g, unknown, or other
gaccaacccaaccgtgggggtgccgggtgccctacggcctacgggcsagcagcgcttgggagccgcggcacggaggcatcgacgccgttgagctcgaggcgaccggcggctggcggccccgcacagcgttgctnaggntgtggcttcttctggtttctgcgggctcagcgcggaggcctattgcaggattaaatggcaaatagggcaagatggatgatgaagtacgaaaagggtcttgttgatatacttcatgagaacaacacttcacattatcgtacccaaaacggttggagaacagaggggtggaggaaaattgttagggatttcaatgtacggtaccctgaagcaaagtttagtaaaatgcaaatccaggaacatgagactcaattgaaggaaagactaca

SEQ ID NO: 8880 - protein, 70 aa, Zea mays
  misc_feature: Ceres CLONE 375150-F
MANRARWMMKYEKGLVDILHENNTSHYRTQNGWRTEGWRKIVRDFNVRYPEAKFSKMQIQEHETQLKERL

SEQ ID NO: 8881 - DNA, 441 bp, Zea mays
  misc_feature: Ceres CLONE 375157-F
  misc_feature: Encodes the peptide sequence at SEQ ID NO. 8882
  misc_feature (188)..(188): n is a, c, t, g, unknown, or other
agcacggacaactctacccctccgcctcgaccctgaccccccacctcgtcggcgatgagttcctcttccaacggcgggaagaagccggctcccggsgcggcsscaggggtcccgccatccgcacgctcgctgacataagccgtgggcccaccggcttcccaggtgccggassgcgacassggcassdncgacgacgagccacaggaatactacaccggtggcgagaagagtggaatgctttttcaagatccaacaagaagaaatgatgtggatgcgatatttgaacaagccagacaagcgggttatcaaaggaatgcctcctcctcttgtatgggcgagtcttccagctctaggagctttacagggactggccgacttcttacaggggagacaatatcatctgctgcacctcaggaaccagtaccaattcgatacgccaca

SEQ ID NO: 8882 - protein, 69 aa, Zea mays
  misc_feature: Ceres CLONE 375157-F
MLFQDPTRRNDVDAIFEQARQAGYQRNASSSCMGESSSSRSFTGTGRLLTGETISSAAPQEPVPIRYAT

SEQ ID NO: 8883 - DNA, 103 bp, Zea mays
  misc_feature: Ceres CLONE 375165-F
aggtagcagctgcctgagccagtgcgcctcggtgagcagacaggaacgcatagaatagacatggcggccgcggtggagggggtgcggcaccgaacgctggagg

SEQ ID NO: 8884 - DNA, 262 bp, Zea mays
  misc_feature: Ceres CLONE 375169-F
  misc_feature: Encodes the peptide sequence at SEQ ID NO. 8885
aaacccaacaggcggcgcmsagcatcgccaccaccgtccaaagatggtgaagttcctcaagcccggcaaggccgttatcctcctccagggccggttcgccggcggaagysgtattcgtgcgcgttttcgaggagggcacccgtgatcgtccctacggcactgcctcgtcgcgggcctcgccaagtaccccaagaaggtgatccgcaagacttccgccaagaagacggccaagaagtcccgcgtcaagtgcttcatcaagctc

SEQ ID NO: 8885 - protein, 33 aa, Zea mays
  misc_feature: Ceres CLONE 375169-F
  misc_feature (23)..(23): Xaa is any aa, unknown, or other
MVKFLKPGKAVILLQGRFAGGSXIRARFRGGHP

SEQ ID NO: 8886 - DNA, 159 bp, Zea mays
  misc_feature: Ceres CLONE 375183-F
  misc_feature (24)..(24): n is a, c, t, g, unknown, or other
gtttttcaatccttcaagcgcaangcctcctcctcgtcgtccggtcgtgagaagggatggcgggccgtggcaaggctatcggcgctggcgsscgaagaaggcaacgtcgaggagctccaaggccggactccagttccccgtcggcaggattgccaggtt

SEQ ID NO: 8887 - DNA, 435 bp, Zea mays
  misc_feature: Ceres CLONE 375187-F
  misc_feature: Encodes the peptide sequence at SEQ ID NO. 8888
  misc_feature (354)..(354): n is a, c, t, g, unknown, or other
  misc_feature (359)..(359): n is a, c, t, g, unknown, or other
  misc_feature (360)..(360): n is a, c, t, g, unknown, or other
agatcagaaccaaactcggctcgagagagatcgcatacgcctgcctgcccacccacctccccttttccttcctcttcgccccagcgacgcggccgcccggagaccgagcgaggcaggcaactaaccaccgagaggcagggacaggaacaggaagccggavsaagatttcgtcggtgttcagcggcgatgagacggcccccttcttcggcttcctcggcgccgcgccgccctcgtcttctcatgcatgggcgccgcgtacgggaccgcgaagagcggcgtcggcgtggcgtcgatgggtgtgatgcggccggagctcgtcatgaagtccatcgtgcccgtggtcatggctggtgnrctcnnttatctacgggctcatcatcgccgtcatcattagcacggggattcaaccccaaggccaagccctactacctcttt

SEQ ID NO: 8888 - protein, 49 aa, Zea mays
  misc_feature: Ceres CLONE 375187-F
  misc_feature: SWISSPROT Homolog: EC 3.6.3.14 H(+)-transporting two-sector ATPase
  misc_feature (37)..(37): Xaa is any aa, unknown, or other
  misc_feature (39)..(39): Xaa is any aa, unknown, or other
MGAAYGTAKSGVGVASMGVMRPELVMKSIVPVVMAGXLXYLRAHHRRHH

SEQ ID NO: 8889 - DNA, 482 bp, Zea mays
  misc_feature: Ceres CLONE 375193-F
  misc_feature: Encodes the peptide sequence at SEQ ID NO. 8890
attcctcggagraggaagccgccgtcgcagcaatcacagcagcccggagaacggccaggtccgacaagatgcagatctttgtgaagacgctgacagggaagaccatcaccctcgaggtcgagagcagcgacaccatcgacaatgtcaaggccaagatccaggacaaggaagggatcccgccggaccagcagcggctgatctttgccgggaagcagctggaggatggccgcacccttgcggactataacatccaaaaggagtctacgctccacctcgtgctcaggctccgcggtggcatcattgagccctcgctgcaggssctcgctcgcaagtacaaccaggacaagatgatctgccgcaagtagaagtggtggagggtgtttttgcaaaaatacagggcagcgagatggctgttggatccagaatgaattgtcgcaatttaatatatgtaccatgtacaccaaaggtgacacagatgctat

SEQ ID NO: 8890 - protein, 98 aa, Zea mays
  misc_feature: Ceres CLONE 375193-F
  misc_feature (6)..(74): Pfam Name: ubiquitin Pfam Description: Ubiquitin family
  misc_feature: SWISSPROT Homolog: EC 3.1.2.15 Ubiquitin thiolesterase
  misc_feature (84)..(84): Xaa is any aa, unknown, or other
MQIFVKTLTGKTITLEVESSDTIDNVKAKIQDKEGIPPDQQRLIFAGKQLEDGRTLADYNIQKESTLHLVLRLRGGIIEPSLQXLARKYNQDKMICRK

SEQ ID NO: 8891 - DNA, 212 bp, Zea mays
  misc_feature: Ceres CLONE 375200-F
gtgcccgckgtgctagtgacggttgctctagatccgttcatcctggtggttttgtgaggtcgaaagcggcgagcrattagaagatgctggacaagctgtgggacgacgtggtggccgggcctcgccgaggacggssctcgagaagctccgcaaggccaccaccgcccgcccgctcgtcatcaacaaagacgcggacggcggcasstacaagc

SEQ ID NO: 8892 - DNA, 359 bp, Zea mays
  misc_feature: Ceres CLONE 375223-F
  misc_feature: Translation starting site: 164
  misc_feature (101)..(101): n is a, c, t, g, unknown, or other
ctcttcgcttctaactcctctgggccaccagctttgaccgccgcctcccttcccctccgctactgctcctcctcaccccactcccccgcagagcgcggcgncggcggcgaggtcgtaccccacatcggcgagcggcggcggcaccgcgtagggcaaaggcaagatgttcgggcgcgcgccgaaraagagcgacaacaccaagtactacgagatcctcggggtgcccaagtcggcgtcccaggacgatctcaagaaggcctaccgcaagctgctatcaagarccaccccgacaaggcggtgaccccgagaagttcaaggagctcgcacaagcctatgaggttttgagtgatccaggagaa

SEQ ID NO: 8893 - DNA, 378 bp, Zea mays
  misc_feature: Ceres CLONE 375232-F
  misc_feature (130)..(130): n is a, c, t, g, unknown, or other
ctcttccccccactacccaaacccaacaggcggcgcmsagcatcgccaccaccgtccaaagatggtgaagttcctcaagcccggcaaggccgttatcctcctccagggccggttcgccggcggaagctgnattcgtgcgcgttttcgaggagggcacccgtgatcgtccctacgggcactgcctcgtcgcgggcctcgccaagtaccccaagaaggtgatccgcaagactccgccaagaagacggccaagaagtcccgcgtcaagtgcttcatcaagctcgtcaacttcacgcacctcatgcccacccgctacaccctcgacgtcgacttcaaggacgtcgcatcgggcgggcccgacgcgctctccacccgggacaa

SEQ ID NO: 8894 - DNA, 480 bp, Zea mays
  misc_feature: Ceres CLONE 375235-F
  misc_feature: Encodes the peptide sequence at SEQ ID NO. 8895
acactcacacgcacacgtaaagctcgatcgctctctgtgctccctcctcctgcctcctgcacacgcatacactcagagagcatagtascagtataggatgatgataraacaccaacgcgatgtcgccgacagcaagtaccgacgccgacttctcgttcggccccttgcagccctacgtcggcttcgacgtcgccggcatgggcatgcccagcgtcgtcgtcgagcggtcgtcgtcgctactgcagcacaacaccagcagcagcagccacaacaacaacctagggctatacgacagtttcgacttcgcggccgccgcagggttaccgttccaagaatctggtctcctgccccctgcgagcctgccgctggcgccgtcgccgccaagcatggcggccatggcaatgccaccgtcgtcgctgctgctgacgctcccaggcgtgcctgcggcggcggatgtcgtctataacccctttggtggcg

SEQ ID NO: 8895 - protein, 120 aa, Zea mays
  misc_feature: Ceres CLONE 375235-F
MSPTASTDADFSFGPLQPYVGFDVAGMGMPSVVVERSSSLLQHNTSSSSHNNNLGLYDSFDFAAAAGLPFQESGLLPPASLPLAPSPPSMAAMAMPPSSLLLTLPGVPAAADVVYNPFGG

SEQ ID NO: 8896 - DNA, 738 bp, Zea mays
  misc_feature: Ceres CLONE 375236-R
  misc_feature: SWISSPROT Homolog: EC 2.7.11.1 Non-specific serine/threonine protein kinase
  misc_feature (1)..(1): n is a, c, t, g, unknown, or other
  misc_feature (2)..(2): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (23)..(23): n is a, c, t, g, unknown, or other
nnttggggctgggaaaacnnntncaaaccgaataataatatatcccccgcttttttttacaattgggtaccgggccccccctcgaggtcgacggtatcgataagcttttttttttttttttttgaccacgaacaatctgaatagattgggaaaggaatcaaccgaaccgtttttgataacagcgacgagcctgattgccgccgcttcctcaatgtccagaagacaggaacccttctggtttttgcccccaaaccgagcaggcaactcgggtcattcctcatgtactaaggtatctatgccacacagttaccggccttaaaaagcggaattctcacgtgtgtccacaatatttaagcacggccacggaccccaccttggttaccacctttagaaccagctccgccccttcctcggccagcactgcctctacgtccataattttgaccacctccgatgcctctgcctaccggttaaccacccccaccaccgattgtgccatccgcaagcttctttgccaatacatagtcatccttgcagaaggttggggggaaaaggttttcggctaaggctatgacgaacatgtccaataaaccctgcgcgacgtcgggtgtggaccaaaagtacgacacggtaacgaaggcaagcgtgaccccctggagcctgatggtgaggccatcgttccgggggagcgtgctgcggtagatgacgttgcctcactgcatgacagtgcaaggggag

SEQ ID NO: 8897 - DNA, 231 bp, Zea mays
  misc_feature: Ceres CLONE 375250-F
accaggccgccttcgtcttcgtcccgttccctccagtccggctatataacccgcgcgccctcccatccgccgctccattccgtcgtcgtcgtcagcagcttctgcttgctttgtgggggaaggagagagagagagagcgagagagagatctagtagagaggctagtaggtggtcctcgaacgaagatgttggcggtgttcagcgggcaggtggtggaggtgccggcggact

SEQ ID NO: 8898 - DNA, 215 bp, Zea mays
  misc_feature: Ceres CLONE 375251-F
  misc_feature: Encodes the peptide sequence at SEQ ID NO. 8899
  misc_feature (95)..(95): n is a, c, t, g, unknown, or other
  misc_feature (96)..(96): n is a, c, t, g, unknown, or other
  misc_feature (98)..(98): n is a, c, t, g, unknown, or other
  misc_feature (106)..(106): n is a, c, t, g, unknown, or other
actggctccctgcgttgcgtcttgggggagagagagaagtgggagaccgcgagaggctgccgtgtagggactagggaccgtagagtaagcgacannanggaggganagggggatggccgggatcgggccgatcagacaggactgggagccggtggttgtgcggaagaaggcacccaccgccgctgccaagaaggatgagaaggccgtcaacgccg

SEQ ID NO: 8899 - protein, 34 aa, Zea mays
  misc_feature: Ceres CLONE 375251-F
MAGIGPIRQDWEPVVVRKKAPTAAAKKDEKAVNA

SEQ ID NO: 8900 - DNA, 397 bp, Zea mays
  misc_feature: Ceres CLONE 375276-F
  misc_feature: Translation starting site: 228
  misc_feature: SWISSPROT Homolog: EC 2.7.1.4 Fructokinase
  misc_feature: SWISSPROT Homolog: EC 5.2.1.8 Peptidylprolyl isomerase
cgggttcgtgggtgagcggatcgagatggcggcgtcggatgttgagtaccgctgcttcgtcggcggcctcgctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgcatcgagggcatgaacggcaaggagctggacggccgcaacatcaccgtcaacgaggcgamsstccgcgaggctctcaagttctccaacgcctgcggcccatctgcaccaccaagaagggcgccatcccggcssytgcccacggtcgccaccgcccaggacctcatcgccaaggccaacta

SEQ ID NO: 8901 - DNA, 289 bp, Zea mays
  misc_feature: Ceres CLONE 375284-F
awattattgagagcccaggaagtgagagatgagcctgcagattccggtgagatcaggcgccctgcgcacttctccttctaggtggcgccgagggtctactgcgcacctactccaccggcgaccggcgccggcgggtgatccgcgaggcaaggcaagaggaggaggacgaagcgttcctccgcaccctcaacttcgggssgctgaccccgagaacaacccttcttcccccgccgccgaggcatggcagaggattatccgassgcctcagccgggaagcagcagcagcagc

SEQ ID NO: 8902 - DNA, 428 bp, Zea mays
  misc_feature: Ceres CLONE 375324-F
  misc_feature: Encodes the peptide sequence at SEQ ID NO. 8903
  misc_feature (192)..(192): n is a, c, t, g, unknown, or other
aactgccagacccaagccaacaagcaagaccgcttctgcttgtgatccgaaacctttcttcgaacaaaaagaaccccacccgacgtaccgcgagccggcgatggcgacggtggcgatggacatctcgaagcccacgccggcagcgtccggtgacgaggcagcagcggcggcgaakgggaggagcggcggcgngggcgaggggctgcggcagtactacctgcagcacatccatgacctgcagctccagatccggcagaagacccataacctcaaccgcctcgaggcccagcgcaacgacctcaactcccgagttagaatgctcagggaagagttgcagttgcttcaagagcctggctcatatgttggtgaggtggtgaaggtcatggggaaatcaaaggttctggtgaaggtacatcccgaagcaaata

SEQ ID NO: 8903 - protein, 109 aa, Zea mays
  misc_feature: Ceres CLONE 375324-F
  misc_feature (25)..(25): Xaa is any aa, unknown, or other
  misc_feature (31)..(31): Xaa is any aa, unknown, or other
MATVAMDISKPTPAASGDEAAAAAXGRSGGXGEGLRQYYLQHIHDLQLQIRQKTHNLNRLEAQRNDLNSRVRMLREELQLLQEPGSYVGEVVKVMGKSKVLVKVHPEAN

SEQ ID NO: 8904 - DNA, 112 bp, Zea mays
  misc_feature: Ceres CLONE 375337-F
ctcatcacaggcaacaaggcaccacacctcttcttcttcttcctcctcctcctagcacagctagcgcstgytccccttcgcctgtgatcactagtctctgcagcagcggcaa

SEQ ID NO: 8905 - DNA, 489 bp, Zea mays
  misc_feature: Ceres CLONE 375349-F
  misc_feature: Encodes the peptide sequence at SEQ ID NO. 8906
  misc_feature (440)..(440): n is a, c, t, g, unknown, or other
  misc_feature (479)..(479): n is a, c, t, g, unknown, or other
agtagttgccgatccccattccaaacatgaccgttggggcgctgtgccgctgtcgccttcctgagatccccaaaaccccgacgccgcgctctcccacctggcacccgagaatactcgcgctcgcgcactcgacattcctcgccccccacgccggttcaccctgcgcgcacsstccagcatctcgcaatcccccgggcggaggcgtatgtcctgcgccgtggcgatgccgatcgacttgctccacgctccagctccgtgggaggaggaggtgaaggcggttgaggaggacgaggaggaggtggagggagtaggatgcggcggaggggccgtggtggtggtcgcggcggacgcggaaggcggaggggtcacccctacgacttccacgtgtccgggccgcgcaacctgccgccgcccaactggaaggagataatcagatcganctggaaggatccaaattacaaaaggatggtaatggcctnctttcattca

SEQ ID NO: 8906 - protein, 59 aa, Zea mays
  misc_feature: Ceres CLONE 375349-F
  misc_feature (43)..(43): Xaa is any aa, unknown, or other
  misc_feature (56)..(56): Xaa is any aa, unknown, or other
MRRRGRGGGRGGRGRRRGHPYDFHVSGPRNLPPPNWKEIIRSXWKDPNYKRMVMAXFHS

SEQ ID NO: 8907 - DNA, 231 bp, Zea mays
  misc_feature: Ceres CLONE 375355-F
  misc_feature (210)..(210): n is a, c, t, g, unknown, or other
aacaggaggcgcgtctctgcaagtctgcactcgcacggacgagcgaggcagccccgcagtcgcagccacaacccaagcgcmssttctgcctccgctccggctcagctcccgccctgcctccgccttccattccgccgcgcgcgctrccgagtgccgacgtcgtccccgccggagtttctggtttctgggttggatctctcggagtcggancgagcgaggatgggcggcggc

SEQ ID NO: 8908 - DNA, 344 bp, Zea mays
  misc_feature: Ceres CLONE 375371-F
  misc_feature: Translation starting site: 84
  misc_feature: SWISSPROT Homolog: EC 2.7.7.6 DNA-directed RNA polymerase
  misc_feature (221)..(221): n is a, c, t, g, unknown, or other
  misc_feature (222)..(222): n is a, c, t, g, unknown, or other
  misc_feature (224)..(224): n is a, c, t, g, unknown, or other
aaaaaccctagcaagcaaaccaccggagcagcggcgctcgcgcgggcggassattggcggacgacgattacaacgaaatcgacatgggctatgaggatgagcctccagaacctgagattgaggaaggggccgaagaagagcttgagaacaacgaagatgcccctgatgatgtcataggtggagagggtgaagataaggaacaggaaaagaccaagcgtgannanaaacaacaaaatatatgacgaagtatgaacgtgcgcgcattcttggtacacgagccttgcagataagcatgaatgctccagtcatggttgagcttgagggagaaactgaccctcttgaga

SEQ ID NO: 8909 - DNA, 393 bp, Zea mays
  misc_feature: Ceres CLONE 375391-F
  misc_feature: Encodes the peptide sequence at SEQ ID NO. 8910
  misc_feature (128)..(128): n is a, c, t, g, unknown, or other
  misc_feature (129)..(129): n is a, c, t, g, unknown, or other
ataccatccatcgatcgatcaacaatacataggcaatccatctcctcccacatgtacagctcgctttccgatctagcaatgtcaacgggagcaacggagatgatcgtagccaccgccgatgccgccanngcaccaggtgcatgtcgtcgacggcgagagcaggacgtgatcgtgtccaccgccgtgccaccgcggccggcaccaagtgcacatgttcaagatcgacggctacaagcggatcaaggccatgtacggcaagggcaggagcatcgactcctgcaggttcgaggtggctggccgcgcatggaagatcctcttcttccccaacggcgactgcgggacaccgcgggccacgtctccctcttcctcaagctggacgacgacgacaccgtc

SEQ ID NO: 8910 - protein, 60 aa, Zea mays
  misc_feature: Ceres CLONE 375391-F
MFKIDGYKRIKAMYGKGRSIDSCRFEVAGRAWKILFFPNGDCGTPRATSPSSSSWTTTTP

SEQ ID NO: 8911 - DNA, 304 bp, Zea mays
  misc_feature: Ceres CLONE 375393-F
  misc_feature: Translation starting site: 68
  misc_feature (65)..(65): n is a, c, t, g, unknown, or other
  misc_feature (141)..(141): n is a, c, t, g, unknown, or other
atcttgctctgaacgcattcctcccatctcccaagacctcctcagacccgagaagcgcmkgcggnccatggacgccaccggcactggagctggagggaaggcgaagaagggagcggccggtcgcaaggccgcgggggcganggaagaagtcggtgacgaggtccgtgaaggccgggctccagttccccgtcggccgcatcgggcgctacctcaagawgggccgctacgcgcasscgtcggcagcggtgcccccgtctacctcgcggmcgtcctggagtacctcgccgctgaggtcctggagctc

SEQ ID NO: 8912 - DNA, 497 bp, Zea mays
  misc_feature: Ceres CLONE 375397-F
  misc_feature: Encodes the peptide sequence at SEQ ID NO. 8913
  misc_feature (337)..(337): n is a, c, t, g, unknown, or other
acaagtagccccgcgcgccacctcgctgccggccgccggsacacagatagagaaagagagagagactgagagagagagggaggggaagcgaagagaccagaacaagagcgaagatggtcggactcctccccgagaccaatgccgcggcggagacggacgtcctcctcgacgcctgggacttcaagggccggccgagcagcaacgaccgagccctggccgagctgccctcccccgacgcgcacctctctccatcacgccgagccgagccctgtcaggacggtacagctacagcggcaagcagccgacgacacctctctccatcacgccagcgacascncggatgagccactgaagaaggacgggtcgttctttgatttcctcggcgtcgggcgaactgcatgcggtagtagctgacaagtattcagggttagagttcatcgacattgatggttacagtgttctcatcatcatgtggtgattcatcagtcaaataaggc

SEQ ID NO: 8913 - protein, 91 aa, Zea mays
  misc_feature: Ceres CLONE 375397-F
  misc_feature (66)..(66): Xaa is any aa, unknown, or other
  misc_feature (67)..(67): Xaa is any aa, unknown, or other
MPRRRRTSSSTPGTSRAGRAATTEPWPSCPPPTRTSLHHAEPSPVRTVQLQRQAADDTSLHHASDXXDEPLKKDGSFFDFLGVGRTACGSS

SEQ ID NO: 8914 - DNA, 354 bp, Zea mays
  misc_feature: Ceres CLONE 375442-F
  misc_feature (239)..(239): n is a, c, t, g, unknown, or other
ttcccaccgatccatttcagccgccgccgcgcgtassaagcaggagcagcaaggatgccggctggccacgggctgcgctcgcggacgsscgacctgttcgcgccccttccgcaagaagggctacatcccgctcaccacctacctccgcacctacaagatcggcgactacgtssasstccaaggtgaacggcgccgtccacaaggggatgccgcacaagttttaccacggccgcaccggntcgcgtctgggaacgtcaccaagcgcgccatcgsstcgagataaacaagcaggtgaatggtcgcatcatcaggaamcgtatccatgtccgcktggagcattttgcagccgtcccg

SEQ ID NO: 8915 - DNA, 287 bp, Zea mays
  misc_feature: Ceres CLONE 375459-F
  misc_feature (178)..(178): n is a, c, t, g, unknown, or other
  misc_feature (203)..(203): n is a, c, t, g, unknown, or other
atgcatcccatccccattcccatccatagagctgcgggcggcctgcgctgcatgcagccaacaagctcatcagctcaccgtacctaggaggacgaccgagcagctaaggtagtagtagctagctagccagtgatggcggctacaaagcgcagggcggggcgctcgtcgtcgtcctggntgtcgccgcgctcttcgcggccacnattggcgatggcggtggacgacgagcacatgtaccactggaagtgcttcaagtcgtgcacggggaactgccgcaacgaggacgc

SEQ ID NO: 8916 - DNA, 253 bp, Zea mays
  misc_feature: Ceres CLONE 375469-F
  misc_feature: Encodes the peptide sequence at SEQ ID NO. 8917
  misc_feature (110)..(110): n is a, c, t, g, unknown, or other
  misc_feature (111)..(111): n is a, c, t, g, unknown, or other
  misc_feature (113)..(113): n is a, c, t, g, unknown, or other
  misc_feature (114)..(114): n is a, c, t, g, unknown, or other
gtttcttcggaggctttatttatcgtttatccacggaacttccggtgccggcgggaccacttgtgcgatccatccctcaccatgtcgtcggagaaggaggcggcgctcknntnncttcgatgmcagcccaaccatatttgacaagatcatcaaaaaggaaataccttctactgtggtttatgaggacgagaaggtactggctttcargggacataaaccctcaagctccaacacacattctcatcatccccaa

SEQ ID NO: 8917 - protein, 84 aa, Zea mays
  misc_feature: Ceres CLONE 375469-F
  misc_feature (37)..(37): Xaa is any aa, unknown, or other
  misc_feature (38)..(38): Xaa is any aa, unknown, or other
  misc_feature (41)..(41): Xaa is any aa, unknown, or other
  misc_feature (69)..(69): Xaa is any aa, unknown, or other
FLRRLYLSFIHGTSGAGGTTCAIHPSPCRRRRRRRSXXFDXSPTIFDKIIKKEIPSTVVYEDEKVLAFXGHKPSSSNTHSHHPQ

SEQ ID NO: 8918 - DNA, 129 bp, Zea mays
  misc_feature: Ceres CLONE 375506-F
acgcacaccgcgacccagtccagagccagtacgtgcgamggcacgcacgctgctggtccgcgtacssagaacgacggtcaggtcggccggtgcttttcagtttggaataatgacggcgacgacgacgac

SEQ ID NO: 8919 - DNA, 218 bp, Zea mays
  misc_feature: Ceres CLONE 375520-F
gtagattcacttgggctcaaccctcgcggacggcaacccgctgttgctgtggtcgaaggggctgtcgccgccgtagggtgacgcggcgtccggctggcgtactcatggagttggacgcggactcgggccccgggcgccggcatcttgagcacccgctcgatctcgccgaccacctcgcccatcgatggccggtcggcgccggctcctcgacgcagcgc

SEQ ID NO: 8920 - DNA, 370 bp, Zea mays
  misc_feature: Ceres CLONE 375574-F
  misc_feature (172)..(172): n is a, c, t, g, unknown, or other
  misc_feature (333)..(333): n is a, c, t, g, unknown, or other
gatcgtccttcctgtcgtttcgttttctcgccggcaggcactgggtacgccgccgccgcctcaacgccaccacgctgccgccgcgccagttcgtcaccgcgagacacaagacacgtgcctcgcttccctcgggccggttggcgtggcggcgtcgctgttctgttcctatttnttggcaactccgcccgtttcacctccggagaccgacagcgacggcgccagtagatagatgcactactgacgccactggccacctcgagttcgagtgccaagggacgccacgagaccaaccgtgagacaggacaacggtcgcctttgcccgcggatccgcgnatttcgtcttcttgggtgccatggatccagtcgccgg

SEQ ID NO: 8921 - DNA, 405 bp, Zea mays
  misc_feature: Ceres CLONE 375586-F
  misc_feature: Encodes the peptide sequence at SEQ ID NO. 8922
acctcctatataatttatctctcgtgcctcgttgcgtttttgtcgagtctaaccctagcgcgcgccgccacacctgccgttgctaccgccccgtacctcgcttgctttcccgtcgccgaaatgacgaagcgcaccaagaaggctggaattgttggcaaatatggaaccaggtatggcgctassttgcgtaassaatcaagaagatggaggtatctcagcactccaagtacttctgcgagttttgtgggaagtttgctgtgaagaggaaagcagttggaatttggggatgcaaggactgtgggaaggtcaaggctggcggtgcttacaccatgaacactgctagtgcagtcactgtcaggagcacgattcgtcgcttgagagagcagactgaagcatgatttagct

SEQ ID NO: 8922 - protein, 64 aa, Zea mays
  misc_feature: Ceres CLONE 375586-F
  misc_feature (1)..(63): Pfam Name: Ribosomal_L37ae Pfam Description: Ribosomal L37ae protein family
MEVSQHSKYFCEFCGKFAVKRKAVGIWGCKDCGKVKAGGAYTMNTASAVTVRSTIRRLREQTEA

SEQ ID NO: 8923 - DNA, 426 bp, Zea mays
  misc_feature: Ceres CLONE 375587-F
  misc_feature: Encodes the peptide sequence at SEQ ID NO. 8924
  misc_feature (378)..(378): n is a, c, t, g, unknown, or other
gaacctacgaagagccgactcaaccgctagtacagtccacacatgacacaacgacaccaactgtcctcaatccagcagccctcgagtctcgtccccgcacatcagcagagagacgccactaccaccaccgcaagcgacgacggggagatgtttctgcgacggatcctgaccggcggaggtggcctggcggcgctgagggcggcgcgcgccgtgaaggagacgacggggatcgtcggccttgaggtggcgcccaacgcgcgggaggttctcatcgggctctacacgcgtacgctcaaggagatcgaggccgtccccaaagacgagggctaccgcaaggccgttgagtccttcaccaatcaccgcctccagatctgccangaggaggacgactggaagcgcatcgaggaccgaatcggatgcgggcaa

SEQ ID NO: 8924 - protein, 93 aa, Zea mays
  misc_feature: Ceres CLONE 375587-F
  misc_feature (35)..(91): Pfam Name: ETC_C1_NDUFA5 Pfam Description: ETC complex I subunit conserved region
  misc_feature (77)..(77): Xaa is any aa, unknown, or other
MFLRRILTGGGGLAALRAARAVKETTGIVGLEVAPNAREVLIGLYTRTLKEIEAVPKDEGYRKAVESFTNHRLQICXEEDDWKRIEDRIGCGQ

SEQ ID NO: 8925 - DNA, 403 bp, Zea mays
  misc_feature: Ceres CLONE 375590-F
  misc_feature: Encodes the peptide sequence at SEQ ID NO. 8926
  misc_feature (367)..(367): n is a, c, t, g, unknown, or other
caagcgccactaatctcgccttccgaggaaactcaccagcccaccacagacccgagcggaagawgccatgtccgggcgcggtaagggtggcaaggggctcggcaagggcggcgcgabstcacccggaaggtctgcgcgacaacatccagggcatcaccaagccggcgatccggcgmcttggcgaggaggggcggcktcaagcgcattctcggggctcatctacgaggagacccgcggcgtgctcaagatcttcctcgagaacgtcatccgcgacgccgtcacctacactgagcacgcccgccgcaagaccgtcaccgccatggacktcgtctacgcgctcaagsscaggggccgcaccctctacggnttcggcggctaggctgatgggctcctcgcgatgttc

SEQ ID NO: 8926 - protein, 103 aa, Zea mays
  misc_feature: Ceres CLONE 375590-F
  misc_feature (17)..(17): Xaa is any aa, unknown, or other
  misc_feature (37)..(37): Xaa is any aa, unknown, or other
  misc_feature (87)..(87): Xaa is any aa, unknown, or other
  misc_feature (93)..(93): Xaa is any aa, unknown, or other
MSGRGKGGKGLGKGGAXSPGRSARQHPGHHQAGDPAXWRGGAASSAFSGLIYEETRGVLKIFLENVIRDAVTYTEHARRKTVTAMDXVYALKXRGRTLYGFGG

SEQ ID NO: 8927 - DNA, 471 bp, Zea mays
  misc_feature: Ceres CLONE 375594-F
  misc_feature: Encodes the peptide sequence at SEQ ID NO. 8928
  misc_feature (422)..(422): n is a, c, t, g, unknown, or other
aagaatatgttgggctcagggctcacagggcagacagcaacggcatgccggccgatccgccatcrtccggtcccatcggcgtccgtgctagctacggtgctataggtcctagctaataattccatcgcatggcatccgtgcaggcgacaagtcgatgatccggaagcggtacatgcacctgacggaggagttcctgtcggagaacccgagcatgtgcgcgtacatggcgccgtcgctggacgcgcggcaggacgtggtggtgacggaggtgccgaagctggggaaggcggcggcgcagaaggcgatcaaggagtgggggcagcccaagtcgcggatcacgcacctggtgttctgcaccacgtcgggggtggacatgccgggcgccgactaccagctgaccaaggcgctgggcctgcggcytnccgtgaaccgcctgatgatgtaccagcagggggtgcttcgcgggcggca

SEQ ID NO: 8928 - protein, 105 aa, Zea mays
  misc_feature: Ceres CLONE 375594-F
  misc_feature (1)..(103): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
  misc_feature (89)..(89): Xaa is any aa, unknown, or other
  misc_feature (90)..(90): Xaa is any aa, unknown, or other
MIRKRYMHLTEEFLSENPSMCAYMAPSLDARQDVVVTEVPKLGKAAAQKAIKEWGQPKSRITHLVFCTTSGVDMPGADYQLTKALGLRXXVNRLMMYQQGVLRGR

SEQ ID NO: 8929 - DNA, 344 bp, Zea mays
  misc_feature: Ceres CLONE 375626-F
  misc_feature: Encodes the peptide sequence at SEQ ID NO. 8930
  misc_feature (131)..(131): n is a, c, t, g, unknown, or other
  misc_feature (193)..(193): n is a, c, t, g, unknown, or other
atcccatctccatccccatccatagagctgcaggcggcctgcgctgcagccaacaagctcatcagctcaccgtacctaggaggacgaccgagcagctaaggtagtagtagctagctagccagtgatggcgngctacaaagcgcagggcggggcgctcggcgtcgtcctggctgtcgccgcgctcttcgcsssncassgattggcgatggcggtggacgacgagcacatgtaccactggaagtkcttcaagtcgtgcacgggggaactgccgcgacgaggacgcctttgacgacgtcggtccccgccactccgagggctcctcccacgtcgtcgtcgctgccgtc

SEQ ID NO: 8930 - protein, 54 aa, Zea mays
  misc_feature: Ceres CLONE 375626-F
  misc_feature (3)..(3): Xaa is any aa, unknown, or other
  misc_feature (23)..(23): Xaa is any aa, unknown, or other
  misc_feature (24)..(24): Xaa is any aa, unknown, or other
  misc_feature (25)..(25): Xaa is any aa, unknown, or other
  misc_feature (40)..(40): Xaa is any aa, unknown, or other
MAXYKAQGGALGVVLAVAALFAXXXLAMAVDDEHMYHWKXFKSCTGELPRRGRL

SEQ ID NO: 8931 - DNA, 361 bp, Zea mays
  misc_feature: Ceres CLONE 375697-F
  misc_feature: Encodes the peptide sequence at SEQ ID NO. 8932
aaaccctagactgcacccccatcccgcagcagccaaaacctacctagccgccgccgcrcgccccatcgccgccaagatgcagatctttgtgaagactctgacggggaagaccatcactttggaggtggattcytccgacaccattgacaatktgaaggccaagwtccaggacaaggagggcatccccccggaccagcagcggctcatcttcgccggcaagcagctcgaggacggtcgcaccytcgcssgaytacaacattcagaaggagtccaccctccacytggtgctccgcytccgsgttggcgccaagaagcktaagaagaagacktacaccaagcccaagaagwtcaagcacaagca

SEQ ID NO: 8932 - protein, 80 aa, Zea mays
  misc_feature: Ceres CLONE 375697-F
  misc_feature (6)..(68): Pfam Name: ubiquitin Pfam Description: Ubiquitin family
  misc_feature (26)..(26): Xaa is any aa, unknown, or other
  misc_feature (30)..(30): Xaa is any aa, unknown, or other
  misc_feature (56)..(56): Xaa is any aa, unknown, or other
  misc_feature (58)..(58): Xaa is any aa, unknown, or other
  misc_feature (69)..(69): Xaa is any aa, unknown, or other
  misc_feature (73)..(73): Xaa is any aa, unknown, or other
  misc_feature (75)..(75): Xaa is any aa, unknown, or other
MQIFVKTLTGKTITLEVDSSDTIDNXKAKXQDKEGIPPDQQRLIFAGKQLEDGRTXAXLQHSEGVHPPXGAPXPXWRQEA

SEQ ID NO: 8933 - DNA, 142 bp, Zea mays
  misc_feature: Ceres CLONE 375705-F
acacgcacaccgcgacccagtccagagccagtacgtgcgamggcacgcacgctgctggtccgcgcacgagacgacggtcaggtcggccggtgcttttcagtttggaataatgacggcgacgacgacgacagccgccgcggcg

SEQ ID NO: 8934 - DNA, 470 bp, Zea mays
  misc_feature: Ceres CLONE 375739-F
  misc_feature: Encodes the peptide sequence at SEQ ID NO. 8935
acttctagccttctggaactctcccttccggttccttcctctccgcctccacggctccacctccagtccttccaccgctgctccacacgggcacacctttgcctcgcccaaccgctgcctcgctcgcgtccgccattccccagacctcgagagctaccgtctggtccgatcggacggaccccttcgcgcgccccagagatttcaggtaaggtgctgtaacagaagatgcaagggggaagaggtgggaggcagggcttattcggtttcggggacccttctggtggttccggtggctttggacaaccagggagccttatgcctggtttttttggtggcgcaaatccctttgacgaccctttcttcacaaacccctttggtagcatgatgcagactagtttctcagcccctttcagcggcatgatgcaacctagcttcatgaaccccttcggcagcatggtgcaactaagctt

SEQ ID NO: 8935 - protein, 81 aa, Zea mays
  misc_feature: Ceres CLONE 375739-F
MQGGRGGRQGLFGFGDPSGGSGGFGQPGSLMPGFFGGANPFDDPFFTNPFGSMMQTSFSAPFSGMMQPSFMNPFGSMVQLS

SEQ ID NO: 8936 - DNA, 1415 bp, Zea mays
  misc_feature: Ceres CLONE 375781
  misc_feature: Encodes the peptide sequence at SEQ ID NO. 8937
ctcccgttctcggtggcccgtcctcccccccaatcctccaactctaactgccgcccgtcggtagccgcgctcgcggcagtggacctcgcctcctgcgcggctgtgcccagactgctgtgctgtttcggtctcttcggttagcagcagccacgccgggaacaagatggcggcggcgttgccgcagctggacgacgagatcgtccacggcatggccatcggcgctgtcttcacggactataccgggaagatcaattgcctcgacttccaccgcacggaagatctcatgatcacctctagcgaggacgactccatccgcctatacaacatcaccagcgcgacgttgttaaagactacgtatcacaggaaacatggtgctgaccgtgtctgttttagtcatcatccaagttctatcttatgctcttcacggtacaacctagagtctatagagtcacttcgttatctgtcattgtatgacaaccgttgcttaagatacttcaaaggacacaaagacagggtcgtttcattatgtatgtcacctgtcaatgatagctttatgtcaggatcacttgatcacagtgtcagaatatgggatcttcgggtaaatgcttgtcagggcatactaaggctgcgtggtagaccttctgttgcatatgatcaacagggacttgtttttgctgtagcaatggaaggtggtgctattaatttatttgattcccgatcttatgacaagggtccattcgacactttcttggttggtggagatacagctgaagtttctgacatcaaatttagcaatgatggcaagtctatgcttttgacaacaactaacaaccatatatatgttctggatgcatatgttggggataagaggtgtggttttagtttagagccatctcccaatgtaacaaatgaagctgctttcactccagatggtcaatatgtaatttcaggatcaggtgatggaacactgcacgcttggaacatcaatacagtacaagaggttgcttgttggaacagtcgcattggtcctattacagcattgaagtgggcccctcgtcgagccatgtttgcaaccgcatcaactgccctaactttctggattcccaaccgatcgaattaggatcaggtgcctggaaaaacaaggggtggaatttcatatatgttaacttggcaaatgtttattccctgttgttttctccaaaagatagatgccatgtatgaaatcacttcattaccatttacggaggcaatggcatagttccaggcagataccggttaaattgttgtgttagcactcataaaggttttttggtgatttactctggacttgtgcttcgaaaaacaggcgcttgtaacttctggaaaccactgatttaatatggacatgttggagaatcaacaaaaaaaaaaaaaaa

SEQ ID NO: 8937 - protein, 318 aa, Zea mays
  misc_feature: Ceres CLONE 375781
  misc_feature (105)..(143): Pfam Name: WD40 Pfam Description: WD domain, G-beta repeat
  misc_feature (235)..(273): Pfam Name: WD40 Pfam Description: WD domain, G-beta repeat
  misc_feature (16)..(54): Pfam Name: WD40 Pfam Description: WD domain, G-beta repeat
  misc_feature: SWISSPROT Homolog: EC 2.7.11.7 [Myosin heavy-chain] kinase
MAAALPQLDDEIVHGMAIGAVFTDYTGKINCLDFHRTEDLMITSSEDDSIRLYNITSATLLKTTYHRKHGADRVCFSHHPSSILCSSRYNLESIESLRYLSLYDNRCLRYFKGHKDRVVSLCMSPVNDSFMSGSLDHSVRIWDLRVNACQGILRLRGRPSVAYDQQGLVFAVAMEGGAINLFDSRSYDKGPFDTFLVGGDTAEVSDIKFSNDGKSMLLTTTNNHIYVLDAYVGDKRCGFSLEPSPNVTNEAAFTPDGQYVISGSGDGTLHAWNINTVQEVACWNSRIGPITALKWAPRRAMFATASTALTFWIPNRSN

SEQ ID NO: 8938 - DNA, 228 bp, Zea mays
  misc_feature: Ceres CLONE 375797-F
  misc_feature (104)..(104): n is a, c, t, g, unknown, or other
  misc_feature (131)..(131): n is a, c, t, g, unknown, or other
atcacaattcacagcgctcaagttctcgcgcccacagccaaatttttctccactcaatcgcggcataagctgcactgcasccatggacgccagcggasscggtnagcaaggcgaagaagggggcggctggncgcaaggtctggcggccccaggaagatagtcggtgttcgcggtccgtcaaggccgggctgcagttccccgttvggccggatcgggcgctacctcaag

SEQ ID NO: 8939 - DNA, 477 bp, Zea mays
  misc_feature: Ceres CLONE 375819-F
  misc_feature: Encodes the peptide sequence at SEQ ID NO. 8940
  misc_feature (170)..(170): n is a, c, t, g, unknown, or other
  misc_feature (174)..(174): n is a, c, t, g, unknown, or other
  misc_feature (176)..(176): n is a, c, t, g, unknown, or other
  misc_feature (386)..(386): n is a, c, t, g, unknown, or other
  misc_feature (404)..(404): n is a, c, t, g, unknown, or other
  misc_feature (415)..(415): n is a, c, t, g, unknown, or other
aatcaaaacacgagggcgtctcccgcagactggtcactcggcacgcaggcagaggcagcatagcagcagccagctccatccatcctctttcccctcctcgcttcgcttcctcggcggattcctcctccctcgaccgtccccgtccccgtccccttccggcgcgcaasaangmrngngatggctaagcatggtgggactggcaaaggttgcaaacatgcccttaattacggaggatgggaccatgtgctgaccgaatccaaataaratggtagggtcggatttctccagaatcactctgctgcaatccaaacatgctcttaatctaccgctgctgaaggtaatactatcttataccctaatcaagagtagaggtttagatatttganvaatgcacacaaaatacnktwtaaatcancctttctatttggacggctctaattattgctaatataccttcttggccaaacgatctatttt

SEQ ID NO: 8940 - protein, 39 aa, Zea mays
  misc_feature: Ceres CLONE 375819-F
MVGSDFSRITLLQSKHALNLPLLKVILSYTLIKSRGLDI

SEQ ID NO: 8941 - DNA, 457 bp, Zea mays
  misc_feature: Ceres CLONE 375849-F
  misc_feature: Encodes the peptide sequence at SEQ ID NO. 8942
gtgttcccaaactgaggtgtcaggaaaaggaggaaagcactgagcgcgagccattcgttcgcgagcctcactgccagttccagcacgaatcctcgtccaatccacgcctgctgctcgcgagccatcgccacagtgctggccatgcctggagccgttgcgcttgcgcccacgctcgcggcagcgagcagctccgccgccgcggcctccacgctggctccgaacccgacaagccgaggcgacccgctaactattaggttgtgccgcaatgctcctgctagcgcaactccacttgttccacttgtagccacccgtcgctacgtgcgtggctgccgcggcgcggctctagtcgccagtccccaccacgctccaaaccctcgcctccgattcgcgtctgcggcagaggggatggctgcggaagcgagcacggcgggtgcggcgtcggcagccgaggcgaagc

SEQ ID NO: 8942 - protein, 105 aa, Zea mays
  misc_feature: Ceres CLONE 375849-F
MPGAVALAPTLAAASSSAAAASTLAPNPTSRGDPLTIRLCRNAPASATPLVPLVATRRYVRGCRGAALVASPHHAPNPRLRFASAAEGMAAEASTAGAASAAEAK

SEQ ID NO: 8943 - DNA, 332 bp, Zea mays
  misc_feature: Ceres CLONE 375853-F
  misc_feature (137)..(137): n is a, c, t, g, unknown, or other
gttttcagtgttcccctcaccacccgagccccaccaccatcaccaccagtccaccaccaccaccggcccgtgccccagccacaacaaggcgaaatcaggggtggtcacgccgagcgactacgcgaagacgcagtcgncgggggcgaagatctcccaacccacattgcgcgcgcgtctacgcccgaggatcgatggttggcggcggggcgcgcccggcccttgggcgctggtgcctggtgatcctggccgtggctccgcgctaggggtctctggccccgccttctactggcgctacaagaaggggcttctcctcctcctccccctcgtccacc

SEQ ID NO: 8944 - DNA, 380 bp, Zea mays
  misc_feature: Ceres CLONE 375890-F
  misc_feature: Translation starting site: 137
  misc_feature (12)..(12): n is a, c, t, g, unknown, or other
atcaccatttcnctagcatagcacttgttccagctagctaggagagagagctttgtttaggcggcggcaagatgaacaggaagccaggagactggvsactgcagggcgtgccagcacctcaacttcagccgtcgggatgcatgccagcgctgcagtgaaccacgtggagttggtgatcgtagcggcggtggtggcgacttgggtgggcgtggtggttcctccttcggcggtggctttggtgctggctctgatgtccgccctggtgactggtactgctcctgcggcgcacacaacttcgccagccgctccaactgcttcaggtgctctgcctacaaggaggaggctgccggcgcctttgatagtgacatgtcacgctcacg

SEQ ID NO: 8945 - DNA, 402 bp, Zea mays
  misc_feature: Ceres CLONE 375898-F
  misc_feature (234)..(234): n is a, c, t, g, unknown, or other
gcgcmgttactgccggctgtccggagtcccgaccaccgtcctcggctccccgccgtgaatccatcatcccgtaatggagaccttgcccctcggtgaagaacatcctcttgctggactcggagggaaagcgcgtcgccgtaaagtactacagcgatgactggcctactctatccgcgaactggccttcgagaaktcggtatttaccaaaacccagaaagcgaatgtgaacggaanttgagattgtaatgtttgacggtcaawttgtggtatacaagtttcatccaagacctgcacttttttgttactggaggagaagaagagawtgagcttattttagcatcagtttcttgagggattctctgatgctgtcgaacgactttctcaaaaacatggttgacaaaa

SEQ ID NO: 8946 - DNA, 1771 bp, Zea mays
  misc_feature: Ceres CLONE 375908
  misc_feature: Encodes the peptide sequence at SEQ ID NO. 8947
acggctccgtcgttctcgttcctcacccgattcttataccaactcgtcccctccttatctccgtcgtcacgcatcgccctcgctcgctccgcattgcccgcatcgcctccaatctcagcagaccaggtcgagtttcgcgcggattttcagtgtgggaggggagtggaggtgtgacgggagcagcagaggaagcgcgccatggacccgtgcccgttcgtgcgggtgctggtcggcaacctcgcgctcagaatgccggtggcgccgccggccgccggtgctggcgcgggcgtccacccgtccacgtcgccgtgctactgcaagatccggctggggaagatgccggtccagagcgtcccggcgccgctcgtggtctccgacggcggcgagcagacgccggcgtccggggccctcgccgccgcgttccatctgtccaaggctgacctggagtggttcaacgggaaascgtcgctcttctcgtcgcgcggggaggccagcctgaaggtgtcggtctacgctggccggaaggggagtgcctgcggcgtcagctccgggcggctgcttgggaaggctacgatcgcgctggacctcaagggcgccgaggccaagcccgccgtgctgcacagcggctggatctccatcgggaagcgatccgggaagggcagcaccgcggcgacggagctcagcctcaccgtccgcgcggagccggacccgcgattcgttttcgagttcgacggcgagccggagtgcagcccgcaggtgctgcaggtgcgcggcagcatgaagcagcccatgttcacctgcaagttcggatgccgcagcaacagcgacctgcgcaggccggggatgcagccggagcgcgacgccgcgtcggccaaggagcgcaaggggtggtcggtgacggtgcacgacctgaagggctccgccgtggcgatggcgtccatggtcacgcccttcgtgccctcgccgggcacggaccgcgtgagccggtccaacccgggcgcgtggctcatcctccgccccgcgggcgacggcgcatgggagccctgggcgcggctcgagtgctggcgcgagcgcggcggcgccggcgcgtccgacagcctgggctaccacttcgccctcctcatccccggcgcggaccacgccgtcgccctcgccgactcctccatcccttcgtccaacggcggcaagttcgccatcgacctgaccgccgcgcagccgctgagccggggcggcacgccggggtgcagcccgagaggcagcggcgacctgagcaactggcccctggggaactaccgcggcttcgtcatgtccgccgcggtccagggcgagggccggtgcagcaagccgacggtggaggtcggggtggcgcacatcgggtgcgccgaggacgcggcggcgttcgtagccctcgcggcggccgtggacctgagcatggacgcgtgcaggctcttctcccaccggctgaggaaggagctctcgcacctgcaggccgacctactccggtgacccaccggaccggcggcaaccgcgaatcacgagcgaattgtacagaagtagttgaggcagacgtgtgctttgttgtagtagttcgattccggtgatcaactagttgatcgtggtcaccttttcttgtgagcgctgaatgcctttgtgtggtgtgattttttggttggttgcttcgctttagccatgtagggtgtccgcttttacggatctccgtaatttataagctgtttggtttgaggaaaaaaaaaataaaaaaaaaaaaaaa

SEQ ID NO: 8947 - protein, 435 aa, Zea mays
  misc_feature: Ceres CLONE 375908
  misc_feature (248)..(431): Pfam Name: DUF1005 Pfam Description: Protein of unknown function (DUF1005)
  misc_feature (89)..(89): Xaa is any aa, unknown, or other
MDPCPFVRVLVGNLALRMPVAPPAAGAGAGVHPSTSPCYCKIRLGKMPVQSVPAPLVVSDGGEQTPASGALAAAFHLSKADLEWFNGKXSLFSSRGEASLKVSVYAGRKGSACGVSSGRLLGKATIALDLKGAEAKPAVLHSGWISIGKRSGKGSTAATELSLTVRAEPDPRFVFEFDGEPECSPQVLQVRGSMKQPMFTCKFGCRSNSDLRRPGMQPERDAASAKERKGWSVTVHDLKGSAVAMASMVTPFVPSPGTDRVSRSNPGAWLILRPAGDGAWEPWARLECWRERGGAGASDSLGYHFALLIPGADHAVALADSSIPSSNGGKFAIDLTAAQPLSRGGTPGCSPRGSGDLSNWPLGNYRGFVMSAAVQGEGRCSKPTVEVGVAHIGCAEDAAAFVALAAAVDLSMDACRLFSHRLRKELSHLQADLLR

SEQ ID NO: 8948 - DNA, 214 bp, Zea mays
  misc_feature: Ceres CLONE 375920-F
ctaaacatcctcctctcgctctcagtcgcatcattcttctcgcctcgtgtcgctgacttcccccagctttgckkttgccttcgagcaggagacaggctgtgtagcgtagtctagtgctaccaggatcggatcagcggctgctgcgcttcagttgccgccggcggcatgagggtggtggtgacgggcgcgacggggtacctgggaggccgcctgt

SEQ ID NO: 8949 - DNA, 259 bp, Zea mays
  misc_feature: Ceres CLONE 375922-F
  misc_feature: Encodes the peptide sequence at SEQ ID NO. 8950
ttctatctatctactatatatcgatccacccatccctcgcagctccaaagcattgaagcaaagaaccctgcaactgcaacaagccctgacgcttaatacatcggccggcactcgatcggcagcagatcaaagatggcggcggaggagggggagaaggcgaagagcggcggcggcgggcagcagatgacggtggtgcgggggctggacgtggcgcggtacatggggcggtggtacgatgaagacgatcctggcgtcggag

SEQ ID NO: 8950 - protein, 42 aa, Zea mays
  misc_feature: Ceres CLONE 375922-F
MAAEEGEKAKSGGGGQQMTVVRGLDVARYMGRWYDEDDPGVG

SEQ ID NO: 8951 - DNA, 445 bp, Zea mays
  misc_feature: Ceres CLONE 375947-F
  misc_feature: Encodes the peptide sequence at SEQ ID NO. 8952
  misc_feature (438)..(438): n is a, c, t, g, unknown, or other
atccagtgttctgtcctagcgccgccgccgccccagctcgccttgcgtgactgagagctcgtcggcttccgtccacgcgtgaagsagagcatggacacccaggtgaagcttgctgttgtggtgaaggtgatgggcaggaccggctccaggggtcaggtgacccaggtcagagtgaagtttttggatgaccagaaccggctcatcatgaggaatgtcaaggggcccgttcgcgagggtgacatcctcaccctgctcgagtccgagagggaggccaggaggctgcgctgaagccctagcgttcttggtgggctcttgtatggtctttggtgtcttggaatttgtgctatgtttgaacttctgtgaccctgttttaagagtactgaagagcttgtagttctgccaggaacatggttattagttgaagcaagaatgttgatngtcacaa

SEQ ID NO: 8952 - protein, 65 aa, Zea mays; identical to SEQ ID NO: 5504
  misc_feature: Ceres CLONE 375947-F
  misc_feature (1)..(65): Pfam Name: Ribosomal_S28e Pfam Description: Ribosomal protein S28e

SEQ ID NO: 8953 - DNA, 306 bp, Zea mays
  misc_feature: Ceres CLONE 375961-F
  misc_feature: Translation starting site: 66
  misc_feature (286)..(286): n is a, c, t, g, unknown, or other
atctccctgtttaatcaatccttcaagcgcamtgcctcctcctcgtcgtccggtcgtgagaagggatggcgggccgtggcaaggctatcggcgctggcgccggaaktawtgcaacgtcgaggagctccaaggccggactccagttccccgtcggcaggattgctaggttcctcaaggcgggcaaktacgctgagcgcgtcggcccggcgcccccgtgtacctcgccgccgtcctcgagttacctcgcggcttgaggttctcgaayttgccgggaacgccgcgaggnacaacaagaagacccgcatt

SEQ ID NO: 8954 - DNA, 226 bp, Zea mays
  misc_feature: Ceres CLONE 375974-F
  misc_feature: Encodes the peptide sequence at SEQ ID NO. 8955
aattgcacccttggctcctactcactctctctccccatccgcgccagtccaaccaagtcagcacccgcgcgcggcaaggagttcacgcccatggcagcaccaacatggcgtcggccacctcgcggttcatgctggccgcgggcgtgcccactgccagtagcggcacccgcgtcassttcgcctcggcgcccaaccggcttggcaggaggcttgtggtccgggccga

SEQ ID NO: 8955 - protein, 40 aa, Zea mays
  misc_feature: Ceres CLONE 375974-F
  misc_feature (24)..(24): Xaa is any aa, unknown, or other
MASATSRFMLAAGVPTASSGTRVXFASAPNRLGRRLVVRA

SEQ ID NO: 8956 - DNA, 242 bp, Zea mays
  misc_feature: Ceres CLONE 376012-F
ggaggagcccgaccacgccagkagcccgcccgattcgccgtcgcggggccacgtttcccctccaatggccaccagctccaccgccttgctgcaccttgtcatcccggcctcccgccgccgccggacttggtsstcgggccgcacactccgagtccgccccgcccgccgcctccgtcgaccggcgcmgcttcatcgcccacaccgccgcmgcgccgccgtctcccctctcgtcttgccccgct

SEQ ID NO: 8957 - DNA, 363 bp, Zea mays
  misc_feature: Ceres CLONE 376013-F
  misc_feature: Encodes the peptide sequence at SEQ ID NO. 8958
atttcgactttcgagcgcagaaacgagagggccggagcagccgcagtcccggcgatcccgcgccggtcgccctcatacttcctcgtcactgccttcgtttctctttccaacaatcaagatgagccgtggcggtassgcgggtggtggtcaaagacgccaacttcgactgctccggcaccgggttctcgctgcaggccatggactcgagccacgtcgccctcgtcgcgctgctcctccgcgccgaggggttcgagcactaccgctgcgaccgcaacctctccatgggcatgaacctcaacaacatggccaagatgctccggtgcgccggtaacgacgacatcatcaccataaaggccgatgacg

SEQ ID NO: 8958 - protein, 55 aa, Zea mays
  misc_feature: Ceres CLONE 376013-F
  misc_feature (1)..(55): Pfam Name: PCNA_N Pfam Description: Proliferating cell nuclear antigen, N-terminal domain
MDSSHVALVALLLRAEGFEHYRCDRNLSMGMNLNNMAKMLRCAGNDDIITIKADD

SEQ ID NO: 8959 - DNA, 422 bp, Zea mays
  misc_feature: Ceres CLONE 376039-F
  misc_feature (27)..(27): n is a, c, t, g, unknown, or other
  misc_feature (107)..(107): n is a, c, t, g, unknown, or other
aacaattcggtttcttgggtggttttnktttcttgcttgctcggtttcttgtggggcgggccgcgaaccggcgaggcgggggcgcgaggcaacgcaaagcagcgcanagsscagtgcagcaaaagcttcgatctttatccgccggattcctctcctcmcctttcctctactctccgtctcccacgattgctttgtgcttcgttgttgagaggaggggagaggagaggagacccacatccacttgcctttctcctctctcctctcgcagccccccttccaactcctcctggtccctggaaaraaaggagaccttttggtgcaagattcgatctgctgtggctrcctcggccttgctgcgtgcgcggagatttggtwtcttggctggcggctggcgcgcgcgggcagttggagctctttgattc

SEQ ID NO: 8960 - DNA, 440 bp, Zea mays
  misc_feature: Ceres CLONE 376078-F
  misc_feature: Encodes the peptide sequence at SEQ ID NO. 8961
attggtcattcgctcccacggtccagactccacagtccacactccccgcatctggcgacattgtgtgctcggcagtctcggactcggagtgagagcgaccaacaagagggaggaaatgatggagaagcgacacggcggcggaggttgcaccctgctccacctcctcggcaccgccgccgccatggcgttcctgctgccgcggtccgccggagctgccaacgacgccaagtggcacgcccatgcccatccggtcgccggcgccggcctctcgccgctctcggcaccgccgcccaccgcgggagccgacgacgacttgctgccgccgccgagccgcgcgcccgtggagaaggccgccccgcacttcggcttccctctgcagccgggcgacgcgtccgcggcggccccgtccggaagcgaggggtaccgtttatcggcagcaa

SEQ ID NO: 8961 - protein, 107 aa, Zea mays
  misc_feature: Ceres CLONE 376078-F
MEKRHGGGGCTLLHLLGTAAAMAFLLPRSAGAANDAKWHAHAHPVAGAGLSPLSAPPPTAGADDDLLPPPSRAPVEKAAPHFGFPLQPGDASAAAPSGSEGYRLSAA

SEQ ID NO: 8962 - DNA, 215 bp, Zea mays
  misc_feature: Ceres CLONE 376088-F
aggacgccagggccgattctctgcgtgacttggggcgtcgtcgcgagttttctccggccgagggcggcgcgaccggacaaccagcgtgasscgaccggcgacatgactcgcggcaaccagcgtgaccgcgaccgtgagcgcgcgcggcgtaatagcccaacgccaagaactcccaggacgggctcaccccggagcagcgccgcgagagggacaag

SEQ ID NO: 8963 - DNA, 482 bp, Zea mays
  misc_feature: Ceres CLONE 376127-F
  misc_feature: Encodes the peptide sequence at SEQ ID NO. 8964
  misc_feature (387)..(387): n is a, c, t, g, unknown, or other
accgaggcgaagggcggtcggggtcagggaagggcggaaggcgtcggtcggcggcasctctgctcggtcgcggcgcttgaggggcggtgtagaggccgccggaggagtgaagagggagatggctccggccagcgggtggggccgggcggtggggaacacgcggtcgttcgtgggcaacgcgctgggcggcctccgcgggtggagcaacctcgcctcctggaccgtcgccggaaccctcgcctactacctctgggtgaagccgcgcgccasstccagaaggagcaggaggagcgagccgctttggctgctgcaacggatccttatcgttatgtcgagaagcggaaaccgattcctgatccacaggacactggccttatctatgggaanaagagggagcctaccaaatctcaagattagctagcgccctgggcacatcttgtaccaaatgttgccgccagtttatgtgcacaataccaggaatg

SEQ ID NO: 8964 - protein, 100 aa, Zea mays
  misc_feature: Ceres CLONE 376127-F
  misc_feature (51)..(51): Xaa is any aa, unknown, or other
  misc_feature (90)..(90): Xaa is any aa, unknown, or other
MAPASGWGRAVGNTRSFVGNALGGLRGWSNLASWTVAGTLAYYLWVKPRAXSRRSRRSEPLWLLQRILIVMSRSGNRFLIHRTLALSMGXRGSLPNLKIS

SEQ ID NO: 8965 - DNA, 177 bp, Zea mays
  misc_feature: Ceres CLONE 376148-F
  misc_feature (75)..(75): n is a, c, t, g, unknown, or other
gaattagaacggccgaagcggcacacaattcgcgcmrgcgtagaaactagaaagtccagtccccaaactccccancggggcgagcagaggaggaagagtagccgccgccatgtcttggggaatcgcccgcggccgcctcgccgaggagcgcaaggcctggcgcaagaaccacccgca

SEQ ID NO: 8966 - DNA, 185 bp, Zea mays
  misc_feature: Ceres CLONE 376180-F
aactactttcctttcgtcgttgtcgtccccggctcctccacttcaccaccacgaccggacggacccggatgtcttcgcccgcacatccaccccatacccgcaaatccgcagcaaacgcttgcagcggcggcgacagttggtagccgcgatcgagaggcgacgggtaacctgccccgccgcggccg

SEQ ID NO: 8967 - DNA, 492 bp, Zea mays
  misc_feature: Ceres CLONE 376189-F
  misc_feature: Encodes the peptide sequence at SEQ ID NO. 8968
cctgtgaaaattcgtgatgcggagaacagctaccgccgccctcgtcctcgtccccctcctcgctgcggcggtacagacctccgccctgcctttcatcgtcctgcacgggattggggaccagtgcgccaaccatggcgttgccaagttcactaaacttctcgccgattggtccggctccgacggctactgcctagagattggcagaggaacatgggactcttgggtcatgcctcttcaacaacaggctgatataatctgcaacaaggtcaaggaaatgaaacaactgagaggtggctacaacatagttggtctgtctcagggaaacttgattggtcgagcagtggttgagtactgtgatgatggaccgccggtcaagaatttcatctctctaggaggtcctcatgctggtaccgcttcagtgcctctttgtggttctggatttttttgcattattgttgatgctctgatcaaattggagatctactcaggacc

SEQ ID NO: 8968 - protein, 158 aa, Zea mays
  misc_feature: Ceres CLONE 376189-F
  misc_feature: SWISSPROT Homolog: EC 3.1.2.22 Palmitoyl-protein hydrolase
MRRTATAALVLVPLLAAAVQTSALPFIVLHGIGDQCANHGVAKFTKLLADWSGSDGYCLEIGRGTWDSWVMPLQQQADIICNKVKEMKQLRGGYNIVGLSQGNLIGRAVVEYCDDGPPVKNFISLGGPHAGTASVPLCGSGFFCIIVDALIKLEIYSG

SEQ ID NO: 8969 - DNA, 429 bp, Zea mays
  misc_feature: Ceres CLONE 376222-F
  misc_feature: Encodes the peptide sequence at SEQ ID NO. 8970
ggagagggagaagccgccgccgcagcaatcacagcagcccggagaaagcccaggtccgacaagatgcagatcttcgtgaagacgctgacagggaagaccatcaccctcgaggtcgagagcagcgacaccatcgacaatgtcaaggccaagatccaggacaaggtgatctgccgcaaatgctatgcacgactgcaccctagggctgtcaactgccgcaagaagaagtgtggtcacagcaaccagctgagggccaagaagaagatcaagaactgaggtgctgctcctagtcagtttcatggacaatgttgggctgtattgctgtgtggttgttgaaccgtgtttgtttacccaacatttgggccttctgttatgttttaccttgttgtcgatgacacaatactatatgacaatagcaactctgttattgtt

SEQ ID NO: 8970 - protein, 69 aa, Zea mays
  misc_feature: Ceres CLONE 376222-F
  misc_feature (16)..(68): Pfam Name: Ribosomal_L40e Pfam Description: Ribosomal L40e family
MQIFVKTLTGKTITLEVESSDTIDNVKAKIQDKVICRKCYARLHPRAVNCRKKKCGHSNQLRAKKKIKN

SEQ ID NO: 8971 - DNA, 178 bp, Zea mays
  misc_feature: Ceres CLONE 376228-F
  misc_feature: Encodes the peptide sequence at SEQ ID NO. 8972
aatccccagcccaaaatgaacgccaccaccgccgtgctgcgaggygcctcctcctcccgctccgsscccagccgccagcaccgcggggcgcagccggcctcggssaccccaggtgtcgatccgttccgcggagacgacgagtccgtgccgccccggcgcgcgcgtcgctggaccgcgc

SEQ ID NO: 8972 - protein, 58 aa, Zea mays
  misc_feature: Ceres CLONE 376228-F
  misc_feature (15)..(15): Xaa is any aa, unknown, or other
  misc_feature (22)..(22): Xaa is any aa, unknown, or other
  misc_feature (35)..(35): Xaa is any aa, unknown, or other
SPAQNERHHRRAARXLLLPLRXQPPAPRGAAGLGXPRCRSVPRRRRVRAAPARASLDR

SEQ ID NO: 8973 - DNA, 458 bp, Zea mays
  misc_feature: Ceres CLONE 376296-F
  misc_feature: Encodes the peptide sequence at SEQ ID NO. 8974
  misc_feature (434)..(434): n is a, c, t, g, unknown, or other
atcgaacaccaatggcattcttgcattgaaggaaccttccctccacctccaccgcccgagagcgagcggccggacggggttttggttgggcatggctgccccggcgatgctccaagtggtgatcctcgccgcggtcctccttctcccgttcctcagcgtgccgggcgccgaggcacagaccaagaagttctgcctcacgcagttcgccatcgctagccaggcctgcgccatcctgccacccaccagtcctgagcaccaccaccatcatcacgatgacgaggacaatgacgaggacaacgacaaagatgaggacgaagacgaggacaacgatgaagatgaagacgaggacaatgacgacgatagcggcggtggcggcggctacggcaactccgacgggaactggaggaactgagcggtggggcccgcgcgccaanttatcctgttcgctaccgtgttgt

SEQ ID NO: 8974 - protein, 106 aa, Zea mays
  misc_feature: Ceres CLONE 376296-F
MAAPAMLQVVILAAVLLLPFLSVPGAEAQTKKFCLTQFAIASQACAILPPTSPEHHHHHHDDEDNDEDNDKDEDEDEDNDEDEDEDNDDDSGGGGGYGNSDGNWRN

SEQ ID NO: 8975 - DNA, 325 bp, Zea mays
  misc_feature: Ceres CLONE 376341-F
  misc_feature: Encodes the peptide sequence at SEQ ID NO. 8976
  misc_feature (81)..(81): n is a, c, t, g, unknown, or other
  misc_feature (89)..(89): n is a, c, t, g, unknown, or other
  misc_feature (90)..(90): n is a, c, t, g, unknown, or other
  misc_feature (110)..(110): n is a, c, t, g, unknown, or other
  misc_feature (274)..(274): n is a, c, t, g, unknown, or other
  misc_feature (285)..(285): n is a, c, t, g, unknown, or other
ataattgaagggtttgccgttcggaggacgtgatccctgtctgtttctgtctctctctagagatccgataccgccgccaknccgccgcnntgcctcatcgccggcgacgnatgaacaacccagccgatcagccgtcctcacatcgaagtctccatacacaagtggcatcgccccctatttcgcccgttgcattgaactactgcagagtggagatccgtccatccatgacccacccagcaggccctggatcgatctgtcattctcttggtaatknacccacgcttnctcggaggaacgctgcagggcacaagaratgcagagggat

SEQ ID NO: 8976 - protein, 33 aa, Zea mays
  misc_feature: Ceres CLONE 376341-F
  misc_feature (17)..(17): Xaa is any aa, unknown, or other
  misc_feature (21)..(21): Xaa is any aa, unknown, or other
  misc_feature (30)..(30): Xaa is any aa, unknown, or other
MTHPAGPGSICHSLGNXPTLXRRNAAGHKXCRG

SEQ ID NO: 8977 - DNA, 439 bp, Zea mays
  misc_feature: Ceres CLONE 376363-F
  misc_feature: Translation starting site: 160
  misc_feature (79)..(79): n is a, c, t, g, unknown, or other
  misc_feature (109)..(109): n is a, c, t, g, unknown, or other
  misc_feature (144)..(144): n is a, c, t, g, unknown, or other
  misc_feature (269)..(269): n is a, c, t, g, unknown, or other
  misc_feature (331)..(331): n is a, c, t, g, unknown, or other
  misc_feature (413)..(413): n is a, c, t, g, unknown, or other
agtgctcggtgcccgtgcccgcgcgcgctacctagctgctcctgcctggttcgccgtagcccgtagcccgtagcacarnaacaacaaaaaaaatctccgcggcgssggnggaggtggtctgttcaccttggggagcagcggcgngccgtcggcgcagaaatgcccggtggcgccttcctcctcaacggcagcggcggcggcatggcggactacggcggcggcctcaccgtccccgtcgtcgtgacctgcctcatggcggcctccgcggncctcatcttcggctacgacattggcatctcaggaggtgtgtcggagatcggaggatttcctnaacaagttcttccccgggttgctcaagaggacgggcgcgcggcaacaaggacgtgtactgcatttacaacaaccaggcgctnacggccttcacgtcgtcgctgtacgc

SEQ ID NO: 8978 - DNA, 152 bp, Zea mays
  misc_feature: Ceres CLONE 376400-F
cagctccgaccctagggtttccatccggctcttccggaagcttccgaaaatggccaccgacgagctcgcccacgccgtcgcccccgccccggccggggcaccaactccccggccttctcgttcagcatctggccgccgacgcagcgcacgcg

SEQ ID NO: 8979 - DNA, 384 bp, Zea mays
  misc_feature: Ceres CLONE 376448-F
  misc_feature: Encodes the peptide sequence at SEQ ID NO. 8980
ctggtttatcttccaccgcgcttcgcccactcgctccagccgcttcaccgcgccgccaccgccaccgcgaggatgccgttcaagaggttcgtggagatcgggcgcgtggccctggtgaactacggggaggactatggccgtctcgttgtcatcgtcgatgtggtcgaccagaacagggcacttgtggatgcccctgatatggtcaggtgccaggtgaacttcaagcggctctcacttactgacatcaagattgacatcaagactgcacccccatcccgcagcagccaaaacctacctagccgccgccgcasssccccatcgccgccaagatgcagatctttgttgaaggactctgacggggaagaccatcactttggagggtgg

SEQ ID NO: 8980 - protein, 104 aa, Zea mays
  misc_feature: Ceres CLONE 376448-F
  misc_feature (80)..(80): Xaa is any aa, unknown, or other
  misc_feature (81)..(81): Xaa is any aa, unknown, or other
MPFKRFVEIGRVALVNYGEDYGRLVVIVDVVDQNRALVDAPDMVRCQVNFKRLSLTDIKIDIKTAPPSRSSQNLPSRRRXXPSPPRCRSLLKDSDGEDHHFGGW

SEQ ID NO: 8981 - DNA, 127 bp, Zea mays
  misc_feature: Ceres CLONE 376502-F
  misc_feature (86)..(86): n is a, c, t, g, unknown, or other
atatactttctgacctcttctggaatcctgcgacgaggggaccraatggcctcgtcctcctctgactccggccgcatcgccggaanccctagccttgcgtaacgagctcggccttagcggcggcgtc

SEQ ID NO: 8982 - DNA, 467 bp, Zea mays
  misc_feature: Ceres CLONE 376514-F
  misc_feature: Encodes the peptide sequence at SEQ ID NO. 8983
gcttcactcgcgtccgcccccgccgccgcctttcgtcccagcccctaaaccattctccattcctctcatcagtttagcacaatggcactggctaataagcttcggtggtctcgctcaagaaagccacaagttcaaatctgtctgtctaccaagcaatcagatgcatgtcsatccaatctctttgttggagggatttcttatcaaactgatgatcacagtctcagggacgagttctcgccaaatcatgggcaagtcattcgaagctaggattatcattgaccgtgaatctgggaggtctagaggttttggctttgtaacttacacgtcttctgaggaggcttcagctgccattactgccttggatggaaagactctcgatggacggagcatacgtgttaatcatgctaacgagaagacaggtggctttcgtggcggcggtggctatggtggcggcggctacggtggtg

SEQ ID NO: 8983 - protein, 102 aa, Zea mays
  misc_feature: Ceres CLONE 376514-F
  misc_feature (18)..(79): Pfam Name: RRM_1 Pfam Description: RNA recognition motif. (a.k.a. RRM, RBD, or RNP domain)
  misc_feature: The sequence is a functional homolog of SEQ ID NO 22 in US patent 7244875
  misc_feature (4)..(4): Xaa is any aa, unknown, or other
MHVXPISLLEGFLIKLMITVSGTSSRQIMGKSFEARIIIDRESGRSRGFGFVTYTSSEEASAAITALDGKTLDGRSIRVNHANEKTGGFRGGGGYGGGGYGG

SEQ ID NO: 8984 - DNA, 461 bp, Zea mays
  misc_feature: Ceres CLONE 376515-F
  misc_feature: Translation starting site: 69
  misc_feature (66)..(66): n is a, c, t, g, unknown, or other
catcttgctctgaacgcattcctcccatctcccaagacctcctcagacccgagaagcgcmbgcggnccatggacgccaccggcactggagctggagggaaggcgaagaagggagcggccggtcgcaaggccgcgggcgaggaagaagtcggtgacgaggtccgtgaaggccgggctccagttccccgtcggccgcatcgggcgctacctcaagaagggccgctacgcgcasscgtcggcagcggtgcccccgtctacctcgcggccgtcctggagtacctcgccgctgaggtcctggagctcgccggcaacgctgccaaggacaacaagaagacgcgcatcgtcccgcgccacgtgctgcttggcgatccgcaacgacgagggakctcgggaagctggctgaccggcgtgaccatcgcccacggsgtcgtgttgcccaacatcaacccggtcctgctgccc

SEQ ID NO: 8985 - DNA, 446 bp, Zea mays
  misc_feature: Ceres CLONE 376550-F
  misc_feature: Encodes the peptide sequence at SEQ ID NO. 8986
attttggattctgtgccaaaagaggggttaaaggaacgaattctgattcccgtgvsaccgacaaggagcagctgggaaacggagcgccacaagcccacaactctcgcgcaggcttctctcccatctccgcccttcccgaagcagcacggtgcaggccgcggacccgssttttctccacagaatcccgctccacgcacgtcgcccccgtcgccggcgagacggctgtgctgctgcgtactcccctggttccaactctgaaccggccaccctctcctgctccgcgacctcgagtaactttttgagtaccagtgatgcaaagggacacaagctctagcgatgtttctgcttctcatgtaggacgtgtaagacgtcgcaaacatccaactgaggctaccacagatgggaatagagctaatggacagccattgcttgtcaatgatcaggaa

SEQ ID NO: 8986 - protein, 45 aa, Zea mays
  misc_feature: Ceres CLONE 376550-F
MQRDTSSSDVSASHVGRVRRRKHPTEATTDGNRANGQPLLVNDQE

SEQ ID NO: 8987 - DNA, 370 bp, Zea mays
  misc_feature: Ceres CLONE 376561-F
  misc_feature: Encodes the peptide sequence at SEQ ID NO. 8988
  misc_feature (240)..(240): n is a, c, t, g, unknown, or other
  misc_feature (275)..(275): n is a, c, t, g, unknown, or other
tcaccgcaagatccaccacaacagcgaaggagaaagcagaccaacctagccacccagggagaaaggccaaaagggaggggagagtgtcgtcatggcttccattgtcgcttccaggagggccgttcctctagttcgcgctctggagaagctcatcgcagcgtcctccgcgcccgggactggctccgcctcaggccggtggcactcgccggcggcctccgtggctacaacaccggcgctccnytccgacgctacgagggggccgagtcggaagacrntagcgtccgckaggtacgatgggcggcacggcggccgggactacgccgtgccagcctgttctcagatattttccgtgatccgcttagtgcgccgc

SEQ ID NO: 8988 - protein, 93 aa, Zea mays
  misc_feature: Ceres CLONE 376561-F
  misc_feature (50)..(50): Xaa is any aa, unknown, or other
  misc_feature (62)..(62): Xaa is any aa, unknown, or other
MASIVASRRAVPLVRALEKLIAASSAPGTGSASGRWHSPAASVATTPALXSDATRGPSRKTXASARYDGRHGGRDYAVPACSQIFSVIRLVRR

SEQ ID NO: 8989 - DNA, 372 bp, Zea mays
  misc_feature: Ceres CLONE 376569-F
  misc_feature: Encodes the peptide sequence at SEQ ID NO. 8990
aaaccaagctcgatccatctcactctccgctggtcgctcactcttgcagctccacccttcactcagtcttagtctcttattagctctaggctctagctagccgcgccactccttcgtgtagccatcagccttctcatcgccaccaatggccactgccgaggtccagaccccgaccgtcgtggcggccgaggaagcgcccgtggtggagaccccgccgccggccgtcgtgcccgaggagtctgcccccgccgaggccgaggccgaggscgaggstgctgctcctgctgatcccgaggagcttcccgcggccgagcagcaggcagccgccgaggcgtaggccgcggctcctgctggtgccgaggagcccgtcgc

SEQ ID NO: 8990 - protein, 63 aa, Zea mays
  misc_feature: Ceres CLONE 376569-F
  misc_feature (41)..(41): Xaa is any aa, unknown, or other
  misc_feature (43)..(43): Xaa is any aa, unknown, or other
MATAEVQTPTVVAAEEAPVVETPPPAVVPEESAPAEAEAEXEXAAPADPEELPAAEQQAAAEA

SEQ ID NO: 8991 - DNA, 215 bp, Zea mays
  misc_feature: Ceres CLONE 376589-F
  misc_feature: Encodes the peptide sequence at SEQ ID NO. 8992
  misc_feature (134)..(134): n is a, c, t, g, unknown, or other
atcttgctctgaacgcattcctcccatctcccaagacctcctcagacccgagaagcgcmkgcggccatggacgccaccggcactggagctggagggaaggcgaagaagggagcggccggtcgcaaggccgcggngccgaggaagaagtcggtgacgagggtccgtgaaggccgggctccagttccccgtcggccgcatcgggcgctacctcaaga

SEQ ID NO: 8992 - protein, 49 aa, Zea mays
  misc_feature: Ceres CLONE 376589-F
  misc_feature (23)..(23): Xaa is any aa, unknown, or other
MDATGTGAGGKAKKGAAGRKAAXPRKKSVTRVREGRAPVPRRPHRALPQ

SEQ ID NO: 8993 - DNA, 204 bp, Zea mays
  misc_feature: Ceres CLONE 376604-F
actcatacatttcgactctcaactcccaaggtcccttttttttctctatctggaagcgccgcagtagcagccatggacgtgagcggasagtgcgggataggcgaagwagggcgcggccgggcgctaaggccggcgggccgacgaagaagtcggtgtcgcggtcctccagggccgggctgcagttccccgtcagccgcgtcgggc

SEQ ID NO: 8994 - DNA, 494 bp, Zea mays
  misc_feature: Ceres CLONE 376609-F
  misc_feature: Encodes the peptide sequence at SEQ ID NO. 8995
aaactcacacgcgagacggagacgcggccgcagccgaggtctgcataaaagcgcaaaatatctctcgctctcggctctcctcctctccccctcacccccggtgcgctgtctgtgtcccgtctccgcgagaccgcgagcaagttctgtcttcgtccgtccatccgtgcccggtcttactgttggcgctccttgattagcttacccccgccggcgagttcaccctgacatggtcggccggatggagcggcagaccgcgtcgtcgtcagcttcgtgctcctcctcctcctcttcctcctcggtctgcggcggcaagaagcgccctgatatcctcaacatgatccggaatgcagcctgtcttaattcgtcatctactgataccggcaagggaaggagtaaattgtcaaccaacaaagttacacatggattccacctggtggaaggcaagtccggccatggcatggaagactaccatgtggcagagtacaaatatgtga

SEQ ID NO: 8995 - protein, 89 aa, Zea mays
  misc_feature: Ceres CLONE 376609-F
MVGRMERQTASSSASCSSSSSSSSVCGGKKRPDILNMIRNAACLNSSSTDTGKGRSKLSTNKVTHGFHLVEGKSGHGMEDYHVAEYKYV

SEQ ID NO: 8996 - DNA, 258 bp, Zea mays
  misc_feature: Ceres CLONE 376681-F
  misc_feature: Translation starting site: 27
aaagaacagagagaaattactgaagcatgagcgcggacgtgaagagggactacgagatcggcgaggagatcgggcgcggccgcttcggggtggtccaccgctgcacgtcccgcgccaccggggaggccttggcgtcaagtccgtggaccggtcgcggctgggcgacgacctggaccgcgagctcgcgcasstggagccgaagctggcgcmbtcgccggcgcgggcaacccgggcgtggtgcaggtgcacgcggcgtac

SEQ ID NO: 8997 - DNA, 472 bp, Zea mays
  misc_feature: Ceres CLONE 376685-F
  misc_feature: Encodes the peptide sequence at SEQ ID NO. 8998
  misc_feature (226)..(226): n is a, c, t, g, unknown, or other
  misc_feature (227)..(227): n is a, c, t, g, unknown, or other
  misc_feature (425)..(425): n is a, c, t, g, unknown, or other
  misc_feature (431)..(431): n is a, c, t, g, unknown, or other
acgatttagaaaccctcacctcttcccttcctccccgccgccgccaccgccggaaggagaaaaaaaatgggtgccgatggggaagaagcgtcgcggatagtcgtgccaatggcggtggaggggacctcggagcagctggcgttcgtaggagtcgaagctgcagaagcgcaaggagaacgcggactgggccgtcagaaccgggagcgcagggcggttaaagcgccannattccgcgacgagcacaaggtcaccgtaagcggcccgaggacttcgttgcggcgttccggaacaaggaacgcgacttcctgcggatgaggacccgcctcaaggtccgcaagcagccgcccgccgaggcgctcagctccaagctcgtcttcgcaattcgcatccctggctccgtggacttgcatccgcacatcaggaangtcttnaggaagctacggctgacgacggtcctcaccggcgtattcct

SEQ ID NO: 8998 - protein, 53 aa, Zea mays
  misc_feature: Ceres CLONE 376685-F
  misc_feature (38)..(38): Xaa is any aa, unknown, or other
  misc_feature (40)..(40): Xaa is any aa, unknown, or other
MRTRLKVRKQPPAEALSSKLVFAIRIPGSVDLHPHIRXVXRKLRLTTVLTGVF

SEQ ID NO: 8999 - DNA, 379 bp, Zea mays
  misc_feature: Ceres CLONE 376710-F
  misc_feature (97)..(97): n is a, c, t, g, unknown, or other
aaaccctagccgcactgcgctcatttctgcatccccctcccgccgcgccgcctcaccgccgccggagaagatgggtcgcgtgatccgcgcgcastanagggtgcggggtccgtgttcaagtcccacacccaccaccgcaaggccccgccgctttccgctccctcgacttcggcgagcgcaacgggtacctcaagggcgtcgtcaccgasgtcatccacgaccccggccgtggcgcgccgctcgccaaggtcactttccgccacccattcaggtacaagcaccagaaggagctctttgtcgcagccgagggcatgtacacgggccagttcgtctactgcggtcgccgcgccaccctctccatcggcaacgtgctgcccct

SEQ ID NO: 9000 - DNA, 476 bp, Zea mays
  misc_feature: Ceres CLONE 376737-F
  misc_feature: Encodes the peptide sequence at SEQ ID NO. 9001
atcgaacaccaatggcattcttgcattgaaggaaccttccctccacctccaccgcccgagagcgagcggccggacggggttttggttgggcatggctgccccggcgatgctccaagtggtgatcctcgccgcggtcctccttctcccgttcctcagcgtgccgggcgccgaggcacagaccaagaagttctgcctcacgcagttcgccatcgctagccaggcctgcgccatcctgccacccaccagtcctgagcaccaccaccatcatcacgatgacgaggacaatgacgaggacaacgacgaagatgaggacgaagacgaggacaacgatgaagatgaagacgaggacaatgggaaggttaaggccggtggcgcctacacaatgaacactgctagtgcggtcactgtgagaagcacaatccggcgcctgcgggagcagatccgaagcatgattgcgggcagcttgaaaaggagta

SEQ ID NO: 9001 - protein, 128 aa, Zea mays
  misc_feature: Ceres CLONE 376737-F
MAAPAMLQVVILAAVLLLPFLSVPGAEAQTKKFCLTQFAIASQACAILPPTSPEHHHHHHDDEDNDEDNDEDEDEDEDNDEDEDEDNGKVKAGGAYTMNTASAVTVRSTIRRLREQIRSMIAGSLKRS

SEQ ID NO: 9002 - DNA, 241 bp, Zea mays
  misc_feature: Ceres CLONE 376747-F
  misc_feature: Encodes the peptide sequence at SEQ ID NO. 9003
gggtgctaaggagaaatggccacttccgcgcctgcgccaatgccgacggsgctgctcccggagtgtagatggccgcagcggcttctgcgaggtgaccaggacgttccgcagcctgcgcccgccggtgccgctgccgccgacggactcaccgctctcgtttccggagtttgcgttctctttcctggcgtcgtccccgacccccgcgcacccggctcttctcgacgccgccaccgssaggccg

SEQ ID NO: 9003 - protein, 80 aa, Zea mays
  misc_feature: Ceres CLONE 376747-F
  misc_feature (17)..(17): Xaa is any aa, unknown, or other
  misc_feature (78)..(78): Xaa is any aa, unknown, or other
GAKEKWPLPRLRQCRRXCSRSVDGRSGFCEVTRTFRSLRPPVPLPPTDSPLSFPEFAFSFLASSPTPAHPALLDAATXRP

SEQ ID NO: 9004 - DNA, 383 bp, Zea mays
  misc_feature: Ceres CLONE 376756-F
  misc_feature: Encodes the peptide sequence at SEQ ID NO. 9005
  misc_feature (225)..(225): n is a, c, t, g, unknown, or other
  misc_feature (267)..(267): n is a, c, t, g, unknown, or other
  misc_feature (315)..(315): n is a, c, t, g, unknown, or other
  misc_feature (350)..(350): n is a, c, t, g, unknown, or other
  misc_feature (362)..(362): n is a, c, t, g, unknown, or other
actggattgacagcctctgacgccgaaaaagccacagatcggatcgcggcgggcagaggccacctccggattcgggcgctcggcgtagcgcagtggtgtgtctgcctccctccttgtatcctcctcgaattcgagcggcggcgacggcgggaagggagatggaggcggttagaggcgatgggaggtggtgcgtggtgactggcggccgcgggttcgccgcgaagnatcctggtgacgatgctgctccgctccggcgattggcgggtncgcgtggccgacctgggccctccatcacgctcgaccgcgacgaataanagggtttcctgggtgctgctctccgcgaargccangccgtctacgtntccgccgacctccgtgacaag

SEQ ID NO: 9005 - protein, 51 aa, Zea mays
  misc_feature: Ceres CLONE 376756-F
  misc_feature (23)..(23): Xaa is any aa, unknown, or other
  misc_feature (37)..(37): Xaa is any aa, unknown, or other
MEAVRGDGRWCVVTGGRGFAAKXPGDDAAPLRRLAGXRGRPGPSITLDRDE

SEQ ID NO: 9006 - DNA, 137 bp, Zea mays
  misc_feature: Ceres CLONE 376773-F
acacgcacaccgcgacccagtccagagccagtacgtgcgamggcacgcacgctgctggtccgcgtacssagacgacggtcaggtcvgccggtgcttttcagtttggaataatgacggcgacgacgacgacagccgcc

SEQ ID NO: 9007 - DNA, 324 bp, Zea mays
  misc_feature: Ceres CLONE 376806-F
  misc_feature: Encodes the peptide sequence at SEQ ID NO. 9008
aaccaagctcgatccatctcactctccgctggtcgctcactcttgcagctccacccttcactcagtcttagtctcttattagctctaggctctagctagccgcgccactccttcgtgtagccatcagccttctcatcgccaccaatggccactgccgaggtccagaccccgaccgtcgtggcggccgaggaagcgcccgtggtggagaccccgccgccggccgtcgtgcccgaggagtctgcccccgccgaggccgaggccgaggccgaggctgctgctcctgctgatcccgaggagcttcccgcggccgagcagcaggcagcc

SEQ ID NO: 9008 - protein, 60 aa, Zea mays
  misc_feature: Ceres CLONE 376806-F
MATAEVQTPTVVAAEEAPVVETPPPAVVPEESAPAEAEAEAEAAAPADPEELPAAEQQAA

SEQ ID NO: 9009 - DNA, 222 bp, Zea mays
  misc_feature: Ceres CLONE 376810-F
  misc_feature (139)..(139): n is a, c, t, g, unknown, or other
akcttrcwctgaacgcattcctcccatctcccaagacctcctcagacccgagaagcgcavkgcggccatggacgccaccggcactggagctggagggaaggcgaagaagggagcggccggtcgcaaggccgcgggcganggaagaagtcggtgacgaggtccgtgaaggccgggctccagttccccgtcggccgcatcgggcgctacctcaagaagggccgc

SEQ ID NO: 9010 - DNA, 1409 bp, Zea mays
  misc_feature: Ceres CLONE 376815
  misc_feature: Encodes the peptide sequence at SEQ ID NO. 9011
acaacaagtccacaactcacagcacgaaaccacgcgcagatccaaacgaatgcgagcccgtccaaacacttgaggcctcgagcccgcctctccctcctcttcctctcaacaccaccggcatacccatggcgaagtacggcgagggcgacaagcggtggatcgtggaggagcgcgccgatggcaccaacgtccacaactggcactgggcggagcgcgactgcatcgagtggtcccgcgcgcggctctcctcgctgctcgcgggcctcaccgtcctcgacggcgaggacggcctcacgctccgcaccgtcgcgctcgacaatctcgacggcgaggcctacgtcaacatccgcaagggcaaggtcatcccagggtacgagctctcgctcaccctctcttgggaggccgaggccgcttcggagtccggagctgtgaaggtcgccggcaccgccgaggtcccctaccttgccgacgagaacgctgacgaggaccccgacctccacatcaccgtgcgcggtgacgagacgcccctcgcgctccgcgccaaagatgccttcctctcccgcggcaaacccatggtgctcgaaaagatccgggagttcgttgctgccatggccaagggtggaccggcgaaggacgagctggattccaagaaaactcctgcgaaggtcgccgctgcagcgcctggcgccgctccggcgaagaaagaggaggtggtggctcctgcgccggctgcggggaagaaaaaggccaaggggaaggacaaggaggggttcaagaccattaagatgacggagacgttctactgccgctcaaaggacatatatgagatcttgatggatgagaacagatggaaagggtttacacagagcaatgcgaagatcagtagagaggttggaggggaatttagcctctttgatgggtgcatcactggcgtcaacgaggatctgcaggaaggaaaactgattgcgcagaaatggcggtttggaagctggcctgacggcttgtactcctcggtccggttgatgttggatgagcccgagtctggagttacagtcataaaactcaaacaaactggtgtgccagaggaagacaagtatgggaattcaactgtggttgagaacacggagagaggctggagagatctcatattccagcggatacgtgggatgtttggttttgggatctaaagagtctatagagaggcgatttaatttggcatgatgtcctaattcaaatttttacggggtcaggccatgaatgctatagcaatccaagtttctcacccagttttttttcttcatgtcggcaaaacgcaaaactctgcatatgatggggatttgaaaacatctgttattcatcaggctaaaacgctgcagtattccttgccccctaaaaaaaaaaaaaaaaaa

SEQ ID NO: 9011 - protein, 353 aa, Zea mays
  misc_feature: Ceres CLONE 376815
  misc_feature (29)..(164): Pfam Name: Aha1_N Pfam Description: Activator of Hsp90 ATPase, N-terminal
MAKYGEGDKRWIVEERADGTNVHNWHWAERDCIEWSRARLSSLLAGLTVLDGEDGLTLRTVALDNLDGEAYVNIRKGKVIPGYELSLTLSWEAEAASESGAVKVAGTAEVPYLADENADEDPDLHITVRGDETPLALRAKDAFLSRGKPMVLEKIREFVAAMAKGGPAKDELDSKKTPAKVAAAAPGAAPAKKEEVVAPAPAAGKKKAKGKDKEGFKTIKMTETFYCRSKDIYEILMDENRWKGFTQSNAKISREVGGEFSLFDGCITGVNEDLQEGKLIAQKWRFGSWPDGLYSSVRLMLDEPESGVTVIKLKQTGVPEEDKYGNSTVVENTERGWRDLIFQRIRGMFGFGI

SEQ ID NO: 9012 - DNA, 416 bp, Zea mays
  misc_feature: Ceres CLONE 376830-F
  misc_feature: Encodes the peptide sequence at SEQ ID NO. 9013
  misc_feature (292)..(292): n is a, c, t, g, unknown, or other
aaatcagccctcgcgtttctcccttcccccggctcccggcgtctctgcgctgcggccgtacgsssatgcggtggctatcgaggctgctctctcaagccgtcgccgccagagggcctccgcggcggcgaggtccaacactagtctcgtcaagggaggatcccacgggttcgctagtggcggcagggatgggtcaccggagyctccgggagtggttgcggaactgtgggtagacgagctgaagaagcagaaggaagccgcgagagatggggcgtcggctcatcattagaggttncaggagcgaccgaggaggcaccgtcaaggagctatcagtacgaatacagcggctctaaccccgtggaggccaaactggctccgcttcttgcaagagctaacctcgtcattgccaggggatattg

SEQ ID NO: 9013 - protein, 94 aa, Zea mays
  misc_feature: Ceres CLONE 376830-F
  misc_feature (21)..(21): Xaa is any aa, unknown, or other
  misc_feature (22)..(22): Xaa is any aa, unknown, or other
  misc_feature (67)..(67): Xaa is any aa, unknown, or other
NQPSRFSLPPAPGVSALRPYXXAVAIEAALSSRRRQRASAAARSNTSLVKGGSHGFASGGRDGSPEXPGVVAELWVDELKKQKEAARDGASAHH

SEQ ID NO: 9014 - DNA, 135 bp, Zea mays
  misc_feature: Ceres CLONE 376836-F
acgcacaccgcgacccagtccagagccagtacgtgcgamggcacgcacgctgctggtccgcgtacgagacgacggtcaggtcggccggtgcttttcagtttggaataatgacggcgacgacgacgacagccgccg

SEQ ID NO: 9015 - DNA, 300 bp, Zea mays
  misc_feature: Ceres CLONE 376865-F
  misc_feature: Encodes the peptide sequence at SEQ ID NO. 9016
  misc_feature (93)..(93): n is a, c, t, g, unknown, or other
gatctgagatcgacatcgatccaccgaggtttcttgtgcgtgccgccatggccatggcagtagctcaccttcttcctcagctctccgccgamnatttggagctagcaggaacagaatggccattctcttgattcttcagctttttctcttgacggcgctaggcgtggatggagcggcgtcgttcatcttcaccaacgcctgcwagcacgcggtgtgggtgggcgcgctccacggcgccactcgccgccgctcgcgcggtcggggcttctacctggcgccgtccgccacgtccagcatggv

SEQ ID NO: 9016 - protein, 61 aa, Zea mays
  misc_feature: Ceres CLONE 376865-F
  misc_feature (30)..(30): Xaa is any aa, unknown, or other
MAILLILQLFLLTALGVDGAASFIFTNACXHAVWVGALHGATRRRSRGRGFYLAPSATSSM

SEQ ID NO: 9017 - DNA, 269 bp, Zea mays
  misc_feature: Ceres CLONE 376871-F
  misc_feature: Encodes the peptide sequence at SEQ ID NO. 9018
  misc_feature (251)..(251): n is a, c, t, g, unknown, or other
agcagcgtagaaactagaaagaccagtccccaaactccccagcggggcgagtagaggaggaagagtcgccgccgccgtctgctctgctckccgccgccgccgccatgtctgggggaatcgcccgckgccgcctcgccgaggagcgcaaggcctggcgcaagawccacccgcacggtttcgtcgcgaacgcggagtcgctgcccgacgggacggtgaacctgatgatctggcagtgcaccatccccggcaancaagggactgacctgcgc

SEQ ID NO: 9018 - protein, 55 aa, Zea mays
  misc_feature: Ceres CLONE 376871-F
  misc_feature (8)..(8): Xaa is any aa, unknown, or other
  misc_feature (20)..(20): Xaa is any aa, unknown, or other
  misc_feature (49)..(49): Xaa is any aa, unknown, or other
MSGGIARXRLAEERKAWRKXHPHGFVANAESLPDGTVNLMIWQCTIPGXQGTDLR

SEQ ID NO: 9019 - DNA, 319 bp, Zea mays
  misc_feature: Ceres CLONE 376878-F
  misc_feature: Encodes the peptide sequence at SEQ ID NO. 9020
aattgcacccttggctcctactcactctctctccccatccgcgccagtccaaccaagtcagcacccgcgcgcggcaaggagttcacgcccatggsagcaccaacatggcgtcggccacctcgcggttcatgctggccgcgggcgtgcccactgccagtagcggcagcccgcgtcassttcgcctcggcgcccaaccggcttggcaggaggcttgtggtccgggccgatgaggagttcccggcagagcsscggcccacggsgtaaggggagggcgccgtggccaccaagcccaaggccgagaagccgccgccgatcgggc

SEQ ID NO: 9020 - protein, 56 aa, Zea mays
  misc_feature: Ceres CLONE 376878-F
  misc_feature (2)..(2): Xaa is any aa, unknown, or other
  misc_feature (29)..(29): Xaa is any aa, unknown, or other
  misc_feature (53)..(53): Xaa is any aa, unknown, or other
MXAPTWRRPPRGSCWPRACPLPVAAARVXFASAPNRLGRRLVVRADEEFPAEXRPT

SEQ ID NO: 9021 - DNA, 277 bp, Zea mays
  misc_feature: Ceres CLONE 376889-F
  misc_feature: Encodes the peptide sequence at SEQ ID NO. 9022
  misc_feature (127)..(127): n is a, c, t, g, unknown, or other
  misc_feature (214)..(214): n is a, c, t, g, unknown, or other
atccgtgcatacatgctcattgctcaccaagggcaagggaggaggagaggacacacagcggtassgcgaaatggcggcgatgatgatggatagtaccgcggagaaagacctcgccggcgacgcttgncggtgagcgggcacgggcaggacttggagcggtcttgccatgaccaggagcccgccgctgcaratggtgcgagcagcagaggcctanccatcgggcgttttcgtacgggagctgatggtggagggcgtggcgtckttcctgctggtgttc

SEQ ID NO: 9022 - protein, 37 aa, Zea mays
  misc_feature: Ceres CLONE 376889-F
  misc_feature (16)..(16): Xaa is any aa, unknown, or other
MTRSPPLQMVRAAEAXPSGVFVRELMVEGVASFLLVF

SEQ ID NO: 9023 - DNA, 472 bp, Zea mays
  misc_feature: Ceres CLONE 376916-F
  misc_feature: Encodes the peptide sequence at SEQ ID NO. 9024
aagcacgaggctgtgagcgagacagccaaggtgctcatcgactccagccagccgcccaaaaagccaggcgcaaatcacaacctcgcctcctgtcccctccccggctcctcgttcccctctcgccgctcgcctccccgccgagatcgaggaggcgccaatagcgagagggtttcctcttccctccacggctccaacgagcccccggcccctccgcctcaaatcccacgcgcccggttggccgccgcccccgccatggatgtggatctgtggatctccaaggtcaaggaaggccagcacctcgccgagcacgagcttcagtctctctgcgaatacgtaaaggagatcctcatcgaagagtcgaacgttcaaccggtgaatagccctgtgacggtttgcggtgacatccatgggcagttccatgacctgatgaagctcttcgcgacggggggcacgtccagagacgaactatatt

SEQ ID NO: 9024 - protein, 73 aa, Zea mays
  misc_feature: Ceres CLONE 376916-F
  misc_feature: SWISSPROT Homolog: EC 3.1.3.16 Phosphoprotein phosphatase
MDVDLWISKVKEGQHLAEHELQSLCEYVKEILIEESNVQPVNSPVTVCGDIHGQFHDLMKLFATGGTSRDELY

SEQ ID NO: 9025 - DNA, 213 bp, Zea mays
  misc_feature: Ceres CLONE 376924-F
  misc_feature: Encodes the peptide sequence at SEQ ID NO. 9026
agttttgccgctctgtgagcmtgctgccgtcttcttccgccgccgccgccgtcgtcgtcttcgtccgtagcagatcagagagcggggaggaagaaaaagcgatcgatggcgtccaactacgtggacacgccgggcgaggagggacggttccacggccctcacagccacagcaccagcacgaccccgacggcggcgcggcggcggcggcggcat

SEQ ID NO: 9026 - protein, 36 aa, Zea mays
  misc_feature: Ceres CLONE 376924-F
MASNYVDTPGEEGRFHGPHSHSTSTTPTAARRRRRH

SEQ ID NO: 9027 - DNA, 434 bp, Zea mays
  misc_feature: Ceres CLONE 376971-F
  misc_feature: Encodes the peptide sequence at SEQ ID NO. 9028
  misc_feature (134)..(134): n is a, c, t, g, unknown, or other
gcatcccatctccatccccatccatagagctgcaggcggcctgcgctgcagccaacaagctcatcagctcaccgtacctaggaggacgaccgagcagctaaggtagtagtagctagctagccagtgatggcggngctacaaagcgcagggcggggcgctcggcgtcgtcctggctgtcgccgcgctcttcgcssgccassgattggcgatggcggtggacgacgagcacatgtaccactggaagtgcttcaagtcgtgcacggggaactgccgcgacgaggacgcctttgacgacgtcgtccccgccactccgaggggctcctcccacgtcgtcgtcgctgccgtctccggcgggcaagtgcaaggacaggttgcctcagcgagtgcttcgaggacctgccggccctcttgctaccaccagtgcgtcgccacca

SEQ ID NO: 9028 - protein, 75 aa, Zea mays
  misc_feature: Ceres CLONE 376971-F
MAVDDEHMYHWKCFKSCTGNCRDEDAFDDVVPATPRGSSHVVVAAVSGGQVQGQVASASASRTCRPSCYHQCVAT

SEQ ID NO: 9029 - DNA, 434 bp, Zea mays
  misc_feature: Ceres CLONE 376979-F
  misc_feature: Encodes the peptide sequence at SEQ ID NO. 9030
  misc_feature (136)..(136): n is a, c, t, g, unknown, or other
atcgcctccaccgctctctcttcctctgctcttctctgcctgcctgagctcaccgcacctcgcctcctcaccgcgtttcctccgttaatccggtagaaaatggccgatgccgaggatatccagcccctcgtctgcnacaacggaactggcatggtcaaggctgggttcgctggcgacgacgccccgagggccgtcttccccagcatcgtggggcgcccgcgcacactggtgtcatggtcgggatggggcagaaggacgcctacgtcggtgacgaggcgcagtccaagaggggtatcctgaccctcaagtaccccatcgagcacgggatcgtcagcaactgggacgacatggagaagatctggcatcacaccttctacaacgagctccgcgtggctcccgaggagcaccccgtcctcctcaccgaggcgcccctg

SEQ ID NO: 9030 - protein, 67 aa, Zea mays
  misc_feature: Ceres CLONE 376979-F
  misc_feature: SWISSPROT Homolog: EC 2.7.10.2 Non-specific protein-tyrosine kinase
MVGMGQKDAYVGDEAQSKRGILTLKYPIEHGIVSNWDDMEKIWHHTFYNELRVAPEEHPVLLTEAPL

SEQ ID NO: 9031 - DNA, 429 bp, Zea mays
  misc_feature: Ceres CLONE 377011-F
  misc_feature: Encodes the peptide sequence at SEQ ID NO. 9032
aggattaataaaagtaaaaaaattccaaccgcacacggcacctcctctcgtccgttcgccgcctggctcgcaccgctgacagtgcgtcagtccaggtcgatactccctctttccaagatccggtcattctctctcggggtcggctaccgccgccgccgtacgccaggtgccgactgccgagaccttctccgatctgtttgccggcgaagagcgcccgccaaatctgcccctggtttcaaccgattgaaccccgatgtccgacgtcgagaaccctggcgtgggtgggaagccgccgccgtacaaggaccctgacaatgggagtcagcgattcctactcgagttggagttcgtgcagtgcctcgccaackctacctacatccactatctagcgcagaatagatatttcgaggatgaggcatttatcgggta

SEQ ID NO: 9032 - protein, 58 aa, Zea mays
  misc_feature: Ceres CLONE 377011-F
  misc_feature (21)..(58): Pfam Name: SOH1 Pfam Description: SOH1
  misc_feature (39)..(39): Xaa is any aa, unknown, or other
MSDVENPGVGGKPPPYKDPDNGSQRFLLELEFVQCLANXTYIHYLAQNRYFEDEAFIG

SEQ ID NO: 9033 - DNA, 400 bp, Zea mays
  misc_feature: Ceres CLONE 377016-F
  misc_feature: Encodes the peptide sequence at SEQ ID NO. 9034
agaccacacaccacagcactaaaatctgttcatctctggctccccaaattcagctggagagcactttttcccatcatggataagaactacggtgaactctacaacatcctcggatggggtgaggagtacttcgcggtgaacacggaggggcacctcagcgtgaagcctttcggccgctggacggagcccgggcaggagatcgacgtgcactcggtcatcgtggaagctctagcgacccaacccaacgacagcaccagcaaatctcagttccccatgatccttcgcttccccgacgtgctcaagaaccgtatcgagacgctccataacgcattcaacagcgccatggagtccaccgggtacacgtccaggtaccaaggcgtgttcccgatcaaggtgaacc

SEQ ID NO: 9034 - protein, 108 aa, Zea mays
  misc_feature: Ceres CLONE 377016-F
  misc_feature: SWISSPROT Homolog: EC 4.1.1.19 Arginine decarboxylase
MDKNYGELYNILGWGEEYFAVNTEGHLSVKPFGRWTEPGQEIDVHSVIVEALATQPNDSTSKSQFPMILRFPDVLKNRIETLHNAFNSAMESTGYTSRYQGVFPIKVN

SEQ ID NO: 9035 - DNA, 118 bp, Zea mays
  misc_feature: Ceres CLONE 377091-F
  misc_feature (39)..(39): n is a, c, t, g, unknown, or other
  misc_feature (44)..(44): n is a, c, t, g, unknown, or other
acacgcacaccgcgacccagtccagagccagtacgtgcnaaagncacgcacgctgctggtccgcgtackagacgacggtcaggtcggccggtgcttttcagtttggaataatgacggc

SEQ ID NO: 9036 - DNA, 493 bp, Zea mays
  misc_feature: Ceres CLONE 377094-F
  misc_feature: Encodes the peptide sequence at SEQ ID NO. 9037
tggacgggctcgcttctgccgctccgcgcttgtgcggtgggtgaagtgctggtgctggtgcgggaagcgtcgccaaacctagcgggtgcagaccttggtgggggagcgatgagtcgaaacaagaaccatgagtgaaacagggcacactgtacaagtcactaacctctcgagcagagtatctgaaagtgatctttatgagttctttttgttctctggccctattgaacatgttgaacttatcagatcaggagaatacggtgctactgcttatgtgacattcaaggagcgctttgccttggaaactgcggtattgctcagtggggctactattgtggatcagccggtatgcataacttattggggacaacctgaggagacttttaatttctgggacaggccaacttgggaggttgaagaggaaatttgaatacacgagctatcaatcatgccagtacaacactactccgcaggaagctcttacagtggctcaaga

SEQ ID NO: 9037 - protein, 99 aa, Zea mays
  misc_feature: Ceres CLONE 377094-F
MSETGHTVQVTNLSSRVSESDLYEFFLFSGPIEHVELIRSGEYGATAYVTFKERFALETAVLLSGATIVDQPVCITYWGQPEETFNFWDRPTWEVEEEI

SEQ ID NO: 9038 - DNA, 184 bp, Zea mays
  misc_feature: Ceres CLONE 377161-F
ctagtgccacccaccaacttccccttccccgtcgcatcgcatcgagagcggggctgtaccgtgcgagactctactgctcgatcgccatggccgccgcgctcaggtgcccggcctccgtcaggtctcgggccccgccgccgcgbttcgccaaggtgcgccaggcgtccagagtcgtcgcggtgag

SEQ ID NO: 9039 - DNA, 160 bp, Zea mays
  misc_feature: Ceres CLONE 377173-F
  misc_feature (74)..(74): n is a, c, t, g, unknown, or other
  misc_feature (75)..(75): n is a, c, t, g, unknown, or other
aacaacagcgaacacatctcctcgcatttcttcccatccgatccccccttcgcaaccaaaaccccaactcgccnngcatcgatggcgcccaaggccgagaagaaacyygcggcgaagaagccggctggagtgagtgagcccgcggccgagaaggcgcccg

SEQ ID NO: 9040 - DNA, 340 bp, Zea mays
  misc_feature: Ceres CLONE 377195-F
  misc_feature: Encodes the peptide sequence at SEQ ID NO. 9041
  misc_feature (62)..(62): n is a, c, t, g, unknown, or other
  misc_feature (224)..(224): n is a, c, t, g, unknown, or other
  misc_feature (266)..(266): n is a, c, t, g, unknown, or other
  misc_feature (302)..(302): n is a, c, t, g, unknown, or other
aaaaagaagaaggggaggcccgcgactgtagtggggagatgcctcggcatactgcgcccgcngccggccattcggagcgcggcaagatggacgaggtggtagaggcagatccggacacgaggcggaggatcaggaggagaggtgggcgacgctgctaccagagtttgctctccgacgtgttgctgcgcgtcgaggcctcckgcgccgagcagtggccggcssgnaaggacatcgtctctttcgcctgcktgtgccgctggtggcgnaaggcctcattctccgttgtgcgtcctccggcggantccgccaagatcaccttcccctcctcgctcaakcagcc

SEQ ID NO: 9041 - protein, 100 aa, Zea mays
  misc_feature: Ceres CLONE 377195-F
  misc_feature (55)..(55): Xaa is any aa, unknown, or other
  misc_feature (62)..(62): Xaa is any aa, unknown, or other
  misc_feature (71)..(71): Xaa is any aa, unknown, or other
  misc_feature (88)..(88): Xaa is any aa, unknown, or other
  misc_feature (99)..(99): Xaa is any aa, unknown, or other
MPRHTAPAAGHSERGKMDEVVEADPDTRRRIRRRGGRRCYQSLLSDVLLRVEASXAEQWPAXKDIVSFACXCRWWRKASFSVVRPPAXSAKITFPSSLXQ

SEQ ID NO: 9042 - DNA, 193 bp, Zea mays
  misc_feature: Ceres CLONE 377231-F
  misc_feature (131)..(131): n is a, c, t, g, unknown, or other
gtgcccgcggtgctactgacggttgctctagatccgttcatcctggtggttttgtgaggtcgaaagcggcgagcgaattagaagatgctggacaagctgtgggacgacgtggtggccgggcctcgccgtangacggcctcgagaagctccgcaaggccaccaccgcccgcccgctcgtcatcaacaaagacgc

SEQ ID NO: 9043 - DNA, 122 bp, Zea mays
  misc_feature: Ceres CLONE 377234-F
gadaccctaactcctccctccaagcacctagctgccgccggttcccgcgtatkggagggtcgcggcgcaaattkaagcgctcccgcactaaggtccgcgtkgggcttccccgccggaaaccc

SEQ ID NO: 9044 - DNA, 272 bp, Zea mays
  misc_feature: Ceres CLONE 377292-F
  misc_feature: Encodes the peptide sequence at SEQ ID NO. 9045
  misc_feature (201)..(201): n is a, c, t, g, unknown, or other
acaacaccagaatccgcgaatcacagacgcgtctatctcagcttgctgcactgcactaccctgccctgccatcatatcgtacgtgagcccggccgagcgagagvrggaaggaggcatggctgctccgaagctcgcgacgctggcgctggccgtgctcctggcggcgaccgtggtggctcccccggccgcggtgcgcgcggnatggtcgtgctccaccgtgtacagcacgctgatgccgtgcctgccgttcgtccagatgggcgggggccatg

SEQ ID NO: 9045 - protein, 52 aa, Zea mays
  misc_feature: Ceres CLONE 377292-F
  misc_feature (29)..(29): Xaa is any aa, unknown, or other
MAAPKLATLALAVLLAATVVAPPAAVRAXWSCSTVYSTLMPCLPFVQMGGGH

SEQ ID NO: 9046 - DNA, 487 bp, Zea mays
  misc_feature: Ceres CLONE 377296-F
  misc_feature: Translation starting site: 303
agatttgacccatctcccaacccctacactcccggcggcggcgcaggagcagcagcacccgaggatggtgaagttcctcaagcccggcaaggccgtgatcctcctgcagggccggttcgccggcaggaaggcggtgatcgtgccgtgttcgaggagggcacccgcgaccgcccctacggccactgcctcgtcgccggcctcgccaagtaccccaagaaggtggtccgcaggactcggccaagaagacggcgaagaagtcgcgcgtcaagtgcttcatcaagctcgtcaacttcacccacctcatgcccacccgctacaccctcgacgtcgacttcaaggacgtggccaccggcgggcccgacgcgctctccacccgcgacaagaaggtcgccgcctgcaasscggccaaggsgcgcctcgaggagaggttcaagaccggycaagaacaggtggttctttaccaagctccgcttctagatggtcggcg

SEQ ID NO: 9047 - DNA, 162 bp, Zea mays
  misc_feature: Ceres CLONE 377297-F
  misc_feature: Encodes the peptide sequence at SEQ ID NO. 9048
  misc_feature (68)..(68): n is a, c, t, g, unknown, or other
gtgtcattgtctgtcagtgctcgccgcgcggatctagggggaggggggccgtgccggcgcggacgsgnattgccgatctgcgcgccgtcgtccgactcctcggcctcggcctcgtcgggcttgggcgcccgcgtctgggtgctccacgggctagcgctcggc

SEQ ID NO: 9048 - protein, 54 aa, Zea mays
  misc_feature: Ceres CLONE 377297-F
  misc_feature (23)..(23): Xaa is any aa, unknown, or other
VSLSVSARRADLGGGGPCRRGRXLPICAPSSDSSASASSGLGARVWVLHGLALG

SEQ ID NO: 9049 - DNA, 286 bp, Zea mays
  misc_feature: Ceres CLONE 377300-F
  misc_feature (227)..(227): n is a, c, t, g, unknown, or other
  misc_feature (228)..(228): n is a, c, t, g, unknown, or other
aaccgaaacataaatccgtagcctggtcttctgcttcgcraaagatcttgcggaaggtggcagacgcatagatgagggtgagagcatttggcggtassgcttgacgagcgacgagtaaaccctaatgctttgatcgcggcggcatcgtttgagacactcccgaatcgatccgcctacatgcctatgaatcctcctcccccgccgcctcctgggtcggcgtcttcgannccgggggccagctacttccctctccctttccacctgcagcagcaccagccgcagccgc

SEQ ID NO: 9050 - DNA, 467 bp, Zea mays
  misc_feature: Ceres CLONE 377304-F
  misc_feature: Encodes the peptide sequence at SEQ ID NO. 9051
  misc_feature (452)..(452): n is a, c, t, g, unknown, or other
atctgtcgtctcctccagtgcagtccctcccccccctgtctccgccccaactctctccagtctcctcgcgtcggcagtcggcctggcagggctgaatcaatggcggtcgacccgcggcaggtcgtggcgggcttcctcaccctctccatgttcgtcatgctgggcaacatgatcaagcacgaccacttctctcccgtcaccgaggagatgggcttgaaggcaacaggtgcgcgatcatgttgaccagctcgatcgcacgggagaagaggataagaggaagcgagtgggactgtgagtgagttggaaggaggggggtggcaatggcgttgcggaatggtggtggtggtggtggagcctgtcccgcggcggttgtgctggtggctgcggccgtcgcggcgctgctgggcgcggggtggcggcggcgaccaagttcgacgacgtggtgcacccanctgggccaacgacca

SEQ ID NO: 9051 - protein, 47 aa, Zea mays
  misc_feature: Ceres CLONE 377304-F
MAVDPRQVVAGFLTLSMFVMLGNMIKHDHFSPVTEEMGLKATGARSC

SEQ ID NO: 9052 - DNA, 301 bp, Zea mays
  misc_feature: Ceres CLONE 377346-F
atctaccgacccctcacccacatggaaagcgaggaggtgagctgcagctgcgacggagactgagcgagamkccccccctccctccctccttccttcgacgtcaagctccgccccactccatggattcggaattcttggggaggcgaggagctgaggccaggacagggggaggagctgctggggggcagggacaggatagcgcggctaagcggcaacggcggcassatgagctggagacgaggcggaacggaggcgatggcggggtctcgaggaggtgggccgtcctgctctgcgtcggcag

SEQ ID NO: 9053 - DNA, 191 bp, Zea mays
  misc_feature: Ceres CLONE 377402-F
  misc_feature (110)..(110): n is a, c, t, g, unknown, or other
cccttcgccccgtatcgttcccttcctcctctcttttccccaccgccccctttcttggcgtctacccggcgcgaccaggaccgaatcctaaggccgccggcgccggsscncgcsgccgcctgctcccgttggacacggtaaaacctcctccatcctcgtccgtgtcgccggggtccggggtccaagcggct

SEQ ID NO: 9054 - DNA, 479 bp, Zea mays
  misc_feature: Ceres CLONE 377419-F
  misc_feature (354)..(354): n is a, c, t, g, unknown, or other
acaagcggaactcgctgcactgcttggaatccaacgagccaatcattcaaatcctccccggaaccgcgttgagcagggcacggtcgaccggatctagggtgagggtccgtcgccgaagaaactcccaggcggtcacgaggaggcggcgggggagggcggaggagatggcctcggaggagatgacggcgacggaggtggctgcgctgctggatctgaagccgcacccggagcggcttctaacaccgagaccttccgcgacggctccatcacgctcaccacctcccagctcccgccccactacaaggtaaaccgtgctgttagcaccgcaatttatttcctacttcccgcagrgtngtttcccgtctccaccgcattccttgtgctgaaacctggcacttctacaagggagagcctctcacggtcttcgagcttcacgacgatggtcacattgaccttactgtcattggcccacaccttga

SEQ ID NO: 9055 - DNA, 208 bp, Zea mays
  misc_feature: Ceres CLONE 377433-F
  misc_feature (106)..(106): n is a, c, t, g, unknown, or other
  misc_feature (110)..(110): n is a, c, t, g, unknown, or other
atcaaaccctcacagcgaaggacacaaaaacacaggtagggttaggcgacgcggcggcgagagcgcgagagtaggaggaggcgtcggccatgacggggaaggcgansaangaagcacacggcgaaggagatcgccgcgaagatcgacgcggcacgacgaaccggggcggcggcaaggtcgggcaggcggatcggctagggcaggacaa

SEQ ID NO: 9056 - DNA, 418 bp, Zea mays
  misc_feature: Ceres CLONE 377455-F
  misc_feature: Encodes the peptide sequence at SEQ ID NO. 9057
acgacgcaktcggctgccagacaaaaaccctaaacgccgccgccgccgccgctcttcctcgagatgggaggcaagtgcccgcaccgcaagtaaagaagcgccgcctatcccacaagacggctcgccgcggcaagttcctcctgaaggccgacgatgccgtctatgacgagctcgtcaagctggccgaccagggcaatgacgctgaagccaaggagctccccgtcgatgaggacctcccaggcctgggacagttctactgcctccactgcgatcgctactttgcaagtgaaagcgtgaaggatgatcactaccgctcaaagcgccacaagaaaagggttaaggtaatgtctggaccggccccgcacacgcagcttgatgcagaactcgctgcagggatgggaaagcctgacaacggcct

SEQ ID NO: 9057 - protein, 138 aa, Zea mays
  misc_feature: Ceres CLONE 377455-F
  misc_feature: The sequence is a functional homolog of SEQ ID NO 1130 in the 11/479,226 US patent application
  misc_feature: The sequence is a functional homolog of SEQ ID NO 494 in the 10/412,699 US patent application
  misc_feature (3)..(3): Xaa is any aa, unknown, or other
DAXGCQTKTLNAAAAAALPRDGRQVPAPQVKKRRLSHKTARRGKFLLKADDAVYDELVKLADQGNDAEAKELPVDEDLPGLGQFYCLHCDRYFASESVKDDHYRSKRHKKRVKVMSGPAPHTQLDAELAAGMGKPDNG

SEQ ID NO: 9058 - DNA, 290 bp, Zea mays
  misc_feature: Ceres CLONE 377466-F
  misc_feature: Encodes the peptide sequence at SEQ ID NO. 9059
atacggccaccacctgtccttccgcacgtccccgtcggccatcgtccacggatcctatcggtctctcctgtgtcctcttcagtctccacgccgttccagaagtcgccaaccttccctcgccgccgcgccgcaacagccgcctcccctccaaggtagcccaatcgaaaccactcgcccggccaccatggcctttgccagctcgctgcttcccgtgccgccctaccgcgtctgcgcgacccccgcgtcggaggtcgccgccttctcgccggccaagaagagcgtctcgctcg

SEQ ID NO: 9059 - protein, 35 aa, Zea mays
  misc_feature: Ceres CLONE 377466-F
MAFASSLLPVPPYRVCATPASEVAAFSPAKKSVSL

SEQ ID NO: 9060 - DNA, 250 bp, Zea mays
  misc_feature: Ceres CLONE 377477-F
atagccagcgccaaccccggaaaggcggaaacccatcgcaactaatccccaaccccaaacctccaatccacccatcccctcctcatccactccgggcggccatggcctgctccttcgccgccgcgaccgtcgtctcttccgcccccaccccggccgccacgcttcgccgctgccccgcartccgtctctgtttcccgctccgggtcgccaccgccgccasscgctccgcctcgtcgcctccagatccgcg

SEQ ID NO: 9061 - DNA, 242 bp, Zea mays
  misc_feature: Ceres CLONE 377495-F
  misc_feature: Encodes the peptide sequence at SEQ ID NO. 9062
gtcctgtcagctactacccactggccactgcactagccgtctgccgagccgagtgttcctttctagccttcacttctcagcgcggcagscttcgatcccccgactgcagccgccagccgcaccatggagcaagccgcbyatgccgcagttccccgcgtcaagctcggcatccaggggcttgaggtgtcgaagctggggttcgggtgcatggggctcacgggcacctacaacgcgccgctcgg

SEQ ID NO: 9062 - protein, 39 aa, Zea mays
  misc_feature: Ceres CLONE 377495-F
  misc_feature (6)..(6): Xaa is any aa, unknown, or other
MEQAAXAAVPRVKLGIQGLEVSKLGFGCMGLTGTYNAPL

SEQ ID NO: 9063 - DNA, 275 bp, Zea mays
  misc_feature: Ceres CLONE 377496-F
  misc_feature (132)..(132): n is a, c, t, g, unknown, or other
  misc_feature (194)..(194): n is a, c, t, g, unknown, or other
  misc_feature (199)..(199): n is a, c, t, g, unknown, or other
atcccatctccatccccatccatagagctgcaggcgacctgcgctgcagccaacaagctcatcagctcaccgtacctaggaggacgaccgagcagctaaggtagtagtagctagctagccagtgatggcggngctacaaagcgcagggcggggcgctcggcgtcgtcctggvstgtcgccgcgctcttcgcggncacgnatgggcgatggcggtggacgacgagcacatgtaccactggaagtgcttcaagtcgtgcacggggaactgccgcgac

SEQ ID NO: 9064 - DNA, 341 bp, Zea mays
  misc_feature: Ceres CLONE 377603-F
  misc_feature: Encodes the peptide sequence at SEQ ID NO. 9065
aaactaaactacaggaaaagcccaagcgattggttgctgttgcttcctgctttcgcttcgccttcacccgttcgccgtgssgccgagctctctctagctccgccgcttgctagtcgccttcctcccaaatggcgaccgcatgcgggcagcagcctcctgcggttcggtttccgccatgcttcctgcctcctgttccagtcccctcggtgtcctgccccgagcctgggtctgaacctggccgttggcgcaccgggcttatacgcctccgatgctcggcggccggggcggcgacgcgttgggcaagaaggtgtcggctcggctggctctgacgcagcaggtgc

SEQ ID NO: 9065 - protein, 113 aa, Zea mays
  misc_feature: Ceres CLONE 377603-F
  misc_feature (27)..(27): Xaa is any aa, unknown, or other
KLNYRKSPSDWLLLLPAFASPSPVRRXAELSLAPPLASRLPPKWRPHAGSSLLRFGFRHASCLLFQSPRCPAPSLGLNLAVGAPGLYASDARRPGRRRVGQEGVGSAGSDAAG

SEQ ID NO: 9066 - DNA, 397 bp, Zea mays
  misc_feature: Ceres CLONE 377632-F
  misc_feature: Encodes the peptide sequence at SEQ ID NO. 9067
  misc_feature (252)..(252): n is a, c, t, g, unknown, or other
  misc_feature (362)..(362): n is a, c, t, g, unknown, or other
acacgccgctgctccaagaaaccaccgccgagcccaaccgcacaagcgcgcgaggcaggagagagagagagagagagaggcggggagcaaaacaatggaggggaaagaggaggacgtgcgcctgggcsscaacaagttctcggagaaggccggtcggctggagctggagctgcagcggttccagcacgcgctgctgcggcacgaggaggagcgcgcggcgaggcgccccaaggcggcggcgtccaccgcgtngcaggtgcagcggcgtcgcggggtgcatctggtggagtacctctacgggcggcggcgcgacaaccggcggcccaagcagaaggcgcgcgggccgtcctgctgcatgaganccaaggccatcgacgactgacggtgacggccacgc

SEQ ID NO: 9067 - protein, 126 aa, Zea mays
  misc_feature: Ceres CLONE 377632-F
  misc_feature (43)..(43): Xaa is any aa, unknown, or other
  misc_feature (84)..(84): Xaa is any aa, unknown, or other
  misc_feature (121)..(121): Xaa is any aa, unknown, or other
HAAAPRNHRRAQPHKRARQEREREREAGSKTMEGKEEDVRLGXNKFSEKAGRLELELQRFQHALLRHEEERAARRPKAAASTAXQVQRRRGVHLVEYLYGRRRDNRRPKQKARGPSCCMRXKAIDD

SEQ ID NO: 9068 - DNA, 133 bp, Zea mays
  misc_feature: Ceres CLONE 377671-F
acacgcacaccgcgacccagtccagagccagtacgtgcgamggcacgcacgctgctggtccgcgtacssaggacgacggtcaggtcggccggtgcttttcagtttggaataatgacggcgacgacgacgacag

SEQ ID NO: 9069 - DNA, 136 bp, Zea mays
  misc_feature: Ceres CLONE 377673-F
  misc_feature (67)..(67): n is a, c, t, g, unknown, or other
  misc_feature (70)..(70): n is a, c, t, g, unknown, or other
acacgcacaccgcgacccagtccagagccagtacgtgcgamgcacgcacgctgctggtccgcgtacnagnacgacggtcaggtcggccggtgcttttcagtttggaataatgacggcgacgacgacgacagccgcc

SEQ ID NO: 9070 - DNA, 834 bp, Zea mays
  misc_feature: Ceres CLONE 377679-R
tttggggtagtttaatataccttcaagtggatttcatacatagagacgaaaggactacatggcagagtgatctaacaatcaatctaaaccagctggtaactaacaatgatagagggactgacaaacactgccagcataatctatcagtcgctgcctccattttccacaaaaagaagcttatccagtcctatggatctcttgccatatgtcatccttgcaagcggataacactagtccttggcatggtctagtgcgggtttcttccgctgttgtgcatgccggttcacgaactccgcgacgtcacccacaaacttcttgctgtccgcgaggtcgtccaacacgtagaaggcgtggatggcgtccgggtactccgccacggtgacctcctcggagcacacggcgcggagcgcatccgcgtacgccctctgcctgtcctgatgcacgtcccacccgtcgacgcacaccagcgtgggcgggaacgcccgccaccggtccgcgcccgcgcccgcgtcgcgcctgatcgcggcgggcacgttggcggcctcgtggtcccccagaggcgcccggtggcaagaacccgccgcaaaaccacgccagcatctcggggctcccgaacgggggcgtcgccggaaccgcattctcccaacccctttgggccccttcccccctgaaaaaaaggcctccccagtcttagaagccccgctcaccgtctttccaggggggaaaacctgtaagcccccccctcgccccgtgtcctgggggaagggtgcccccccccggtaaggggtctgacactaaaccctattacttttttttatgggagagctccctggg

SEQ ID NO: 9071 - DNA, 263 bp, Zea mays
  misc_feature: Ceres CLONE 377682-F
  misc_feature (174)..(174): n is a, c, t, g, unknown, or other
  misc_feature (175)..(175): n is a, c, t, g, unknown, or other
  misc_feature (177)..(177): n is a, c, t, g, unknown, or other
agaaacaaagaaagaaaaaatcgagaggacgccagggccgattctctgcgtgacttggggcgtcgtcgcgagttttctccggccgagggcggcgcgaccggacaaccagcgtgasscgaccggcgacatgactcgcggcaaccagcgtgaccgcgaccgtgagckcgcggcggnnanagcccaacgccaagaactcccaggacgggctcaccccggagcagcgccgcgagagggacaagaaagctctggagggagaaggcggc

SEQ ID NO: 9072 - DNA, 325 bp, Zea mays
  misc_feature: Ceres CLONE 377689-F
  misc_feature: Encodes the peptide sequence at SEQ ID NO. 9073
ccctttcccggcgtgcggtccggcgttggagatgcgggggctgctcgcggacggcgggatggcgctggcgatggcgccggagttaacgagtcgtcgggcggtgctgcgttgtcgcagggtctgttatggtgggcgtcggagtgccacggggtgttgtacagccttgcggttgatgctgccgtcgctggccttcgtgggattcctagcatggcaggcgcggcggacttccgtagcttcagctacggccgttctcacgtcgtcgtcgtcgcgtactacgsctcctctgggtcgtcgccgtactcaacctcctctggtgcttcctgca

SEQ ID NO: 9073 - protein, 108 aa, Zea mays
  misc_feature: Ceres CLONE 377689-F
  misc_feature (93)..(93): Xaa is any aa, unknown, or other
PFPGVRSGVGDAGAARGRRDGAGDGAGVNESSGGAALSQGLLWWASECHGVLYSLAVDAAVAGLRGIPSMAGAADFRSFSYGRSHVVVVAYYXSSGSSPYSTSSGASC

SEQ ID NO: 9074 - DNA, 209 bp, Zea mays
  misc_feature: Ceres CLONE 377707-F
agacgcacgagcgcgaacacgaacacgaacacgaacaccataacgcggcggccatggtgggcggcggcggcggcggcgacccaaggccggagacgagcccttctccgacggaacgccacggagtcggacaccgacgatgtctcctccgcagggattagtgctcgccgccccggsccaccaccaacccgatcctgactcgcctcgcggtg

SEQ ID NO: 9075 - DNA, 383 bp, Zea mays
  misc_feature: Ceres CLONE 377740-F
  misc_feature (44)..(44): n is a, c, t, g, unknown, or other
atcgtccatccgtatttccgtcacaactcacaacccgagccbsnmcaaacccgaagcagcaggagctcccctgaccttgctccgcctccgatcaaggaaaaggaagatgagctactacggccagcagccccccgtmggcgtcccgcgcagcaaggctacccggggaaggacggctacccgccagcggggtaccscgggccggctaccccccgccggcgcagggctacccgcagcagggttacccacagcagggctacccgccgcagtacgcgcmsscgcctccacagcagcagcagagcagcgggccttcctttcatggaaggatgcttggctgccctctgctgctggctgcctcctggacgcctgctttcttgacgaatcca

SEQ ID NO: 9076 - DNA, 131 bp, Zea mays
  misc_feature: Ceres CLONE 377757-F
gagcgggacggagcagctagcgctagggataacgcacacccaccaccatggcgacgccggagagcagccggcggaggtcgtgtccgtcgagatgcccgcacccgacggtaccaagaagtttactcccttga

SEQ ID NO: 9077 - DNA, 198 bp, Zea mays
  misc_feature: Ceres CLONE 377770-F
  misc_feature: Encodes the peptide sequence at SEQ ID NO. 9078
cacacagcaagccagcagagcagaaagcagccgcagccccagcccccacaagacgaggcaacaatggcgctagaagcagccaccgccccccgcgcactcctcgccgcgtgcctcgtctgcgtgtactgattttgttgcgcgtcttgtgctgatgttttggatggttgtggtcttgttgagaaaaaaaaaaaaaaaaaa

SEQ ID NO: 9078 - protein, 49 aa, Zea mays
  misc_feature: Ceres CLONE 377770-F
HSKPAEQKAAAAPAPTRRGNNGARSSHRPPRTPRRVPRLRVLILLRVLC

SEQ ID NO: 9079 - DNA, 365 bp, Zea mays
  misc_feature: Ceres CLONE 377841-F
  misc_feature: Encodes the peptide sequence at SEQ ID NO. 9080
  misc_feature (221)..(221): n is a, c, t, g, unknown, or other
  misc_feature (223)..(223): n is a, c, t, g, unknown, or other
accacactcgcattgcattgcattgcattccttcagttcagtagtgtgctctgacagtgagatggcgagcgtaaaggttttcgggtcacccacctcggcggaggtcgcccgcgtgctcatgtgcctcttcgagaaggaggtggagttccagctgatccgcgtcgacgcctaccgcggcaccaagcgcatgccccagtacctcaagctgcagccgcaassrngngcgctcaccttcgaggacgagagcctcaccctctccgactccagggggatcctccgccacatctcccacaagtacgcgamaggtgcaacccgtacctgattggcacgggcgcgctggaacgggcgtccatcgagcagtggct

SEQ ID NO: 9080 - protein, 86 aa, Zea mays
  misc_feature: Ceres CLONE 377841-F
  misc_feature (2)..(77): Pfam Name: GST_N Pfam Description: Glutathione S-transferase, N-terminal domain
  misc_feature: SWISSPROT Homolog: EC 2.5.1.18 Glutathione transferase
  misc_feature (53)..(53): Xaa is any aa, unknown, or other
  misc_feature (54)..(54): Xaa is any aa, unknown, or other
  misc_feature (81)..(81): Xaa is any aa, unknown, or other
MASVKVFGSPTSAEVARVLMCLFEKEVEFQLIRVDAYRGTKRMPQYLKLQPQXXALTFEDESLTLSDSRGILRHISHKYAXGATRT

SEQ ID NO: 9081 - DNA, 217 bp, Zea mays
  misc_feature: Ceres CLONE 377874-F
  misc_feature (164)..(164): n is a, c, t, g, unknown, or other
atcaaacaagagaaccaaaggaaacagagcaagagcatcgctctctaagcaaaacgcgcarcgccggccggccacttcgcacgtacgtaggacgcgcacgcaccggtgcatatatggggctcctggaccagctgtgggacgacacggtggccgggccgcgccgnacttccgcctcggcaagctccgcaagtacgcctccttctcccctttcgtcgtc

SEQ ID NO: 9082 - DNA, 97 bp, Zea mays
  misc_feature: Ceres CLONE 377890-F
agccagtgcgagtggagtgagcggcccggacgagcggaggaggaagacaggatggctgccggacgagcggttgcktggccatggtggcggcggcggc

SEQ ID NO: 9083 - DNA, 478 bp, Zea mays
  misc_feature: Ceres CLONE 377895-F
  misc_feature: Translation starting site: 93
  misc_feature (229)..(229): n is a, c, t, g, unknown, or other
atttcatttaccacaccctgctctcgctcttgttgtgacggtcgattcgcttgtacaaggtagcaaccttgagatccagccaagatccagccatgagggagattctccacatccagggtggacagtgcggcaaccagatcggttccaagttctgggaggtcgtctgcgacgagcatggtatcgaccccaccggacgctatgtcggcacctccgacctccagctcgagcncgtcaatgtctactacaacgaggcctcatgcggccgcttcgtgccgcgcgctgtgctcatggacctcgagcccggcaccatggacagcgtcgcaccgggccgtacggacagatcttccggcccgacaacttcgtcttcggccagtctggtgcagggaacaactgggccaagggcattacacagagggcgctgagctcatcgactctgtgcttgacgtcgtgaggaaagaggcggagaactgcgactgcc

SEQ ID NO: 9084 - DNA, 507 bp, Zea mays
  misc_feature: Ceres CLONE 377909-F
  misc_feature: Encodes the peptide sequence at SEQ ID NO. 9085
aacctaacccactcagccaaagatccccacaggtgtcaggtctcatccggagtcgtcgccaagaaccacagccaccgcgatggcgcagatcatcgatggcaaggccatcgccgccgacgtccgccgcgaggtcgccgccgatgtggccgcgctctcgtcagcccacggactcgtgccggggctggccgtggtcatcgtggggagcaggaaggactcgcagacgtacgtgaacatgaagcgcaaggcgtgcgccgaggtcggcatctgctccatcgacgtcgacctcccggaggacatctccgagaccgcgctcgtcgccgaggttcatcgcctcaacgctgaccccgcagtgcacgggatccttgtccagcttccacttcctaagcatatcaacgaagagaagatactgagcgagatttccatcgagaaagatgtggatggcttccatcctctcaacattggcaagcttgcaatgaaaggcagagagccactgttcgtaccatgtac

SEQ ID NO: 9085 - protein, 142 aa, Zea mays
  misc_feature: Ceres CLONE 377909-F
  misc_feature (3)..(120): Pfam Name: THF_DHG_CYH Pfam Description: Tetrahydrofolate dehydrogenase/cyclohydrolase, catalytic domain
MAQIIDGKAIAADVRREVAADVAALSSAHGLVPGLAVVIVGSRKDSQTYVNMKRKACAEVGICSIDVDLPEDISETALVAEVHRLNADPAVHGILVQLPLPKHINEEKILSEISIEKDVDGFHPLNIGKLAMKGREPLFVPC

SEQ ID NO: 9086 - DNA, 137 bp, Zea mays
  misc_feature: Ceres CLONE 377919-F
  misc_feature (97)..(97): n is a, c, t, g, unknown, or other
agacgcacgagcgcgaacacgaacacgaacacgaacaccataacgcggcggccatggtgggcggcggcggcggcggcgacccaaggccggagacgangcccttctccgacggaacgccacggagtcggacaccgacg

SEQ ID NO: 9087 - DNA, 482 bp, Zea mays
  misc_feature: Ceres CLONE 377944-F
  misc_feature: Translation starting site: 158
  misc_feature: Pfam Name: DUF516 Pfam Description: Protein of unknown function (DUF516)
  misc_feature (271)..(271): n is a, c, t, g, unknown, or other
  misc_feature (468)..(468): n is a, c, t, g, unknown, or other
agtccacgaaatcctcgtacttgtgagttgtgttggctggccctcgactagcgtgttgtagcgcactagcgcacagtaatcgagagtgctttcccaggtcgaggtggtgtaggtgtttggcggassagtcggggcgttggaatctgaggaggagaagatggtggtgctggtggtggccacgacgtcagacccggcgtccattgggcccgccgccgccttcctcgccatgcccggatggtcccccggcccgcccatcgccgaggcgatgagnagttttactaatgggaatgttcgattactgaagcatgagcgtacgatttgtcgcagaggatgatcttgaccagcgatggcaggaagccactggagagtctgtttctgaggtcatattcctcagcaaacacactgcagtctccaaacgtccagcactcacagtgcatccaattggtgtgccacatctgaaggaggatnaaaccccaccccaa

SEQ ID NO: 9088 - DNA, 378 bp, Zea mays
  misc_feature: Ceres CLONE 377954-F
  misc_feature: Encodes the peptide sequence at SEQ ID NO. 9089
  misc_feature (302)..(302): n is a, c, t, g, unknown, or other
acgccaaggagaaattgcaaacctgtcactagcgamgatacttcgtcgagcacactcttgcaattaatccaccgagttcggtttagtggtttactctcagacgtacgcataaatatagcatagcatcatcgacaacaatgtcgctcgtgagtcggcgcmsagcaacgtgttcgaccccttctccctcgacctctgggaccctttcaacatgttccgctccatcgtcccgtcggcggcctcctccggcggcggttccgagaccgccgctttccgccaacgcccgcgtcgactggaaggasacncgaggcgcacgtgttcaaggccgacctccccggcgtcaagaaggaggaggtcaaggtcgaggttggagggcggcaa

SEQ ID NO: 9089 - protein, 56 aa, Zea mays
  misc_feature: Ceres CLONE 377954-F
  misc_feature (31)..(31): Xaa is any aa, unknown, or other
  misc_feature (32)..(32): Xaa is any aa, unknown, or other
MFRSIVPSAASSGGGSETAAFRQRPRRLEGXXRRTCSRPTSPASRRRRSRSRLEGG

SEQ ID NO: 9090 - DNA, 198 bp, Zea mays
  misc_feature: Ceres CLONE 377973-F
  misc_feature: Encodes the peptide sequence at SEQ ID NO. 9091
cacacagcaagccagcagagcagraagcagccgcagccccagcccccacaagacgaggcaacaatggcgctagaagcagccaccgccccccgcgcactcctcgccgcgtgcctcgtctgcgtgtactgattttgttgcgcgtcttgtgctgatgttttggatggttgtggtcttgttgagaaaaaaaaaaaaaaaaaa

SEQ ID NO: 9091 - protein, 49 aa, Zea mays
  misc_feature: Ceres CLONE 377973-F
  misc_feature (8)..(8): Xaa is any aa, unknown, or other
HSKPAEQXAAAAPAPTRRGNNGARSSHRPPRTPRRVPRLRVLILLRVLC

SEQ ID NO: 9092 - DNA, 117 bp, Zea mays
  misc_feature: Ceres CLONE 378031-F
acacgcacaccgcgacccagtccagagccagtacgtgcgamgcacgcacgctgctggtccgcgtacssagaacgacggtcaggtcggccggtgcttttcagtttggaataatgacgg

SEQ ID NO: 9093 - DNA, 235 bp, Zea mays
  misc_feature: Ceres CLONE 378034-F
  misc_feature: Encodes the peptide sequence at SEQ ID NO. 9094
  misc_feature (176)..(176): n is a, c, t, g, unknown, or other
gttactaataagtcccgtccaaagctcgacaccgcaccgcatcgaccagctacacgaatcagacggcgccatggccggcacgtgcgcccacgtcgagttcctccgcgcgcagcggcttgggcgctggtgctggccgccgtgggcctgctcgtggccgtccagcagcmgctgcccgnttcgcgsstctgggtctacgccgcgttcctccgcccggggaagcccctgcgccgccgct

SEQ ID NO: 9094 - protein, 78 aa, Zea mays
  misc_feature: Ceres CLONE 378034-F
  misc_feature (56)..(56): Xaa is any aa, unknown, or other
  misc_feature (59)..(59): Xaa is any aa, unknown, or other
  misc_feature (62)..(62): Xaa is any aa, unknown, or other
VTNKSRPKLDTAPHRPATRIRRRHGRHVRPRRVPPRAAAWALVLAAVGLLVAVQQXLPXSRXWVYAAFLRPGKPLRRR

SEQ ID NO: 9095 - DNA, 330 bp, Zea mays
  misc_feature: Ceres CLONE 378036-F
  misc_feature: Encodes the peptide sequence at SEQ ID NO. 9096
  misc_feature (219)..(219): n is a, c, t, g, unknown, or other
atggccgggaaggcggcggccgcgacggcgsaggtgggcggaggggtaccgkggaaggagaagctggcaaagtacaagggtgagctcgggaagggggtgtggggatactgggagctcggcgcgtggaagccgctcggcatcagcgctcgcaagcssgcccgcctccgcaagrtgcttcctcgccggcgaggactggagctacgatcctccccgcggganatgcgtaccaagcgcaagggccacaagtgcgaccgcatctccgccgagaagcgagcaaatrctgttgagctgatgaagaagatgccccagatgctgctcgactacaagaaa

SEQ ID NO: 9096 - protein, 110 aa, Zea mays
  misc_feature: Ceres CLONE 378036-F
  misc_feature (11)..(11): Xaa is any aa, unknown, or other
  misc_feature (18)..(18): Xaa is any aa, unknown, or other
  misc_feature (52)..(52): Xaa is any aa, unknown, or other
  misc_feature (58)..(58): Xaa is any aa, unknown, or other
  misc_feature (73)..(73): Xaa is any aa, unknown, or other
  misc_feature (94)..(94): Xaa is any aa, unknown, or other
MAGKAAAATAXVGGGVPXKEKLAKYKGELGKGVWGYWELGAWKPLGISARKXARLRKXLPRRRGLELRSSPRXMRTKRKGHKCDRISAEKRANXVELMKKMPQMLLDYKK

SEQ ID NO: 9097 - DNA, 273 bp, Zea mays
  misc_feature: Ceres CLONE 378096-F
  misc_feature (186)..(186): n is a, c, t, g, unknown, or other
  misc_feature (187)..(187): n is a, c, t, g, unknown, or other
aaaagtctgaaattaagctggacaccgctgaccgctcccgcaccaaaccaaatcacctgttcccgcgacctcctccccggcgtacctccagtctccagagatccacacgaccacaccgacccaccaccatctgcatcggcavstggacgccgcgccacccaccataaccaagtcccygccgtcccnngttccaccagcggggcccacccccggtggttycctcccgctctcgtccatcgacaagaccgccgccgtccgtgtctccgtcgactt

SEQ ID NO: 9098 - DNA, 241 bp, Zea mays
  misc_feature: Ceres CLONE 378112-F
  misc_feature: Translation starting site: 89
  misc_feature (177)..(177): n is a, c, t, g, unknown, or other
acattccatcggtcgtgaaaagaaaaagggaaacaaaccaagctagagaaaagaagaaggtactacatactagctagctagcttagctatgggcaccatcgtcgacgctgacgtssgggttcgcggtgaagaggacgagcaggtcgctggtgccgcctgcktcggcgacscgcgggnakacgctgcggctgtcggtgatcgaccgcgtggcgggctgcgcacctggtgcggtcgctgcacg

SEQ ID NO: 9099 - DNA, 252 bp, Zea mays
  misc_feature: Ceres CLONE 378158-F
  misc_feature: Encodes the peptide sequence at SEQ ID NO. 9100
  misc_feature (118)..(118): n is a, c, t, g, unknown, or other
gcaaaccctagtgcttcccaccgatccatttcagccgccgccgcgcgtacgaagcaggagcagcaaggatgccggctggccacgggctgcgctcgcggacgsscgacctgttcgcgcnccctttccgcaagaagggctacatcccgctcaccacctacctccgcacctacaagatcggcgactacgtcgacgtccaaggtgaacggcgccgtccacaaggvggatgccgcacaagttctaccacggccgcac

SEQ ID NO: 9100 - protein, 61 aa, Zea mays
  misc_feature: Ceres CLONE 378158-F
  misc_feature (12)..(12): Xaa is any aa, unknown, or other
  misc_feature (17)..(17): Xaa is any aa, unknown, or other
MPAGHGLRSRTXDLFAXPFRKKGYIPLTTYLRTYKIGDYVDVQGERRRPQGGCRTSSTTAA

SEQ ID NO: 9101 - DNA, 363 bp, Zea mays
  misc_feature: Ceres CLONE 378173-F
  misc_feature: Encodes the peptide sequence at SEQ ID NO. 9102
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
gakggttctgttgtctctttcgcttgctccgcgccggcatccnnnccccttcgccgccacagcgattcttgttctcaggtctgckgcggcgataaccccctccactccccaccctgtcacccccacaaaataagttctgcggcggcgatggcgctctcctcctcccggccgaagcacctcctgcgccccctcctgcggggtttccacgcctcagcgcgggccctggcgcgggtggagccgcacgagttctccaagcccagcgagtacctgggcagctgggagcccgcgggtactctgggaagkcgtgggcgcggctggaccggctgcgcaaggggtacgcgagcgatgtgcgggactgcggcg

SEQ ID NO: 9102 - protein, 72 aa, Zea mays
  misc_feature: Ceres CLONE 378173-F
  misc_feature (52)..(52): Xaa is any aa, unknown, or other
MALSSSRPKHLLRPLLRGFHASARALARVEPHEFSKPSEYLGSWEPAGTLGXRGRGWTGCARGTRAMCGTAA

SEQ ID NO: 9103 - DNA, 485 bp, Zea mays
  misc_feature: Ceres CLONE 378204-F
  misc_feature: Encodes the peptide sequence at SEQ ID NO. 9104
  misc_feature (74)..(74): n is a, c, t, g, unknown, or other
atttttgaattttctattccgtattgaaggcgtcgatggccttgtccgccctaatcagcaccctcctcgccgcngccatctggtgcgccgcttacctcgccgctgccatctcctccgccttctgattcccactccccaaccctaacctcccccctgtagcacaccccacctctagctttgtaggtcctactatacttgcaacctctcccgctgactcgcttcgatctacccgccctcgcgtcaccatggggtacgcgcasgtcgtcatcggccccgctgggagcggcaagtcaacttattgctccagtttatacgaccattgccagaccgtgggaaggacaattcatattgtcaatcttgatccagctgctgagcacttcgactatcctgtagatatggatattagagagctgatttcattggatgatgttatggaggagattgggttggggccaaatggcggtctcatctactgcatggagcac

SEQ ID NO: 9104 - protein, 80 aa, Zea mays
  misc_feature: Ceres CLONE 378204-F
  misc_feature (7)..(80): Pfam Name: ATP_bind_1 Pfam Description: Conserved hypothetical ATP binding protein
  misc_feature (5)..(5): Xaa is any aa, unknown, or other
MGYAXVVIGPAGSGKSTYCSSLYDHCQTVGRTIHIVNLDPAAEHFDYPVDMDIRELISLDDVMEEIGLGPNGGLIYCMEH

SEQ ID NO: 9105 - DNA, 457 bp, Zea mays
  misc_feature: Ceres CLONE 378240-F
  misc_feature: Encodes the peptide sequence at SEQ ID NO. 9106
atccagtgttctgtcctagcgccgccgccgccccagctcgccttgcgtgactgagagctcgtcggcttccgtccacgcgtgaagsagagcatggacacccaggtgaagcttgctgttgtggtgaaggtgatgggcaggaccggctccaggggtcaggtgacccaggtcagagtgaagtttttggatgaccagaaccggctcatcatgaggaatgtcaaggggcccgttcgcgagggtgacatcctcaccctgctcgagtccgagagggaggccaggaggctgcgctgaagccctagcgttcttggtgggctcttgtatggtctttggtgtcttggaatttgtgctatgtttgaacttctgtgaccctgttttaagagtactgaagagcttgtagttctgccaggaacatggttattagttgaagcaagaatgttgatggtcacaaaaaaaaaaaaaa

SEQ ID NO: 9106 - protein, 65 aa, Zea mays; identical to SEQ ID NO: 5504
  misc_feature: Ceres CLONE 378240-F
  misc_feature (1)..(65): Pfam Name: Ribosomal_S28e Pfam Description: Ribosomal protein S28e

SEQ ID NO: 9107 - DNA, 2604 bp, Zea mays
  misc_feature: Ceres CLONE 378258
  misc_feature: Encodes the peptide sequence at SEQ ID NO. 9108
gatagagaaatgagcttcgctgttcgagaaaacagcagagcccggccgaattcgttgggcagcctgcggagatgcagtagaggccgccaggcgcagatggaatgagcgaccgggctctgctccgccgctagcctgccgccgcaccgcgccgtcgatcgccgcgccatgaacggtccccgcggctaccccctttctccaccggcaccttacccccgtatggcgtgatccaatgatagcaccaagagcgcaccttcccctctccctgacggcgtcgtcctccccgcacggcggcgcgcgcacccgcaccaagaagaggaagaaaccatgtcccccaacctggacagcgccatcaagatccaggtgccggcgctgctcctgaggcgtctcttcggcgcgtcccggcgggacgaggccaagcagctccagcggaccccggcgccggtggggaggcggcgggtgtttgtgcagacggagaccggctgcgtgctcggcatggacctggaccgcggggacaacgcgcacaccgtcaagcgccggctgcagctcgcgctcaacatgcccaccggcgggacctcgctcaccttcggcgatcgcctcctggagaacgacctgtccttcatacgcccggactcgccgctgctgctcacccggaacagcatcaaccggagctgctccaccccgtgcctctgccccgtctccaaggacttcgagcacaaggactgcagcggactggttgagatgctcggctgttccagcagctgtgcccgggtgaagcgcctcgtggacgacgtggtgactgccatcaggagcggcgtggatccggtccccattagcagcggccttggtggctcgtactacttcaggaacgtcttgggcgacagggttgctattgtgaagccgacggacgaggagccctttgcgccaaacaatcccaaggggttcgtcgggagggcgctcggtcagccgggcctcaagagatctgtgcgagtgggagagacggggtttagggaggttgcggcattcctgttggaccatgacaacttcgccaacgttcctgccacggctctggtgaagataacacactccattttcaacataaactgcccggtaaatggaggaaacctggcaccggctcatgaccagcaacagcaagttaacagcaagattgcttcgttccagcagttcatagcccatgacttcgacgccagcgaccatggcacgtcaagcttccctgtcgctgctgttcataggatcggcatactagatatccggattttcaacactgacaggcacgccggcaatgtgctggtgaggaagcttaacggtggcacaggccgctttggttgccagacagagctgttcccaattgatcatggcatgtgcttgccggagaacttggaggacccttacttcgagtggatccattgggctcaggcttctattccgttctctgaggaagagctcgagtacatcagaaatcttgatccaaggaaagatgtgcagatgctgcgccgggaacttccgatgatacgtgaggcctgcctacatgtactggccctgtgcacaatcttccttaaggaggctgcagctttcggactctgcttggccgagataggcgagatgatgaccagggagttcagagggatggaggaggaaccaagccagctggaggttatgtgtatggaggccaggaagagagtagcagagtgggagcccttctctgccacggctgaacatggagaagataccgatttccagttctcggtggatatgctaggagaatacagtgatgtagtgcgatcaccgaggttcaatggctcaggttccaaggtgtccagtttcagaagccctttgtctaagctcgtcgagagtgtcgacgagggcagtgatggccatgaagatcaaaacgagtctgatcgagtcttgtatgctggatggaatacatccagcgttcctagcaaagctatgggccatagtggcaatgcctcaaaaagtgcaatgaacaggagtgccgatgaacaacttccatcaagtatgtgttttgtcaggctgtcggatatgagtgcagatgagtgggatgtattcctcgaaaaattccaggagctgctgaaagaggcactgcacgagagcgcaagggcagcagtaggtcaaaggatgaagcagcggctgggcacttcatgcaagttttgagcagggcaatagcgcatcagagaagaaaaaaatgcagtgctacttgtactgcttgcttatggagtgagtacaggatgaagatatcatcgtatgtggcaccttcaaccttgtgcaacgatctaggttgcagcagccatgtccagcaggtagataggaccacaagcatatgtagtgacggtgtggagaactgctacgcgtgtttattagctatatgtttacgaaggggaatgcttaataataaatgtttgtcagcctgtgtatattggcttgatgttagatactccagctttagcatgcaatttcttagtcgctgaaaattctttgtagcttgtgatgtgacctgtgagcagtgtaaacgttgcacctttgatggaaaaataatgcttacctgttgttgtaaaaaaaaaaaaaaaa

SEQ ID NO: 9108 - protein, 621 aa, Zea mays
  misc_feature: Ceres CLONE 378258
  misc_feature (172)..(437): Pfam Name: PI3_PI4_kinase Pfam Description: Phosphatidylinositol 3- and 4-kinase
  misc_feature: SWISSPROT Homolog: EC 2.7.1.67 1-phosphatidylinositol 4-kinase
  misc_feature: Functional homolog of the protein sequence given in SEQ ID NO 96868
  misc_feature: Useful for making plants with altered protein content
MSPNLDSAIKIQVPALLLRRLFGASRRDEAKQLQRTPAPVGRRRVFVQTETGCVLGMDLDRGDNAHTVKRRLQLALNMPTGGTSLTFGDRLLENDLSFIRPDSPLLLTRNSINRSCSTPCLCPVSKDFEHKDCSGLVEMLGCSSSCARVKRLVDDVVTAIRSGVDPVPISSGLGGSYYFRNVLGDRVAIVKPTDEEPFAPNNPKGFVGRALGQPGLKRSVRVGETGFREVAAFLLDHDNFANVPATALVKITHSIFNINCPVNGGNLAPAHDQQQQVNSKIASFQQFIAHDFDASDHGTSSFPVAAVHRIGILDIRIFNTDRHAGNVLVRKLNGGTGRFGCQTELFPIDHGMCLPENLEDPYFEWIHWAQASIPFSEEELEYIRNLDPRKDVQMLRRELPMIREACLHVLALCTIFLKEAAAFGLCLAEIGEMMTREFRGMEEEPSQLEVMCMEARKRVAEWEPFSATAEHGEDTDFQFSVDMLGEYSDVVRSPRFNGSGSKVSSFRSPLSKLVESVDEGSDGHEDQNESDRVLYAGWNTSSVPSKAMGHSGNASKSAMNRSADEQLPSSMCFVRLSDMSADEWDVFLEKFQELLKEALHESARAAVGQRMKQRLGTSCKF

SEQ ID NO: 9109 - DNA, 490 bp, Zea mays
  misc_feature: Ceres CLONE 378261-F
  misc_feature: Encodes the peptide sequence at SEQ ID NO. 9110
attcgtcttgctccagccgccgtcggatcggatccgatccaaagcaagcagcagcagccggctccgctcccgcagcagccacaccccgtccgtcaccagaggaagaggaagaggaggatgtcggggtcgaaggtgtacacccttgaggaggtggccaagcacaacaccaaggatgactgctggctcgtcatcggcggcaaggtgtacaatgtgaccaagtttctggaggaccaccctggaggtgatgatgtcctgctgtcttccactgccaaggatgctaccgatgatttcgaagatgtggggcacagcaccaccgcccgtgcaatgatggacgagtacctcgtcggtgagattgatgcggccacgatacccagtaaggtgaagtacacgccccccaagcagccgcactacaaccaggataagaccccggagttcgtcatcaagatcctccagtttttggtcccctggcaattactggggcctggctgtt

SEQ ID NO: 9110 - protein, 124 aa, Zea mays
  misc_feature: Ceres CLONE 378261-F
  misc_feature (6)..(80): Pfam Name: Cyt-b5 Pfam Description: Cytochrome b5-like Heme/Steroid binding domain
  misc_feature: SWISSPROT Homolog: EC 1.7.1.1 Nitrate reductase (NADH)
MSGSKVYTLEEVAKHNTKDDCWLVIGGKVYNVTKFLEDHPGGDDVLLSSTAKDATDDFEDVGHSTTARAMMDEYLVGEIDAATIPSKVKYTPPKQPHYNQDKTPEFVIKILQFLVPWQLLGPGC

SEQ ID NO: 9111 - DNA, 242 bp, Zea mays
  misc_feature: Ceres CLONE 378263-F
  misc_feature: Encodes the peptide sequence at SEQ ID NO. 9112
  misc_feature (163)..(163): n is a, c, t, g, unknown, or other
  misc_feature (165)..(165): n is a, c, t, g, unknown, or other
ataaaatcgagaggacgccagggccgattctctgcgtgacttggggcgtcgtcgcgagttttctccggccgagggcggcgcgaccggacaaccagcgtgasscgaccggcgacatgactcgcggcaaccagcgtgaccgcgaccgtgagcgcgcggcggcssnanagcccaacgccaagaactcccaggacgggctcaccccggagcagcgccgcgagagggacaagaaagctctggaggag

SEQ ID NO: 9112 - protein, 43 aa, Zea mays
  misc_feature: Ceres CLONE 378263-F
  misc_feature (1)..(43): Pfam Name: 4F5 Pfam Description: 4F5 protein family
  misc_feature (17)..(17): Xaa is any aa, unknown, or other
  misc_feature (18)..(18): Xaa is any aa, unknown, or other
MTRGNQRDRDRERAAAXXPNAKNSQDGLTPEQRRERDKKALEE

SEQ ID NO: 9113 - DNA, 423 bp, Zea mays
  misc_feature: Ceres CLONE 378267-F
  misc_feature: Translation starting site: 58
  misc_feature: SWISSPROT Homolog: EC 2.7.11.7 [Myosin heavy-chain] kinase
  misc_feature (245)..(245): n is a, c, t, g, unknown, or other
  misc_feature (254)..(254): n is a, c, t, g, unknown, or other
atcctacgcccgccgccgccacagcaacccttgcagccccaatcccccacggcgaccatggccggcgcgcaggagtccctctccctggtgggcacgatgcgcggccataacggcgaggtgacggcgatcgcgaccccgatcgacaactcgcctttcatcgtctcctcctcvcgggacaagtccgtgctggtgtgggacctgaccaacccggtccacdccaccccggaatccggcgtcaccgcssnctacggstnccccttccgccgcctcaccggccactcccacttcgtccaggacgtcgtcttagttccgacggccagttcgcactctctggctcctgggacggcgagctccgcctttgggacctctccaccggcctcaccacccgccgcttcgtcggccacgagaaggacgtcatctccg

SEQ ID NO: 9114 - DNA, 240 bp, Zea mays
  misc_feature: Ceres CLONE 378270-F
  misc_feature: Encodes the peptide sequence at SEQ ID NO. 9115
  misc_feature (136)..(136): n is a, c, t, g, unknown, or other
aaaccccaacaaaccaaagcaaaccaaactccatctccatctgctcgctcgctcacgcagcagccatgaccatgacgacaccaccgccaaggcagcagcatggcctggccgctgttgcgtccgaggtgcgcgcgcncatcgcgctccctctcatcggcatgaacctcacctggttcgccaagcaggccgtgaccacgytttcctcggccgcctcgggacctggagctggccgccggcacg

SEQ ID NO: 9115 - protein, 58 aa, Zea mays
  misc_feature: Ceres CLONE 378270-F
  misc_feature (24)..(24): Xaa is any aa, unknown, or other
  misc_feature (45)..(45): Xaa is any aa, unknown, or other
MTMTTPPPRQQHGLAAVASEVRAXIALPLIGMNLTWFAKQAVTTXSSAASGPGAGRRH

SEQ ID NO: 9116 - DNA, 429 bp, Zea mays
  misc_feature: Ceres CLONE 378282-F
  misc_feature: Encodes the peptide sequence at SEQ ID NO. 9117
  misc_feature (51)..(51): n is a, c, t, g, unknown, or other
  misc_feature (278)..(278): n is a, c, t, g, unknown, or other
  misc_feature (392)..(392): n is a, c, t, g, unknown, or other
atcctctccgtgtaggccgcgggattccgtgtccctctccaatccggcgtnrtcgtcgccggatacaggatccggtccccgcgatggagccctcaccaacctcctcctcgccggctgtggcgcgccggttgtcgccggagtaaggagggtgccgaagcgggcgctggaggagttgttggagcaggtccagcgggctgttgagatgctgcgcgatgccgacgctgatctcgccatctctctctcggaggagaccgcagcagcctcgccggasscgaggnaccgcaagacgatgttggtgtcgatggagatggcatggcgacgtcgtcggtttgcgagtkactccgattacgagacgacgcaatgtgtgaccttctcaaatctaagggttggancactcgagttcctttcaaaagctcaatggtattcaga

SEQ ID NO: 9117 - protein, 142 aa, Zea mays
  misc_feature: Ceres CLONE 378282-F
  misc_feature (17)..(17): Xaa is any aa, unknown, or other
  misc_feature (90)..(90): Xaa is any aa, unknown, or other
  misc_feature (91)..(91): Xaa is any aa, unknown, or other
  misc_feature (93)..(93): Xaa is any aa, unknown, or other
  misc_feature (113)..(113): Xaa is any aa, unknown, or other
  misc_feature (131)..(131): Xaa is any aa, unknown, or other
SSPCRPRDSVSLSNPAXSSPDTGSGPRDGALTNLLLAGCGAPVVAGVRRVPKRALEELLEQVQRAVEMLRDADADLAISLSEETAAASPXXRXRKTMLVSMEMAWRRRRFASXSDYETTQCVTFSNLRVGXLEFLSKAQWYS

SEQ ID NO: 9118 - DNA, 264 bp, Zea mays
  misc_feature: Ceres CLONE 378300-F
  misc_feature: Encodes the peptide sequence at SEQ ID NO. 9119
  misc_feature (43)..(43): n is a, c, t, g, unknown, or other
  misc_feature (44)..(44): n is a, c, t, g, unknown, or other
  misc_feature (142)..(142): n is a, c, t, g, unknown, or other
  misc_feature (152)..(152): n is a, c, t, g, unknown, or other
atcctcatcgtcacaacgcgtcctcgaataaaaatccagacgnnacccaaaatccccaccgaacgcaacctaaaatctccccatccctcctcgatccggccccgcggagaagagccatggccgattccgcaaccarcgayrnccccctggtngccagcaaccagcccacggaggaggaggtgacggtggagagggccgcggcgacggaggamaggaggaggagaggctgcggtacctcgagttcgtgcagcaggckgcggcgca

SEQ ID NO: 9119 - protein, 49 aa, Zea mays
  misc_feature: Ceres CLONE 378300-F
  misc_feature (7)..(7): Xaa is any aa, unknown, or other
  misc_feature (9)..(9): Xaa is any aa, unknown, or other
  misc_feature (32)..(32): Xaa is any aa, unknown, or other
  misc_feature (47)..(47): Xaa is any aa, unknown, or other
MADSATXDXPLVASNQPTEEEVTVERAAATEXRRRRGCGTSSSCSRXRR

SEQ ID NO: 9120 - DNA, 734 bp, Zea mays
  misc_feature: Ceres CLONE 378310
  misc_feature: Encodes the peptide sequence at SEQ ID NO. 9121
gttcgcgccttttccattttcaccccccgattccgatcgcttttcaccgccgcctctgttccttcgctagtcgacaggccccgcttccgctctcctcttccaccggccaccgccgcgcgccgagaagatggggaagcggtggatcccactggaggccaacccggatgtcatgaaccagttcatatggggtctgggagtctccgagagggctgtgcagttctgcgacgtctacggcctggaggagtggagcatccagatcgaggaggccaacagcgccaagaagctcgtggtgattgacttcactgcaacatggtgtcctccgtgccgcgccatggctccaatttttgctgatatggccaagaagtccccaaatgttgttttcctgaaagttgatgtcgatgaaatgaagaccattgctgagcaattcagcgtagaggccatgccaacattcctgttcatgagggagggcgacgtcaaggacagggtcgttggcgcagcaaaggaagagctagcaaggaagcttgaactacacatggcctcgtagatcagtgatgccgtaatgtagtattcgcctaaataagaggacgcctcgcctcaactctgagaaaactagtgcttctgtgatggtaattcgtatgagagagtgccccctttggtggtacttcttcgtatgtagtattaactcctgtcttaatatgttgccctgcttgtgcttttcaaaaaaaaaaaaaaaa

SEQ ID NO: 9121 - protein, 138 aa, Zea mays
  misc_feature: Ceres CLONE 378310
  misc_feature (33)..(135): Pfam Name: Thioredoxin Pfam Description: Thioredoxin
  misc_feature (33)..(135): SWISSPROT Homolog: EC 3.5.1.52 Peptide-N(4)-(N-acetyl-beta-glucosaminyl)asparagine amidase
  misc_feature (2)..(44): SWISSPROT Homolog: EC 3.4.19.12 Ubiquitinyl hydrolase 1
MGKRWIPLEANPDVMNQFIWGLGVSERAVQFCDVYGLEEWSIQIEEANSAKKLVVIDFTATWCPPCRAMAPIFADMAKKSPNVVFLKVDVDEMKTIAEQFSVEAMPTFLFMREGDVKDRVVGAAKEELARKLELHMAS

SEQ ID NO: 9122 - DNA, 218 bp, Zea mays
  misc_feature: Ceres CLONE 378337-F
  misc_feature (114)..(114): n is a, c, t, g, unknown, or other
acagcatctcaagccaccatcgaccttcaagtctcgctacgtagcagtgcaataaaaaaagcagccgcaatggcgagcagcaccatggccctctcctccacggccttcgccggncaaggccggtgaacgtgccgtcgtcgtccgccttcggaggcccgcgtgacgatgcgcaagacggcggcgaaggccaagccagcgggtcgtccggggagcccgtg

SEQ ID NO: 9123 - DNA, 424 bp, Zea mays
  misc_feature: Ceres CLONE 378350-F
  misc_feature: Encodes the peptide sequence at SEQ ID NO. 9124
  misc_feature (316)..(316): n is a, c, t, g, unknown, or other
accaatggcattcttgcattgaaggaaccttccctccacctccaccgcccgagagcgagcggccggacggggttttggttgggcatggctgccccggcgatgctccaagtggtgatcctcgccgcggtcctccttctcccgttcctcagcgtgccgcgcgcctcggagaagagatagaggcggccgctgcatcgaccccgcgccacccccgcctgcctcccccggcaccgatcgggtttgatcgatggcgtcgaagaggatcctgaaggagttgaaggacctgcagaaggacccgcccacctcctgcagcgcagtncctgttggtgaggacatgttccattggcaagcgaccatcatggggccttcggacagcccatttgcaggtggggtattcttggtgaacattcacttcccacccggatta

SEQ ID NO: 9124 - protein, 60 aa, Zea mays
  misc_feature: Ceres CLONE 378350-F
  misc_feature: SWISSPROT Homolog: EC 6.3.2.19 Ubiquitin--protein ligase
MASKRILKELKDLQKDPPTSCSAVPVGEDMFHWQATIMGPSDSPFAGGVFLVNIHFPPGL

SEQ ID NO: 9125 - DNA, 309 bp, Zea mays
  misc_feature: Ceres CLONE 378357-F
  misc_feature: SWISSPROT Homolog: EC 3.1.3.5 5'-nucleotidase
  misc_feature (285)..(285): n is a, c, t, g, unknown, or other
aacgggaattcctcattcacatccctacgcacgaacggaaacgccccatgctgcgctcgcrtctcgcatggactccaccactgctgctgctaccgcggccgssctgssgccggcgcggtgctgctggtgacgaacgacgacggaatcgacgcgccggggctccgcttccttgtcgaccgtctcgtcgccgcaggcataccgcgtactcgtctgcgcgcccgacacagacaaatcgggtgkgagccactgcatcacatggcgccytgcaytccgctgtaaacgtgnttgatataatagggtgctacagca

SEQ ID NO: 9126 - DNA, 485 bp, Zea mays
  misc_feature: Ceres CLONE 378372-F
  misc_feature: Encodes the peptide sequence at SEQ ID NO. 9127
acggacgcttcgctctagtcggaaggtttcgaggaactcccgggctcgaggagatcgggacgatgatgggagggcgcgctctgctgctgctcctggtctcggcgctgctcgttcagatccgcgcctctgacccgctgctgtacgagccgtttgatgaggacttcgagggtagatggatcgtctccaagaaggatgaataccaaggtgtatggaagcatgccaagagtgatgggcatgaggactatggcctccttgttagtgacaaggcaaggaaatacgccataatcaaggagcttgatgagccagttaccttaaatgatgggacagtggtcctgcagtttgaagtgagacttcagaatggccttgaatgtggaggtgcctacattaagtacatccgccctcaggatgctggatgggatgccaaggagtttgataatgagactccatacactattatgtttggtccagataaatgtgggtcaacc

SEQ ID NO: 9127 - protein, 141 aa, Zea mays
  misc_feature: Ceres CLONE 378372-F
  misc_feature (24)..(141): Pfam Name: Calreticulin Pfam Description: Calreticulin family
MMGGRALLLLLVSALLVQIRASDPLLYEPFDEDFEGRWIVSKKDEYQGVWKHAKSDGHEDYGLLVSDKARKYAIIKELDEPVTLNDGTVVLQFEVRLQNGLECGGAYIKYIRPQDAGWDAKEFDNETPYTIMFGPDKCGST

SEQ ID NO: 9128 - DNA, 331 bp, Zea mays
  misc_feature: Ceres CLONE 378377-F
  misc_feature: Translation starting site: 58
  misc_feature (288)..(288): n is a, c, t, g, unknown, or other
  misc_feature (289)..(289): n is a, c, t, g, unknown, or other
  misc_feature (290)..(290): n is a, c, t, g, unknown, or other
  misc_feature (294)..(294): n is a, c, t, g, unknown, or other
gatcgcctcgctgtgttgcactgctaggtagccagctcgtttcctcccccaacccaaatgggcgactccaccgccaccaacccctcctcgccgaccgcagccatggatcccgactccgaggtcgtcttcgacttcccgccctacctctgccagtacaagagcggccgcatccaccgccccggcgcgcccbscaccgtcccagctggcacggacccagccaccggcgtcgtgtccaaggacatccgcgccggccccgcctccgcgcgagtctacctccctcccggcgcnnnaagnatcccggtgggtcgtctacttccacggcggcgggttc

SEQ ID NO: 9129 - DNA, 465 bp, Zea mays
  misc_feature: Ceres CLONE 378396-F
  misc_feature: Translation starting site: 191
  misc_feature: SWISSPROT Homolog: EC 3.4.25.1 Proteasome endopeptidase complex
  misc_feature (68)..(68): n is a, c, t, g, unknown, or other
  misc_feature (75)..(75): n is a, c, t, g, unknown, or other
  misc_feature (81)..(81): n is a, c, t, g, unknown, or other
gaatcctcccgagtcgcctccccctcaagttccacaaacgcaagccccaatctcgccgtcaccacccncaatccngcaaangcaaaccccatctcgccgccgccgccgccgccgccgcgatgtctcgccgctatgacagccgcactacgatcttctcgccggagggcgtctctaccaggtggagtacgcgatggaggcgatcggcaacgcgggttcagccctcgggatcctagcggccgacggcgtggtcctcgtcggcgagaagaaggtgacctccaagctcctccagacctcgcgctccgccgagaagatgtacaagatcgactcccacctggcgtgcgcgtggccgggatcatgtccgacgccaacatcctcatcaacaccgcccgcctccacgcccaacgctacggctctcctaccaggaacccatccccgtcgagcagctcgttcagtccctctgcgaca

SEQ ID NO: 9130 - DNA, 462 bp, Zea mays
  misc_feature: Ceres CLONE 378401-F
  misc_feature: Translation starting site: 132
  misc_feature: SWISSPROT Homolog: EC 2.5.1.67 Chrysanthemyl diphosphate synthase
aycctgctgtctccctccctccttccttccttccccgccactgcgcasscgagtgcggcgacassagtcacacactcacactccctcgaccgctctcggccccgtccgcgtcgccgcaggssagggaggcaatggcggcgggcgggaatggcgccggcggggacaccagggcggccttcgcgcggatctacaagacgctcaaggaggagctgctcaccgacccggccttcgagttcaccgaggagtcacgccagtgtattcgaccgcatggttgactacaatgtactcggaggcaagtgtaaccgtgggctcttctgtggtcgacagctacaagctgctcaagggcgctgatgctctgggcgaggaggaaacgttccttgcttgcaccctcgggctggtgcattgaatggctttcaggcttycttycttggtgcttgatgatatcatggatgactctcacac

SEQ ID NO: 9131 - DNA, 489 bp, Zea mays
  misc_feature: Ceres CLONE 378407-F
  misc_feature: Encodes the peptide sequence at SEQ ID NO. 9132
aaactcgcgacccagcgtccatacacacaccagcctttttgttctccccgcgagcgctctctttctctatcgactggcgacgactccgccaccgccgccgctctacgcgagacgcccaggtcttcgccaacgacgagcatccgggttagagaggaagaaattgcaaccgaaacaatggcggcagattccggcgctcgcagacaaccaagcttcaccaaggtcgaccagctgcgccctggaacccacggccacaacctcatcctcaaggttgttgactccaagatggtcgtccagagaggccgcgagggagggccccagggaagacagatgaggattgcggagtgcttggttggtgatgaaaccggcatcattgtcttcactgcaagaaacgatcaagtggatgtaattaggcctggaacaactgttgaactgaggaacgcaaagatcgacatgttcaagggttcgatgcggcttgcagtggacaaagtt

SEQ ID NO: 9132 - protein, 105 aa, Zea mays
  misc_feature: Ceres CLONE 378407-F
MAADSGARRQPSFTKVDQLRPGTHGHNLILKVVDSKMVVQRGREGGPQGRQMRIAECLVGDETGIIVFTARNDQVDVIRPGTTVELRNAKIDMFKGSMRLAVDKV

SEQ ID NO: 9133 - DNA, 239 bp, Zea mays
  misc_feature: Ceres CLONE 378419-F
  misc_feature: Encodes the peptide sequence at SEQ ID NO. 9134
actcgcccactctacaaacacgtgacacctcckcccaccctcgccccctccctaccggcaccgcccagatggcctgctcccacatcgccgccgcgggggtctcctcccccgccgcagcgcgctcgttccccggcgcattctcccgctgccgccttcgcgcgcctccggtcgacgcctcgtttcgcgagcgctggcttgtcggttaagggaaacggagcggcgttcccgttggtcgccgc

SEQ ID NO: 9134 - protein, 79 aa, Zea mays
  misc_feature: Ceres CLONE 378419-F
TRPLYKHVTPPPTLAPSLPAPPRWPAPTSPPRGSPPPPQRARSPAHSPAAAFARLRSTPRFASAGLSVKGNGAAFPLVA

SEQ ID NO: 9135 - DNA, 521 bp, Zea mays
  misc_feature: Ceres CLONE 378447-F
  misc_feature: Encodes the peptide sequence at SEQ ID NO. 9136
caccgcagccctagcgcgccgccaccttcaccttcccaggccgccgccgccgccgcctccattgctgctaaacccgcaaccatgggtcccgtgctgaagcgcccgaccccgggcacggtgcagtgcttcgggcgcaagaagacggccgtggsskggcctacacgaagccaggccgggggatgatcaaggtgaacggcgtcccgatcgagctgctccgtcccgagatgctgcggctcaaggccatggagcccgtgctgctggcggggcggtccaggttcaaggacatcgacatgcggatccgcgtgcgcggcggcgggaagacgtcgcagatctacgccatccgccaggccgtcgccaagggtctcgtggcctactaccagaagtacgtggacgaggcggcgaaaaaggagatcaaggacatcttcatgcgctacgagcssaccctcctcgtcgcckacccccgccgctgcgagcccaagaagytcggcggccgcggcgccggccaggttccagagtctacg

SEQ ID NO: 9136 - protein, 114 aa, Zea mays
  misc_feature: Ceres CLONE 378447-F
  misc_feature (1)..(111): Pfam Name: Ribosomal_S9 Pfam Description: Ribosomal protein S9/S16
  misc_feature (87)..(87): Xaa is any aa, unknown, or other
  misc_feature (93)..(93): Xaa is any aa, unknown, or other
  misc_feature (102)..(102): Xaa is any aa, unknown, or other
MIKVNGVPIELLRPEMLRLKAMEPVLLAGRSRFKDIDMRIRVRGGGKTSQIYAIRQAVAKGLVAYYQKYVDEAAKKEIKDIFMRYEXTLLVAXPRRCEPKKXGGRGAGQVPEST

SEQ ID NO: 9137 - DNA, 398 bp, Zea mays
  misc_feature: Ceres CLONE 378474-F
  misc_feature: Encodes the peptide sequence at SEQ ID NO. 9138
  misc_feature (279)..(279): n is a, c, t, g, unknown, or other
  misc_feature (334)..(334): n is a, c, t, g, unknown, or other
agttcgactcagctccgccgcgcgtgtcagccgatggaagagctgcgggccgccgtgacggcacacttggaccaggtwgcgggcctcgtgcaggcgctctcctccgagctccgccgcggcatargtcccgccgccgacaacctgcgcgccttcatccgcgccgttkactggacsgagcccatggctcatgtgcttgatggccttccatgtggttctgctgctcactgctgtdggttcwggaggaatgccmatttccagctattcttgttatttcttgcntattcaggaatgtatctagctgaaaagatgaacagatacctgggagagaactggnagarctttwccmgtaggaaatawtttgaacgttctggarttttatctctgtcgtctggtctggg

SEQ ID NO: 9138 - protein, 121 aa, Zea mays
  misc_feature: Ceres CLONE 378474-F
  misc_feature (31)..(31): Xaa is any aa, unknown, or other
  misc_feature (45)..(45): Xaa is any aa, unknown, or other
  misc_feature (67)..(67): Xaa is any aa, unknown, or other
  misc_feature (69)..(69): Xaa is any aa, unknown, or other
  misc_feature (73)..(73): Xaa is any aa, unknown, or other
  misc_feature (101)..(101): Xaa is any aa, unknown, or other
  misc_feature (102)..(102): Xaa is any aa, unknown, or other
  misc_feature (104)..(104): Xaa is any aa, unknown, or other
  misc_feature (105)..(105): Xaa is any aa, unknown, or other
  misc_feature (108)..(108): Xaa is any aa, unknown, or other
  misc_feature (114)..(114): Xaa is any aa, unknown, or other
MEELRAAVTAHLDQVAGLVQALSSELRRGIXPAADNLRAFIRAVXWTEPMAHVLDGLPCGSAAHCCXFXRNAXFQLFLLFLAYSGMYLAEKMNRYLGENWXXFXXRKXFERSGXLSLSSGL

SEQ ID NO: 9139 - DNA, 405 bp, Zea mays
  misc_feature: Ceres CLONE 378489-F
  misc_feature: Encodes the peptide sequence at SEQ ID NO. 9140
aagacgagatccccacaccaatagatctctttcgcgtcagtcaatgccgtccgccgacgccggagatgctgacgcgatgcccgcgccgccgccgcaaacaagggccgccatctcgcatgtcatcttcgacatggacggcctcctcctcgatacggaggggttctacacaacggtacaggagaagatcctgatgaggttcggcaaggtgttcgactggtccgtgaaggccaagatgatgggcaagaccacggccgagtccacgcgcatcttgtttgaggagttcggcctcgccggcctgctcaccccggagcagttcctggaggaacgcgaaaccatgctcaagaagctcttgcccacttgcgttgccatgccaggtgtgctacgtttgatcaatcttctccacac

SEQ ID NO: 9140 - protein, 120 aa, Zea mays
  misc_feature: Ceres CLONE 378489-F
MPSADAGDADAMPAPPPQTRAAISHVIFDMDGLLLDTEGFYTTVQEKILMRFGKVFDWSVKAKMMGKTTAESTRILFEEFGLAGLLTPEQFLEERETMLKKLLPTCVAMPGVLRLINLLH

SEQ ID NO: 9141 - DNA, 476 bp, Zea mays
  misc_feature: Ceres CLONE 378490-F
  misc_feature: Encodes the peptide sequence at SEQ ID NO. 9142
ctaataacatttcctactcctgccggatcagactagcgagccaagccaccgacggccgacgtcgagcctccgcggccgagcctccgcctagcaccaactccgtcgtcgatcgtcctatgcgaccacgcccccgtccgccttccgtctcctgcctccactgagtcgcgggcgcgmatcggggaacgccaaggctgagcttcgcccatacgcctaccgccctgttatgccccgaaccgccgtgctgaggtccgcccaggccgggccaggagcttctcccggcagacccacccccgcccaacggagctccatgcctccgcccagggccattgtccgagctacgccccacgctcctgtccagtgccctggccacttagatggttctgctcagtcatggtatttgtctggttcaacaacttcaacttcaaccaagggacgcatctatcacaagacgtatggttgccaaatgaatataaagt

SEQ ID NO: 9142 - protein, 28 aa, Zea mays
  misc_feature: Ceres CLONE 378490-F
MVFVWFNNFNFNQGTHLSQDVWLPNEYK

SEQ ID NO: 9143 - DNA, 460 bp, Zea mays
  misc_feature: Ceres CLONE 378506-F
  misc_feature: Translation starting site: 263
gactccacgccgccactcacgaccacgccgcgcctccgcctgaaacccttagccgagcgassaaggaaggaaatggggaagggtacgggcagcttcggcaagcgccggaacaagacgcacacgctctgcatccgctgcggccgccgcagctttccacctccagaagagcacctgctcctcctgcggctaccccgccgcccgcatccgcaagtataactggagtgtgaaggccatcaggcgtaagacaactggtaccggaaggatgaggtacatgcgacacgtgcctcgccgtttcaagagcaacttcagagaagggactgaggctgccccaaagaagggtgttgctgctgccaactaagtgtgtggtcttgctgccatcaagaagcgctagaacttgaggctttttttgattgaatttgtacttctgaactatttagcccataatactatgcttgaatta

SEQ ID NO: 9144 - DNA, 471 bp, Zea mays
  misc_feature: Ceres CLONE 378510-F
  misc_feature: Translation starting site: 3
  misc_feature: SWISSPROT Homolog: EC 1.6.5.5 NADPH:quinone reductase
  misc_feature (249)..(249): n is a, c, t, g, unknown, or other
aaatggaggcgctcgtggtgcggcasstgggcgatcccaccctgccccctggcggtgaagctccccgtttcgccgcgggtctctggggatcacccagtgccggagatctcatcgccgacggctgtccgagtgcgagtygcggcgaccagctcaacttcgccacgttcctccaggtgcagggcaagtaccaggagcggcccccgcttccgttcgtgcctggatccgactactctggcgtggtcgacgcanbttccccggcgtgcgtgggctccggccggcgaccgcgtctgctcctttaccggcctcggttccttcgctgacttcatcgtcgccgaggagaagcagctatttttggtgcctgatggatgcgacctggtcacagctggggctttaccagttgcatttggtacatcacatttggcccttgttcaccgagcccaattgaaggctgggccaagtgctacttgttct

SEQ ID NO: 9145 - DNA, 502 bp, Zea mays
  misc_feature: Ceres CLONE 378512-F
  misc_feature: Encodes the peptide sequence at SEQ ID NO. 9146
cttcctctcctttccagacccgagagccagagaccaaccacctgcggcggcgatggggatcggtgagcacttcgagggcgtgaagcagcactgggcgagcaacttcgccttcctcgactactacaagaaggtctacggccgcgccgagcccctccccaagtggtccgacgccgacgtcgacgagttcatcgcctccgacccggtctacgggccccagctcaaggccctgcgggagtcgaggaagttcgcgcttgtcggggccttcgccggcgccgcccacctcggcggcgtcgcgctcaagtactccaaggcgccgcacggcgtcgtgctggcgaccgggttcggggcgatcacgggcgccgtgctggggtccgaggtggcggagcactggtaccagttctacaagatggacaagcagggggccaaccttaggttcatctactggtgggaggacaaggtctcaggacagaagagctgaaccatgttgaattgaatgatgcct

SEQ ID NO: 9146 - protein, 141 aa, Zea mays
  misc_feature: Ceres CLONE 378512-F
  misc_feature (66)..(110): Pfam Name: Rick_17kDa_Anti Pfam Description: Rickettsia 17 kDa surface antigen
MGIGEHFEGVKQHWASNFAFLDYYKKVYGRAEPLPKWSDADVDEFIASDPVYGPQLKALRESRKFALVGAFAGAAHLGGVALKYSKAPHGVVLATGFGAITGAVLGSEVAEHWYQFYKMDKQGANLRFIYWWEDKVSGQKS

SEQ ID NO: 9147 - DNA, 290 bp, Zea mays
  misc_feature: Ceres CLONE 378518-F
  misc_feature: Encodes the peptide sequence at SEQ ID NO. 9148
agctcgcactccccgctagctccctctggttcccttcaagcggagaaagaagagagaggagggagaagaagcaacaagagcgaacgcaaaagtacagtacagctcctgagatggcggcgcggcgcgaagcaggaggagctgcagccgcacgccgtcaggaccagctgccctccgtctcctactgcctcaccagcccgcccccatggccggasstcccttcctgggcttccagcactacctcgtcatgctcggcaccaccgtcatcatccccaccgcgctcgtcccccaga

SEQ ID NO: 9148 - protein, 29 aa, Zea mays
  misc_feature: Ceres CLONE 378518-F
  misc_feature (4)..(4): Xaa is any aa, unknown, or other
MAGXPFLGFQHYLVMLGTTVIIPTALVPQ

SEQ ID NO: 9149 - DNA, 479 bp, Zea mays
  misc_feature: Ceres CLONE 378521-F
  misc_feature (375)..(375): n is a, c, t, g, unknown, or other
ctaatcgaaaaaccaaacaaaccgcgtccgcgtcgagtctctagtctctactctctcggctgtcctgtccggcgcggctctcgcgtctccaacctacccatgctgcagctcctccaactccaaggctcacaccaccccgcgacgggcgacgctaattaagtagagctgcaacacctgggttggaggctagagcttgcaaacaccaccagcgaaaacgtcgtggccagccatcccggtgtcgtcccgcgttctacagcctctgcatcccgcgttctacagccaccgctgttgtcgccgtcctagactcctagatccgtcagcttaacgagctccattccttcgcggccagccatcccggtgtctcagcggcggcgncggcggcgtcgagctcttgctttctgtgggaggacgcatggcgatgtctgcggggcgtgggctcttggtcctcttcttctctgccgccgtagtggctgagctcg

SEQ ID NO: 9150 - DNA, 431 bp, Zea mays
  misc_feature: Ceres CLONE 378523-F
  misc_feature: Translation starting site: 66
  misc_feature (87)..(87): n is a, c, t, g, unknown, or other
  misc_feature (211)..(211): n is a, c, t, g, unknown, or other
aagaaccaacgtgctcgatctccatctcgaccgtcgctcaccgggaagctacgctacgacgaagcatggcgtccgtcaccgcccgcnccccggtcgcggccctgcgcccgtcggcgtctctcaagtcgtcgtcgtcgtcggcggcggccttccttggccactctagccgcctcggccgcactgctaccgcgtcgccgacgaggccasctanaaggcggaggccaagggctagtggctcccgggccttccctcccccgcctacctcgacggcagcctgccgggtgacaatggcttcgacccgttgggcctggcggaggacccggagaacctgaggtggtacgtgcaggcggactggttgaacgggcggtgggcgatgctgggcgtggccgggatgctgatcccggagtgctgaccaaggccgggctgatcaa

SEQ ID NO: 9151 - DNA, 469 bp, Zea mays
  misc_feature: Ceres CLONE 378536-F
  misc_feature: Encodes the peptide sequence at SEQ ID NO. 9152
gcgcattggaaagggaatctcaccaaggccctaaactggctccaccgtggttcccttgcacgacgccctgcggsggtccgcssaaacacagcgtcaaaatggacccacatgtcatcgaaggcacatcaatcgacctggggattgcgtacatccttatgctggttgccctagtgctcacctacctgatccacccgcttgacgcgtcctccccctacaagctcttctgatccctgcgcctttccgtttggtcatgcggttaagggcgcgataggattttgagttaggcaacgtgcttaggtgaggctgggaggtttaggatgatgattgcggtcatctggtcttgcttggtatgatgtattggaggctcgaagctgttggtgttctgattggttttgtatcggacggactctatgatctttgtgctcagtccctcagttctgctctgttttggctggtgccgctcggtgta

SEQ ID NO: 9152 - protein, 42 aa, Zea mays
  misc_feature: Ceres CLONE 378536-F
MDPHVIEGTSIDLGIAYILMLVALVLTYLIHPLDASSPYKLF

SEQ ID NO: 9153 - DNA, 411 bp, Zea mays
  misc_feature: Ceres CLONE 378543-F
  misc_feature: Encodes the peptide sequence at SEQ ID NO. 9154
actctctcacacacacaaaagcagcgacttgctcacagtagtgctccacggacagaatgaccaaagacgacgagttcaagctggtcaagatccagaaccatgtgctcaaggtgaacatacactgcgacgggtgcaagcacaaggtcaagaagctccttcagaagatcgaaggcgtgtactcggtggccattgatgtggacaaccacaaggtgtcggtgacaggcgacgtggactcggagaccttgatcaggaagctcaccaggggcggcaagcacgcggagctgtggtcgcagcagcacaagggcagtgcccagcagaagcagcaggcccagcagcaacagcatcagaagcaaggtgccaatccgagcaaggatgggcacagcaagagcagcaacaacggcggccagaaaa

SEQ ID NO: 9154 - protein, 118 aa, Zea mays
  misc_feature: Ceres CLONE 378543-F
  misc_feature (16)..(76): Pfam Name: HMA Pfam Description: Heavy-metal-associated domain
MTKDDEFKLVKIQNHVLKVNIHCDGCKHKVKKLLQKIEGVYSVAIDVDNHKVSVTGDVDSETLIRKLTRGGKHAELWSQQHKGSAQQKQQAQQQQHQKQGANPSKDGHSKSSNNGGQK

SEQ ID NO: 9155 - DNA, 465 bp, Zea mays
  misc_feature: Ceres CLONE 378550-F
  misc_feature: Translation starting site: 103
  misc_feature (317)..(317): n is a, c, t, g, unknown, or other
  misc_feature (323)..(323): n is a, c, t, g, unknown, or other
atgagattgacatggtgatcgagctacaggccggtcgtcttctccaacgctagacaacgaagaaggagcaattaatcaagtagatcgattcaatccaatccaatggggttgctgataccagcccgtccggagcaatgcacgttgagccgtgtcgtgtctctcatcaccgtcggtgtcgtcatcgtggtttgcacgtacgtcacatcttctccggccggtggcgacgccgggaaggaggagttcttcagcatatggcaccgtcgatcatcggattttgtccccgacgatctggaggtggcgctgcgcggcgcasstancgcganacaggacgctgatcctgaccatgctgaacaaggcttattcggaggagggcggcctcctcgacctcttcctcgagagcctgagggaaggggacggcaccgagcagtttgatcgaccacgtcctcttcgtggccatggaccagc

SEQ ID NO: 9156 - DNA, 1777 bp, Zea mays
  misc_feature: Ceres CLONE 378576
  misc_feature: Encodes the peptide sequence at SEQ ID NO. 9157
aaacgccctccgtgccgtgcccactcctctccccgcagcttcgggcccctgccatgccgtcctcgtcgtcgctgatccatggcatctccatctccgtctccgacgacgacgaggccaccggcaaggtgcgcgtccgcgtccgccgcaagcgctcccgcggccccgcatccgcttcggcgcgccgccgccgcatcctcttccgcgccgcgcggctgggcgtgccgctcctcctcgccgccctcgccgtgtgcctcctcctctacgagtcctaccgcctcacgccttcccgctcctccacactgcctccgccgtccttcgcggacatcagccgcctctcccgcaacgcccgcgccgccgatggcgccaggaagtcatgcctgaagtttcttgatcctgagaagcttcaaaatttggaacttccagaaattcctgaaacaaatttgtcgatgaaggaagttctgtacagatcaagtctgccccatatcgtcaatgatacaccaccacatacagagaattcccggttcaacttgttcacaggataccagacactcactgaacgagaagaaagcttcaagatgaagaaaagtgtgacagtgcactgtggcttttataatgaaaatggagggttcagagtttctgatgttgacagagaatatatgagatcctgtgaagtagttgttgcaacttgtgcatttggtggaggtgacgaccttcatcagcctatagggatgaccgaaaattccatcagaaaggtttgctatgtagctttctgggatgaagtcacccgtgcagctcaagaggaggaaggacacacgatcagtgaagacctcgtgattggcctatggcggatcattcttgttagcgatcttcctttctcagatcaacggttgaatgggaaaattcctaagctgataagccatcgcctcttcccaatggcgcggtactcaatttgggtggattcaaaatctcagttccggagagacccattgggagtccttgaagcccttttgtggcgctcaaactcttctctagcgttatcggaacacggagctcggagtagcctgtacgatgaggcgaaagcaattgttaagaaacacaaagcaactccagaggaagttgaagtgcagttggatcagtaccgacgagatggcatccctgatgagaaaagattcaatggaaagaaagctctcgcagaagcttcagtgatcgtgaggaaccacgcgccgctgaccaacctcttcatgtgcgcctggttcaacgaggtggtcaggttcacgtcccgggatcagctgagctttccctacgtcctgaggcgcctgaggccgcccggcgttcacctgttcccggtttgcgcgcgcaaggacctggtgaacagcttcgggcacaagcgcaaggtgaagccgctcgtcaaggacacgacgtgagccccttgtggaattgggccttcgtctgggctagagaaggtcaacctgcctgattagtaatttagtggtagtagtcttcttccttccatccagtagtagttcataagtaagaatcaaaccgtcgtgtaggggagggtcttgagtcttgacgtagtgaaattacagtcggagacgcagagtagtagtcaccgaaggggtgcaacgtaggggtaggaatgatttatcccggtaacgaaggatgtacttactagctgacgacaatggcgctgtcgacgttgctgcaggcgaagatggcctgtgcagctgtggttacccttccccgttcctcatgaaagaaaaaaaaaaaaaaaaaa

SEQ ID NO: 9157 - protein, 456 aa, Zea mays
  misc_feature: Ceres CLONE 378576
  misc_feature (140)..(444): Pfam Name: DUF616 Pfam Description: Protein of unknown function (DUF616)
MPSSSSLIHGISISVSDDDEATGKVRVRVRRKRSRGPASASARRRRILFRAARLGVPLLLAALAVCLLLYESYRLTPSRSSTLPPPSFADISRLSRNARAADGARKSCLKFLDPEKLQNLELPEIPETNLSMKEVLYRSSLPHIVNDTPPHTENSRFNLFTGYQTLTEREESFKMKKSVTVHCGFYNENGGFRVSDVDREYMRSCEVVVATCAFGGGDDLHQPIGMTENSIRKVCYVAFWDEVTRAAQEEEGHTISEDLVIGLWRIILVSDLPFSDQRLNGKIPKLISHRLFPMARYSIWVDSKSQFRRDPLGVLEALLWRSNSSLALSEHGARSSLYDEAKAIVKKHKATPEEVEVQLDQYRRDGIPDEKRFNGKKALAEASVIVRNHAPLTNLFMCAWFNEVVRFTSRDQLSFPYVLRRLRPPGVHLFPVCARKDLVNSFGHKRKVKPLVKDTT

SEQ ID NO: 9158 - DNA, 403 bp, Zea mays
  misc_feature: Ceres CLONE 378580-F
  misc_feature (371)..(371): n is a, c, t, g, unknown, or other
actgccacgctaaccgtcgcaaagaacagctgctatgctgctcttcccgctccgcctcgaaccagcgtcaatccactcgtccaccgtcgcacctgcaccacgaccacccgcggccgcgatgaacaacttccccgacggacgcacgtgtggctgcagasscgcgcgcgcsssgttacctccacgccgacgaggacggghccggcgtctccctcagcaacagccgcgccacgctgaacgcggcgtggcaggtgcaccggatcgtgcacgggggcgtcgactacgtcctcctccggtccgccgcctacgsscgttacctcgcgctctcagsstccttggcggcggacggccaccgcggcsscgaascgcccagncgcgacttcaacgagccgcagcagctcaacgt

SEQ ID NO: 9159 - DNA, 463 bp, Zea mays
  misc_feature: Ceres CLONE 378606-F
  misc_feature: Encodes the peptide sequence at SEQ ID NO. 9160
agaaaccctagcgatgctgcagatccgcctgagcaagattggctcgtcggactccggcgctgccgccaccggctcggcagccgccgccggtgccgccgccgctgtggggtcggctgcggcgctgggcggcggcatcccggaatcgtcaccgtggcatgccccgaccacctggtgatcgcggacctacccgtcgcgaagagcctcggtgccgtcacgacctccgctgccgccgccacgcgcgccatcggccgtcgctcccgtcgcccgctcggggagcgcgtccacatctgctcccgctgcgagttccccatcgccatctacggccgcctcgtacgaacttgctaagcccttttctttatgcggctatcaaaccacgaacttgttccgcttgtgttgctgctaaggaaactaggggtttaattaaccgcgtgtgttgtggagccacttaccgccacaaactcta

SEQ ID NO: 9160 - protein, 114 aa, Zea mays
  misc_feature: Ceres CLONE 378606-F
RNPSDAADPPEQDWLVGLRRCRHRLGSRRRCRRRCGVGCGAGRRHPGIVTVACPDHLVIADLPVAKSLGAVTTSAAAATRAIGRRSRRPLGERVHICSRCEFPIAIYGRLVRTC

SEQ ID NO: 9161 - DNA, 226 bp, Zea mays
  misc_feature: Ceres CLONE 378614-F
  misc_feature: Encodes the peptide sequence at SEQ ID NO. 9162
  misc_feature (182)..(182): n is a, c, t, g, unknown, or other
aacctgagaaatggcggccgtctcctccacctccaccgcctcctcctacttctcctcgcagccgcagctsscgatctccaccgccgaccctgccgccagcaaaagtaggttgatgcggcasscacggcggassagcagcttcgtgatgatggaggcgtcctctgccagcggacgacggcggnkgtggccaggacgaagagcctcacggaggacgacctggatgagy

SEQ ID NO: 9162 - protein, 72 aa, Zea mays
  misc_feature: Ceres CLONE 378614-F
  misc_feature (21)..(21): Xaa is any aa, unknown, or other
  misc_feature (37)..(37): Xaa is any aa, unknown, or other
  misc_feature (38)..(38): Xaa is any aa, unknown, or other
  misc_feature (41)..(41): Xaa is any aa, unknown, or other
  misc_feature (58)..(58): Xaa is any aa, unknown, or other
MAAVSSTSTASSYFSSQPQLXISTADPAASKSRLMRXXRRXSSFVMMEASSASGRRRXWPGRRASRRTTWMS

SEQ ID NO: 9163 - DNA, 454 bp, Zea mays
  misc_feature: Ceres CLONE 378654-F
  misc_feature: Encodes the peptide sequence at SEQ ID NO. 9164
acgcacgcagagssaacccacggccacggggacgggggtctgtaaaatccgtagcgattgagcgagcaaaagaatctgccccttccccttccctttttacaggcgctgtcccgcaagckgcgcatcgcaggaggcggtgaactggtggcgaggcgagaggtctcgatcttcccggccccacacacaacaaakcggggcgatggkvccagcacgaccacgagatggagcagaaggggtgcctctgccggatcaagaactgcgccattgaactcttgtcgatggaggaggacctggagacggacgacgaggagtcgtgggacctcgttggaagggacctccggctcaaggccaccttcctgtgcatcgacctcagtcgcttgatcgccttctgccagggcgaagagcacaagaaggcgctcactgtcgtcgccaacaagttcttctactccatgga

SEQ ID NO: 9164 - protein, 77 aa, Zea mays
  misc_feature: Ceres CLONE 378654-F
MEQKGCLCRIKNCAIELLSMEEDLETDDEESWDLVGRDLRLKATFLCIDLSRLIAFCQGEEHKKALTVVANKFFYSM

SEQ ID NO: 9165 - DNA, 469 bp, Zea mays
  misc_feature: Ceres CLONE 378679-F
  misc_feature: Encodes the peptide sequence at SEQ ID NO. 9166
gctgctcctcaattcgattggytccgtgccgacctccaggttgagaaggaaagcatcgcrgttcgccatacggatgggttctaaagcgcctttatgtctcacgctcctcttgctgctcactgcggcctgtggacctgctgcacatgccaacgatgctgacaatgtgaggacgaaccaaaagggcgagttctgggtggcgatccactgtcggagaagtatgtatcctcggctaatgagctgccatgtcaagctgaggaagtttttgctcagcttcccaatccctgccaagtaccactacctgatgcatatcgatagcaagctctacgcgttgatcatcagggacagcccgatggccagatgcttcacatcatggaggacgacaagggagaggtggtgagagttatcatcgaagtggagggtccgtctgatgccattcatcgctgtctttgacctcgtgaaggcgtcttag

SEQ ID NO: 9166 - protein, 131 aa, Zea mays
  misc_feature: Ceres CLONE 378679-F
  misc_feature (20)..(20): Xaa is any aa, unknown, or other
LLLNSIGSVPTSRLRRKASXFAIRMGSKAPLCLTLLLLLTAACGPAAHANDADNVRTNQKGEFWVAIHCRRSMYPRLMSCHVKLRKFLLSFPIPAKYHYLMHIDSKLYALIIRDSPMARCFTSWRTTRERW

SEQ ID NO: 9167 - DNA, 270 bp, Zea mays
  misc_feature: Ceres CLONE 378698-F
accacctccctgctctgctttgctgtttgcatcgcatcgcatcgcatcgcctttgctgaatcccagcgacggacgggccgctacgggcactgtacggtgccgacgagcattgcttgctgctgcctcggccggcatggcgatggcggcgcggtggaggtcggcacgcagggcacggtgggctcgctggtgctccgggaggtcgagcacttccggagatggaggtcgccggcggccacggcaagaagagcagcaaggtcgttgcagccggcg

SEQ ID NO: 9168 - DNA, 492 bp, Zea mays
  misc_feature: Ceres CLONE 378701-F
  misc_feature: Encodes the peptide sequence at SEQ ID NO. 9169
  misc_feature (64)..(64): n is a, c, t, g, unknown, or other
agcctatctcttcgtgaatcgtgtcccttcccttggctgcagctgcaggatccaagcaacgcgnaaggagggaggtgagcaccatgtcggcgctgttcaacttcaactccttcctgaccgtggtgttgctggtgatctgcacctgctcctacatcaagatgcagttcccggcaatcctcaacgaccgcaccggattccgtggtttcttttggaaagctgccaggataggtgagcgattgagcccttgggtatcagtcgggtgcttggctatgggaatatccactattttcttctaaggccgaagttttaatctccacaaatttagtctaggacgcagcaccttgtttcacttgtagagaaaaaaaaactattgtaagcattttgcttcagtttttaatggtgggcactgtaagatctgtatctgcactgagatttctgatattaacaaaaatgttttctcataagatttctgaggaaaaaaaaaaaaaaaag

SEQ ID NO: 9169 - protein, 70 aa, Zea mays
  misc_feature: Ceres CLONE 378701-F
  misc_feature (2)..(71): Pfam Name: DUF1242 Pfam Description: Protein of unknown function (DUF1242)
MSALFNFNSFLTVVLLVICTCSYIKMQFPAILNDRTGFRGFFWKAARIGERLSPWVSVGCLAMGISTIFF

SEQ ID NO: 9170 - DNA, 420 bp, Zea mays
  misc_feature: Ceres CLONE 378705-F
  misc_feature: Encodes the peptide sequence at SEQ ID NO. 9171
attcagttttgctgggcttgccggccctggccggcgaggcgagtaggcgacccggcgtgcgttggactctctctctctctctacccccttttcaacgcggtggagtcgagccgaactcaacccaacttctctccctctccctcgcctgcctgccgttccgcgtttgaccaactcccccgcaccgtaaccctagcagcagatcggccatggagagctgggcgacctgggtggggacaagcgtcacctccgccttcttcgcctccctcgagcgctgctcctgcatcaacctctccaccgacgacgacgacgacgacgaggaccacgacgaggccaaggaccggcccctcatcctcgccgccgccccacgccacgactccgccgccaagcccgatccagactccgccgccgaggacaggacga

SEQ ID NO: 9171 - protein, 71 aa, Zea mays
  misc_feature: Ceres CLONE 378705-F
MESWATWVGTSVTSAFFASLERCSCINLSTDDDDDDEDHDEAKDRPLILAAAPRHDSAAKPDPDSAAEDRT

SEQ ID NO: 9172 - DNA, 429 bp, Zea mays
  misc_feature: Ceres CLONE 378759-F
  misc_feature: Encodes the peptide sequence at SEQ ID NO. 9173
  misc_feature (301)..(301): n is a, c, t, g, unknown, or other
attcctatcaatacttccacacggcacaactatcggcggcggcaacgagccaggaccctgttgtgatgctaccgtcgccgccggtgctactacgcccttgcgctgcccgggcctccccgcttccgccccctagacctagagctgcaaatcctaacaccgagtcggcgacgacgacaaccgccgccacttcagcggacagagcggccaccatgggcgcggcasstggtggcggcgcgcctggggcagcggttcaacccagccggtgtggccgcggtggcgcgttcgcggcgtccaagccgcncttggcgctgccgcacgtgtcggtgcaagacatcaggtggctcgactgggctgagctccgccgcgccgggttccgcggcttcgttttcgacaaggacaacacgctcacggccccctaacgcgcccgss

SEQ ID NO: 9173 - protein, 69 aa, Zea mays
  misc_feature: Ceres CLONE 378759-F
  misc_feature (5)..(5): Xaa is any aa, unknown, or other
  misc_feature (31)..(31): Xaa is any aa, unknown, or other
MGAAXGGGAPGAAVQPSRCGRGGAFAASKPXLALPHVSVQDIRWLDWAELRRAGFRGFVFDKDNTLTAP

SEQ ID NO: 9174 - DNA, 456 bp, Zea mays
  misc_feature: Ceres CLONE 378771-F
  misc_feature: Encodes the peptide sequence at SEQ ID NO. 9175
  misc_feature (61)..(61): n is a, c, t, g, unknown, or other
  misc_feature (378)..(378): n is a, c, t, g, unknown, or other
  misc_feature (400)..(400): n is a, c, t, g, unknown, or other
gacattatgtccagcaatcaaaacacgccacctgtgcgtacactccacacctcgcctcckngcttccgtctcgcacttccggacataaagtgcgaccatggccatggcggcgctgcgggaaacctcccgctgtttggcgtccagggggagatctgcggcctggcgacccgtgctcctcgcgcagtcccgcggcatcacttacaagctcttcgtcggaggtttatcacagtttgcgacggaagcaagcctagcagaagcattctcacgttacggacaagtaatagaagctaccgtcgtcagggataaggtgaccgaygtaccgawagwttcggcttcgtgaagtttgcttccccggagaagccaataamgcgagggaanavatgamcggcaaggcattgancggtcgggtcatatacgtvgacattgcaaassrccagamaggaccgtgctgcagat

SEQ ID NO: 9175 - protein, 80 aa, Zea mays
  misc_feature: Ceres CLONE 378771-F
  misc_feature (76)..(76): Xaa is any aa, unknown, or other
  misc_feature (77)..(77): Xaa is any aa, unknown, or other
MAMAALRETSRCLASRGRSAAWRPVLLAQSRGITYKLFVGGLSQFATEASLAEAFSRYGQVIEATVVRDKVTDVPXXSAS

SEQ ID NO: 9176 - DNA, 477 bp, Zea mays
  misc_feature: Ceres CLONE 378830-F
  misc_feature: Encodes the peptide sequence at SEQ ID NO. 9177
agctcgaggccttgtcttgagttctctcgtccagaggcctggccagctagctagcactgacactgaccgagaccctgcagctagcagctgatcgatccatatccatccatggccatgggctgctgctacggtgatttcttcgacaaggccaagccttacctcgccatgatctccctgcagttcggctatgcggcatgaacgtcatcaccaaggtctccctcaaccacggcatgagccactacgtgctcgtcgtctaccgccacgccttcgccaccgtctctattgcaccgtttgctctcatccttgagaggaaggtgaggcccaacatgacgtggtccgtcttcctccagatcttcgtgttggcactgctcgggcctgtgatagaccagaacttctactacgccggcctcaagttcaccgggccgaccttcgtgtgcgccatgagcaacatccttcctgccatgaccttcgtcatgg

SEQ ID NO: 9177 - protein, 94 aa, Zea mays
  misc_feature: Ceres CLONE 378830-F
MNVITKVSLNHGMSHYVLVVYRHAFATVSIAPFALILERKVRPNMTWSVFLQIFVLALLGPVIDQNFYYAGLKFTGPTFVCAMSNILPAMTFVM

SEQ ID NO: 9178 - DNA, 471 bp, Zea mays
  misc_feature: Ceres CLONE 378855-F
  misc_feature: Encodes the peptide sequence at SEQ ID NO. 9179
  misc_feature (171)..(171): n is a, c, t, g, unknown, or other
  misc_feature (267)..(267): n is a, c, t, g, unknown, or other
  misc_feature (366)..(366): n is a, c, t, g, unknown, or other
ctcccccatttcaaactcgaaccccctctccccgcctcgagcatcgaccagagggggaaggcaaggcgccgatacgttatcggaatccgaggcgaacggggggtggggatcggatggtggaggctagcgcgassttcatggataaggtcgaggcggcggcaggygacgckncgtcgacgtggcgagcgtcggcgtcggggacgcaaggaaggaagatgaggagatggcgcccgtggaacccctgccggagcctcccgacgaaggsgncccgttgcgtggcccatgccggagttctgccctctcacggtcgatggcgcgctgaaggagtcattcctggagactctgtggaaggacgctgcgccgganatggakcggcctgcgcgagakggcggacgaagcgctcagcccggaatcacggccgtcgagcagcaagcgccatcgctccggcaccgctcgccgtcgtccaggagc

SEQ ID NO: 9179 - protein, 63 aa, Zea mays
  misc_feature: Ceres CLONE 378855-F
  misc_feature (28)..(28): Xaa is any aa, unknown, or other
  misc_feature (30)..(30): Xaa is any aa, unknown, or other
  misc_feature (35)..(35): Xaa is any aa, unknown, or other
MPEFCPLTVDGALKESFLETLWKDAAPXMXRPARXGGRSAQPGITAVEQQAPSLRHRSPSSRS

SEQ ID NO: 9180 - DNA, 442 bp, Zea mays
  misc_feature: Ceres CLONE 378865-F
  misc_feature: Encodes the peptide sequence at SEQ ID NO. 9181
aagaggctgcggtgctcgctcaggctcactgctcagtgctcactgctcactagctaaaaacatctcctttcttatccatggagacggcagcgctcacctcccactccctgcagcgcccagcagcagcagcagctsstcccgcgcatggccagcggcggagggtcggagcggcgggcctgcggcaccggcagccgcgcgccggcgcaggatccgggccctgccttcggcggaggtcatcagcgagatcctgagccccaagctggtgcccggctcgcccgccgacaccggcgacgtctcctcgctcgtcccggtcagtgccctgatgctgctcttctacttcgtgtccaactgggtggtgcccgagctgctcctgaagggcctcaaggagcccaagcccggaggacgaagcgtccacgtccttcgccgcgtccgssacaacgcc

SEQ ID NO: 9181 - protein, 147 aa, Zea mays
  misc_feature: Ceres CLONE 378865-F
  misc_feature (45)..(45): Xaa is any aa, unknown, or other
  misc_feature (145)..(145): Xaa is any aa, unknown, or other
RGCGARSGSLLSAHCSLAKNISFLIHGDGSAHLPLPAAPSSSSSXSRAWPAAEGRSGGPAAPAAARRRRIRALPSAEVISEILSPKLVPGSPADTGDVSSLVPVSALMLLFYFVSNWVVPELLLKGLKEPKPGGRSVHVLRRVRXNA

SEQ ID NO: 9182 - DNA, 789 bp, Zea mays
  misc_feature: Ceres CLONE 378885-R
  misc_feature (30)..(30): n is a, c, t, g, unknown, or other
ctgcgctgccccccctcccccgccccgaanaaaatgaacaggaaaccggtgggtgttgggggggtgggtgggttcccccccccccccaataggtacgagccccccctcgaggtcgacggtatcgataagcttttttttttttttttttagtaaaacttcagatggaactgctgtgtgtagaatacaatcaaacaataactttaacgtcaaaatacacattatctacaaattttaaaatcttcctttcctaaaaaggaaatgaagaatgaaaagaatggctttccaagtccattaaattctaagggcagttcatactagacctaaactacgagaaaagccctagcagtcgggagataaaccatttgctttcttggtgtcattgctgcctttagttgccaaaagcggtgcaacctccttatctggcatctgggaaacctgcaggagcatcattttgttgacttcttcttgcccctctcttaccgcagaacaggaaggatagtgcccctcccccaatatcgccccctaaaaatggcccggagagggctccctcacaaggggaaagggatcctggtaaaaagaggcccccccccaatgatagaaacccaaacatgtgtttaaccgcgaaccaaaagaccccgggaaaggtaacttggggcaaggcttgtttccaatcccaaaaaaatgcaccggaaggttccaggacccccccacccccgcccaggagaggggccaaggaaacccccaaaaccgccacccgcagcatctgccggcggagaccccccccccccg

SEQ ID NO: 9183 - DNA, 966 bp, Zea mays
  misc_feature: Ceres CLONE 378897
  misc_feature: Encodes the peptide sequence at SEQ ID NO. 9184
acaggctcacatagtcacaaggaagtccagtcggccatggggagaccgagagctaccaccaccgcagcctcttccaagccgaagccgaagccgaagcccaagcccaagcccaggtccagggccaagcctagggcgacgcccagccccgtccccctgctctccggcatctcctctccttacgcgtgccgcacgccgtcccctgctgccgccgacctcagcttcctctcgccctcctccccgcccgcggaacccggaaccaggaattcttcgcccctcgccgcccccactaccatgtccaccatcggagacctgaggagcctcgccgcgtcgcacctcgactccctgaagcgccgcttggacgcgctccacggcgactatgtccgcgaccttgaggcctcccactcccgcatctccaagcgcgtcaagatggagtcccatggctgcctgcagctagcagaggaagtggacaaggaacagcagaagatagccgacaagatcgccgagcgcgccgagctggtgaagacctcttacaagaagttcgtggctgaagtgcaggcgtccacatcccgtgtgtgcaaggtgactgtccctgagatgacgaagtccatggagagggctattgatggcttgcgcagtcgctacatctccgctataccatcagcttagctggtgctgttgtccacatcaattgaggtcacatgttgagtcttaaatcggcttcgcagcagggacttgcacatttgtacataatatcaccgttgcatgagtacatgagatagttcattgctacatctccatttccagatatcccgaaaagtcaataatagttccttcgatccttggaactttttttttttgcttcgtcgcatttcttgtgcatcccgttagatgctactgtcgatgtacctttcacgctcagagcatctaatttttaatcatgtttgttctaaaaaaaaaaaaaaaaaa

SEQ ID NO: 9184 - protein, 209 aa, Zea mays
  misc_feature: Ceres CLONE 378897
MGRPRATTTAASSKPKPKPKPKPKPRSRAKPRATPSPVPLLSGISSPYACRTPSPAAADLSFLSPSSPPAEPGTRNSSPLAAPTTMSTIGDLRSLAASHLDSLKRRLDALHGDYVRDLEASHSRISKRVKMESHGCLQLAEEVDKEQQKIADKIAERAELVKTSYKKFVAEVQASTSRVCKVTVPEMTKSMERAIDGLRSRYISAIPSA

SEQ ID NO: 9185 - DNA, 256 bp, Zea mays
  misc_feature: Ceres CLONE 378943-F
  misc_feature: Encodes the peptide sequence at SEQ ID NO. 9186
  misc_feature (27)..(27): n is a, c, t, g, unknown, or other
acacacagcaagccagcagagcabsdnagcagccgcagccccagcccccacaagacgaggcaacaatggcgctagaagcagccaccgccccccgcgcactcctcgccgcgtgcctcgtcctgctggtcctcggcggcggcaccggcccgtcgtcggtgctggggctggggctgggacgttggtgtaatgtggtgaataagcgagtgcatgcaacgcaattggaacttaagacacttttggcaaaaaaaaaaaaaaa

SEQ ID NO: 9186 - protein, 63 aa, Zea mays
  misc_feature: Ceres CLONE 378943-F
MALEAATAPRALLAACLVLLVLGGGTGPSSVLGLGLGRWCNVVNKRVHATQLELKTLLAKKKK

SEQ ID NO: 9187 - DNA, 268 bp, Zea mays
  misc_feature: Ceres CLONE 378982-F
  misc_feature: Encodes the peptide sequence at SEQ ID NO. 9188
gtaaaaatagccgcaccgcctacccaaaccaccggcgcgcacgccaagcggtgaagcagcatcggccatggaggagaccaagccagcgccagaggccatgctccgctgcgccagggccgcgctcctcctcgcctccctccgccggccacgcgcgccgacgccgacacaggatcgccgccggacctcctactctccctcctcggccgccgcagcgagctcgcgcgctccggtcggaggggctcctccgcagcgccgagatcgcagcggc

SEQ ID NO: 9188 - protein, 67 aa, Zea mays
  misc_feature: Ceres CLONE 378982-F
MEETKPAPEAMLRCARAALLLASLRRPRAPTPTQDRRRTSYSPSSAAAASSRAPVGGAPPQRRDRSG

SEQ ID NO: 9189 - DNA, 462 bp, Zea mays
  misc_feature: Ceres CLONE 378987-F
  misc_feature (73)..(73): n is a, c, t, g, unknown, or other
  misc_feature (206)..(206): n is a, c, t, g, unknown, or other
aattttsstccagccgccgcgctcctgatccttatctctgcgcgcgctgcatcggcgcccgcsgggaggmttncccgccgcctcgtccatgccgtgggtccgcaatctccgccgcttcgtcgacacgggcgccggcctcggatccgaggcctcatggaactggagactaaaaggatattgcttgagattttcaaggagcggtassnatagagtgccgaggctggttccatcccaagtttttacaagaagaaacctgaagaagggatccattagctctagakttcaaaggkttggccaagtacaggtttctaaagaaacaatcagaggcttctgctgaatgctgatgattcttgatgccatgtgggtttgtctaagagaaaattgtgttattgatgatgctactggtgcttgaaaagatgaattatgaaggatttctgccatatcgccacagtctgcacggag

SEQ ID NO: 9190 - DNA, 174 bp, Zea mays
  misc_feature: Ceres CLONE 379000-F
  misc_feature: Encodes the peptide sequence at SEQ ID NO. 9191
accggcatcgctctccgcgcccaacgccctctccctgctcgcgcccgctagagtcacctccgggaggtggaacaggagcctgtctgtttccgccgctgcgcgctccgtgacccgggtggtgtctgtcgcgtccgcggcagtkctacggcgcagaggaggttggtcgccgcggca

SEQ ID NO: 9191 - protein, 57 aa, Zea mays
  misc_feature: Ceres CLONE 379000-F
PASLSAPNALSLLAPARVTSGRWNRSLSVSAAARSVTRVVSVASAAVLRRRGGWSPR

SEQ ID NO: 9192 - DNA, 373 bp, Zea mays
  misc_feature: Ceres CLONE 379012-F
  misc_feature: Encodes the peptide sequence at SEQ ID NO. 9193
aacacccaatggcatcacgaatgtggaacctcaaagccctggtcacctcactactctgcatctcggcgttgtcgtcgtcgccatggccatgcacggcagccggtcagctgggcggcaagccctggtcaccgccgtcaccaaggacgcgtccacctccctctacacggcgccgctcaaggacggccacccgctcgtcctcgacctcactagcccggtcatctcgctggccacgtgcgcctcctcctccaagaacaacaacggcacgctcaccgtcacgctatccaacgctaccgacggccagaacccgctgttcccggtctccttctcggcggtggccacgtgcgcgccgtcgtccaagctgcccgccggcgcc

SEQ ID NO: 9193 - protein, 97 aa, Zea mays
  misc_feature: Ceres CLONE 379012-F
MAMHGSRSAGRQALVTAVTKDASTSLYTAPLKDGHPLVLDLTSPVISLATCASSSKNNNGTLTVTLSNATDGQNPLFPVSFSAVATCAPSSKLPAGA

SEQ ID NO: 9194 - DNA, 494 bp, Zea mays
  misc_feature: Ceres CLONE 379049-F
  misc_feature: Encodes the peptide sequence at SEQ ID NO. 9195
aaggaagagggctttacactgaaccccagcgacccaggcgtcagcggcgtgatgcagttcctccgaggcagcggcggcgggggcgggggcggtgggttcccgggggtggcgtgggaggtgttgcggcggcacttctctaagaagcggtccgtggacgtgaggcggatcaaccccaaggtgcccaaggaggaggccgtcgccatttccggccgactcctccagatcctctccgaccatgggcccctcaccgtcggcaacacctggaaccacgccaaggatgctggcatcgctggtctgaacagcaagacgcacatgaagatcctgctgaaatggatgacggggagaaatgtcgtgaagctgacctgcgtgcacgtgggcaacgcgaagaagttcctctactccccgtccactgaaagcagcagcagcgccggcgcatcaccgtcatccacatcggcctcgcagtgacggtcagtcgccgttaagccttggtgtgg

SEQ ID NO: 9195 - protein, 137 aa, Zea mays; identical to SEQ ID NO: 7424
  misc_feature: Ceres CLONE 379049-F

SEQ ID NO: 9196 - DNA, 438 bp, Zea mays
  misc_feature: Ceres CLONE 379069-F
  misc_feature: Encodes the peptide sequence at SEQ ID NO. 9197
  misc_feature (94)..(94): n is a, c, t, g, unknown, or other
  misc_feature (369)..(369): n is a, c, t, g, unknown, or other
gtgagatggctgagtacggcgagcgctaccagggcaacggcgaccaggccacggccgagggtggctatgcgcagaccgagtacgccgccggccncggtggctcgccgccctccgacagcaatccctccgtgttctccgaccacgccgacggccgctcctcccagccccagcatgagacccaatcacatgacagtggttcctccaaatctcaagaaagggaccgagaacgtgataagggcaaggacagggagcgaggcagagaccgtgtccgcgaaaaggagaggggccgagacagggacaaggatcgtgaaagaggtgacagagacagggatcgtgatcgccaccacagggatcgtcgcgagcgcassnattaaaggggaacaccgtgattcgttctgattgatcgtgaccgtcgcaggagtcatgattctgagagga

SEQ ID NO: 9197 - protein, 120 aa, Zea mays
  misc_feature: Ceres CLONE 379069-F
  misc_feature (30)..(30): Xaa is any aa, unknown, or other
MAEYGERYQGNGDQATAEGGYAQTEYAAGXGGSPPSDSNPSVFSDHADGRSSQPQHETQSHDSGSSKSQERDRERDKGKDRERGRDRVREKERGRDRDKDRERGDRDRDRDRHHRDRRER

SEQ ID NO: 9198 - DNA, 709 bp, Zea mays
  misc_feature: Ceres CLONE 379091
  misc_feature: Encodes the peptide sequence at SEQ ID NO. 9199
gtagtttgttgaataactcgatcgagatagacatatcgctatcggtgtagcattcaagtagggaggtggccatgaacaacattgaatcgtcggagctgaggaaggtgttccaaatgttcgacaagaatggcgatggccaaatcacgaagaaagagctaggggagtcgctcaagaacctgggcatccacatctctgatgacgagcttgatgccacgatggacaagatcgacgccaatggtgacgggtgcgtagacgtcgaggagttcggaaagctctaccgctccatcgtcggcgagggccaagtggacaagcacgacgaggaagaggacatgcgggaggcattcaacgtcttcgaccagaacggtgacggcttcatcaccgtggaggagctgcggtctgtgctgtccagcctcggcctcaagcaagggcgcacggccgaggattgccgtaagatgattagcaaggtcgatgccgacggcgacgggcgcgtcgacttcacagagttcaagcagatgatgcgcggcggcgggtttgatgcacttggtacatgatcgggacttcggaggattgagtatgccttaattgcgtggatggtaagggcgttgtagatacttcgttcattaaaatggttcgcatggtacggatgtggcaatctaatgacatttcttcattagttaattatttgttttggtgaaaaaaaaaaaaaaaa

SEQ ID NO: 9199 - protein, 159 aa, Zea mays
  misc_feature: Ceres CLONE 379091
  misc_feature (86)..(114): Pfam Name: efhand Pfam Description: EF hand
  misc_feature (8)..(36): Pfam Name: efhand Pfam Description: EF hand
  misc_feature (124)..(152): Pfam Name: efhand Pfam Description: EF hand
  misc_feature (44)..(72): Pfam Name: efhand Pfam Description: EF hand
  misc_feature: SWISSPROT Homolog: EC 2.7.11.1 Non-specific serine/threonine protein kinase
MNNIESSELRKVFQMFDKNGDGQITKKELGESLKNLGIHISDDELDATMDKIDANGDGCVDVEEFGKLYRSIVGEGQVDKHDEEEDMREAFNVFDQNGDGFITVEELRSVLSSLGLKQGRTAEDCRKMISKVDADGDGRVDFTEFKQMMRGGGFDALGT

SEQ ID NO: 9200 - DNA, 735 bp, Zea mays
  misc_feature: Ceres CLONE 379149
  misc_feature: Encodes the peptide sequence at SEQ ID NO. 9201
aacgatcgacgaacgaggggtgtagggagtggaaggaagaggctcagcgttcatggagagccgcaaggaggagcaggcggcggtggggtggatgaccgtgccggcgttcggggagtgggacgtgaagaacggcgccgtgccggactactccatggacttctccaagatccgcgagatgcgcaagcagaacaggcgcgagctctcccggtcccgggccagcgtcggctgcggcgacgacgacgacgacctactccagaagaagcagcagcagcaggaggaggagggaagcaaggcccagccgcgcaacaagccctccgccgctgtcgcggacgacggccaccgtcgagcgctgcacgacgactcccctacggggaggaagaagttcctgagctatttccagtgctgtaccagagcgtgaagaaaactcccaagacttgttcttcctctgctgcgctgcgcaggtagctgcatgtttgggtttccttctgtaatgtatgtaaagcatgtctgcgtagttaaagtgtgtgatcctgtcacccatgccaagcatgagagaggggaggaacgcccatggctcacagcttctagtgcagtgtggtctgagaaaaaaaagattggatctgatgaagaaggatgtggcttgtgtgtttttgtttgttgctgtacgagattggacgcacttgagatgatgtattgacgattgtccatcttgttcttccaaaaaaaaaaaaaaaa

SEQ ID NO: 9201 - protein, 121 aa, Zea mays
  misc_feature: Ceres CLONE 379149
MESRKEEQAAVGWMTVPAFGEWDVKNGAVPDYSMDFSKIREMRKQNRRELSRSRASVGCGDDDDDLLQKKQQQQEEEGSKAQPRNKPSAAVADDGHRRALHDDSPTGRKKFLSYFQCCTRA

SEQ ID NO: 9202 - DNA, 123 bp, Zea mays
  misc_feature: Ceres CLONE 379219-F
aaggccgcaacgcctccgctttcattcttcttctcttttctcgttccccccgttgggttttgagctccgacgaaccctaataatcgccggggaccgcccggwatcgcccgccggcatgcacca

SEQ ID NO: 9203 - DNA, 471 bp, Zea mays
  misc_feature: Ceres CLONE 379237-F
  misc_feature: Encodes the peptide sequence at SEQ ID NO. 9204
attctcaatctggttcgggctcctggatcggacccgaaaaactggtgagatttgacstacagcggagatggccaccggcgacctgcgcagcctcgccaccgtcgcggccgcggtgatcgcgtgcatgggctacgcccgcttcgccgcgcggcgactccgcccgggcctgtcccgccttgcagcgttcctcccggtgctcgccgtcttgcctttcctcccgctcgccttccgtgcgctccacccgcgcggcatctccggcttcttcctcgcctgggccgccgaattcaaactcctgctcctcgcatgcggccagggcccgctcgatccgagcctcccgctgccctccttcaccgccatcgccaccttccccgtcacactacgggatcccaagagctccgcctcgaggccgggcctggggctcgtggagtccgcctccatggccgcgctgctcgcggccatcgtgtcgctgta

SEQ ID NO: 9204 - protein, 134 aa, Zea mays
  misc_feature: Ceres CLONE 379237-F
MATGDLRSLATVAAAVIACMGYARFAARRLRPGLSRLAAFLPVLAVLPFLPLAFRALHPRGISGFFLAWAAEFKLLLLACGQGPLDPSLPLPSFTAIATFPVTLRDPKSSASRPGLGLVESASMAALLAAIVSL

SEQ ID NO: 9205 - DNA, 462 bp, Zea mays
  misc_feature: Ceres CLONE 379262-F
  misc_feature: Encodes the peptide sequence at SEQ ID NO. 9206
aggaaaccatcatcaatcaaaaaatcaaaaacaaaagaagcaaacctcgtcgtcacgccatccctctccacctctcgtcttccagacgcctccaatctgggctcccagcggccagcgtctcggaaaagaggagcagcacggcacggcggcgatggcgaggaacgctccaataatatgctaacccgttctacccagtccaattagcagcctcccaaggagaaggagatccaatcctgcgggcgggcgtcccccgtatcccatccatcgatccgaatctcggaatctgcaggaccctgcggcgcggcttcttcgtggagaagaggttgctgccgaagccaccgccaggtagccatgtcgtcctccgtgctgagggctgcggccgacagggccattcgcaggcaggccctcacgctgacgaacgccgcggcgtccaggatccggcagctactcagcctaaggcaa

SEQ ID NO: 9206 - protein, 37 aa, Zea mays
  misc_feature: Ceres CLONE 379262-F
MSSSVLRAAADRAIRRQALTLTNAAASRIRQLLSLRQ

SEQ ID NO: 9207 - DNA, 410 bp, Zea mays
  misc_feature: Ceres CLONE 379268-F
  misc_feature: Pfam Name: Rib_5-P_isom_A Pfam Description: Ribose 5-phosphate isomerase A (phosphoriboisomerase A)
  misc_feature: SWISSPROT Homolog: EC 5.3.1.6 Ribose-5-phosphate isomerase
gcacaaactgcggctgctgtagatacgcgcgccgccactccaaggtccaagcctcccttgctcccgccaccgcccctcaccatgggcagcgcgccgcctctccgcagccgtctgggaatctgacgcaggacgagctcaagcgcgtggcggcgcaccgcssggtggagttcgtggagtccggcatgacgctgggcctgggcacgggttccacggccgcgcacgctggaccgcctgggcgacctcctccgcgcgggcgcttgccccgggggtcgccggcgttcccacctccctcaagacggaggcccacgccgcccgcgtcgggatcccgctgcttccgctcgacgccgcctcgggsccacatccgcctctccatcgacggcgccgacgwggtcgacccggacctcaacctc

SEQ ID NO: 9208 - DNA, 486 bp, Zea mays
  misc_feature: Ceres CLONE 379332-F
  misc_feature: Encodes the peptide sequence at SEQ ID NO. 9209
  misc_feature (139)..(139): n is a, c, t, g, unknown, or other
  misc_feature (339)..(339): n is a, c, t, g, unknown, or other
ctgttcccctcccaagaaaccccacatttgcatgggcaagcacctacctgccgccgccaccgccgccgccgccgccgcgkktcgctcgtacgcccgcagccttcgcgtcccatccgataccgccgmatccgccgggakncagctaagacgccgtctgccccctggatacacccaggaaatccgctgccgccgctgccgcgscagctccgggcgggccgaggtgcgggatttggcggcggcgtgcgggctagaggcggacgagagggttccgctcgcggaggtggtgtcggactgcacgaggcggtggttccaggacgcactcaaggaggcgcgcgccgncgacatcaccatgcaggtgctcgtcggccagatgtaccgcagcggatacggtgtcaacaagaacgagcacaaggcaagagtttgggatggagaaagcatcaagatatcggtctacagtctgggaaagttagcaataaacgtccatgg

SEQ ID NO: 9209 - protein, 151 aa, Zea mays
  misc_feature: Ceres CLONE 379332-F
  misc_feature (17)..(17): Xaa is any aa, unknown, or other
  misc_feature (32)..(32): Xaa is any aa, unknown, or other
  misc_feature (36)..(36): Xaa is any aa, unknown, or other
  misc_feature (57)..(57): Xaa is any aa, unknown, or other
  misc_feature (103)..(103): Xaa is any aa, unknown, or other
MGKHLPAAATAAAAAAXRSYARSLRVPSDTAXSAGXQLRRRLPPGYTQEIRCRRCRXSSGRAEVRDLAAACGLEADERVPLAEVVSDCTRRWFQDALKEARAXDITMQVLVGQMYRSGYGVNKNEHKARVWDGESIKISVYSLGKLAINVH

SEQ ID NO: 9210 - DNA, 469 bp, Zea mays
  misc_feature: Ceres CLONE 379347-F
  misc_feature: Encodes the peptide sequence at SEQ ID NO. 9211
gtgcttgattgawacgcacccagtccccgctcctgtttcgatctcccgaatcccgatcccgctaccggagcggaggcgatggcggcggcgcggcggtaaggttcccggtcttcgggctcgtgcggctgctgggcttggccgccgcggcggatcctcttctgggccgtccacttccgaggcggcatggcgctctccaccgaagaggagagcaagctccccatcttcaacgttcacccagtgttaatgctgatttggtttggtggccttgaatggcgamstcttttggctttataaaacttgtgccaggaaccaagaaactgaaaaagctagttgcaccttgccgtgcagttccttgccatgtttctgagtctaattgggtctgtgggvctgtatggaagtttccatgatgaaagaaaaatcgatcatttatatacacttcactcgtggttgggccttactttgcttcatc

SEQ ID NO: 9211 - protein, 36 aa, Zea mays
  misc_feature: Ceres CLONE 379347-F
  misc_feature (32)..(32): Xaa is any aa, unknown, or other
MALSTEEESKLPIFNVHPVLMLIWFGGLEWRXLLAL

SEQ ID NO: 9212 - DNA, 435 bp, Zea mays
  misc_feature: Ceres CLONE 379349-F
  misc_feature: Encodes the peptide sequence at SEQ ID NO. 9213
  misc_feature (125)..(125): n is a, c, t, g, unknown, or other
actactaatttctttacacggcttagggcgcaagakgcctctcctgctctacacactgccctagctagccgccgtttggagggcagtgttggcagctagcagcgacgacagatggagtgcagcgncaaggaggagcagcagatgcagatcgtgtgcgtgcgcacgcgtcgacgggcggcggcgaggaggtgggggagtgggcggacaktcgtcgcggtcggcgctgtcgctgttcaaggagaaggaggaggagatcgagcgcaagaaggtggaggtgcgggacaaggtgttctccatgctgggccgggtggaggaggagaccaaacgcctggccttcatccgccagagctggagctcatggccgaccccacgcgccgggaggtcgacgccatccgcaagcgcatcgacaaggtcaacaggcagctcaagccgctc

SEQ ID NO: 9213 - protein, 108 aa, Zea mays
  misc_feature: Ceres CLONE 379349-F
  misc_feature (5)..(5): Xaa is any aa, unknown, or other
  misc_feature (33)..(33): Xaa is any aa, unknown, or other
MECSXKEEQQMQIVCVRTRRRAAARRWGSGRTXVAVGAVAVQGEGGGDRAQEGGGAGQGVLHAGPGGGGDQTPGLHPPELELMADPTRREVDAIRKRIDKVNRQLKPL

SEQ ID NO: 9214 - DNA, 388 bp, Zea mays
  misc_feature: Ceres CLONE 379367-F
  misc_feature: Encodes the peptide sequence at SEQ ID NO. 9215
  misc_feature (265)..(265): n is a, c, t, g, unknown, or other
tcccgtctctagagtggctctttctctctccgtcaaatggctctcgcgtgcgcctctcacgcgtgccgctttctcctcgccggccagssaatctttccacgcccagccctaccatgccaaggtcggcgtggtggagttcctgaacggcgtcgggaaaggggtggaggcgcacgcgctgaasstggaggaggctgtgggcggcgacctccagaggctccttgaggcccgcacgctgcggctcaagaagctcggcatcccctgcaancatgckaaggctggatccacaacccgccagacaggccaakggcgctgaccggatggaggcctgttcgaccctcttcgctcacacgagacaagacgaaggccccgccgatagtctacgggacct

SEQ ID NO: 9215 - protein, 103 aa, Zea mays
  misc_feature: Ceres CLONE 379367-F
  misc_feature (29)..(29): Xaa is any aa, unknown, or other
  misc_feature (30)..(30): Xaa is any aa, unknown, or other
  misc_feature (60)..(60): Xaa is any aa, unknown, or other
  misc_feature (61)..(61): Xaa is any aa, unknown, or other
  misc_feature (88)..(88): Xaa is any aa, unknown, or other
  misc_feature (102)..(102): Xaa is any aa, unknown, or other
PVSRVALSLSVKWLSRAPLTRAAFSSPAXXSFHAQPYHAKVGVVEFLNGVGKGVEAHALXXEEAVGGDLQRLLEARTLRLKKLGIPCXHAKAGSTTRQTGQXR

SEQ ID NO: 9216 - DNA, 504 bp, Zea mays
  misc_feature: Ceres CLONE 379400-F
aacactctcacctcctctcattcaatactgtctctcagcctttttttttcatagtgtgtgcggccgatctatgcacctcacctttcccttgctgcagttggaggaagtgtgctgcaggtggaagaagagaggggagaagctggttcccctctccatatctctcctccccagctccctccccctctcatagatcgatcacacagcctgcaggcacagacaagagttaggctgttctacctgatcatatgaccctccagcaattctctcatccacacacaaactgaagcaagaattattgcttatctatatcctgtctgtcctttcctctatttcccccctcccctttctatttccattgtgcagcttgttattagtagatagcagtggatcgatgtgtgatggaggaaacaagctagctagctagctaccagctgamgcagcagggagaagaaggatagavagagagagagagagagaaaaccagtcttcttcatccatagtctc

SEQ ID NO: 9217 - DNA, 444 bp, Zea mays
  misc_feature: Ceres CLONE 379456-F
  misc_feature: Encodes the peptide sequence at SEQ ID NO. 9218
acgcgtccttctctctagaattttcagccatcgcccctcccaaatcctcttctccctcacgtctctttctctccatccaccgccgttctcatttcttgcacagggcagcagcacmagccgcgccctcttcctcctgcggcaggtcggcgacccatgcccctgctcttctcatggccgcctctcctccatcccctatccatcttctcccatgcaagaagccatggcaccccttctccccttgttttccatggaaaacccaagaacctactcctccccatggctgtgtctcctgtaggttttcctacaatcgcagcagcagcagatatggaatcacctctatgtcgtgcccacggcatgctcgatgaaatgtcgcagccagttacacctagatctatgcagccccatcccacgatgtcgtcgacccttggtgagatcccacaatgt

SEQ ID NO: 9218 - protein, 97 aa, Zea mays
  misc_feature: Ceres CLONE 379456-F
MPLLFSWPPLLHPLSIFSHARSHGTPSPLVFHGKPKNLLLPMAVSPVGFPTIAAAADMESPLCRAHGMLDEMSQPVTPRSMQPHPTMSSTLGEIPQC

SEQ ID NO: 9219 - DNA, 474 bp, Zea mays
  misc_feature: Ceres CLONE 379463-F
  misc_feature: Encodes the peptide sequence at SEQ ID NO. 9220
tatacagcagcgatgacatcgaagaggcacaaggatcacttgaaagagatgatgaggatgtgtattttgatgatgaatcagctgaggtggtaatatcttctttgcgtctgggagatgaccaggaaggctccctctttacaaattcaaactggttcacatttgatggagagagaggcattgatgaccgatcatctgcctctgttccttcatcatcccccaattctgaggagacatcactaaagactgaggaagctgatgatggtaaagtcattggcactgaggatgaaatggaaacagtgtatcttggaaatggtagtgttgaggaggtaaaagatgtagcagaatgtactgaacagccaaattgttgtactgaggaagagcgattgaaaawatgaagaagggatggaatggcatccaaatgcttcaaataacgataccgagatttattttggctcactagctgtcaaaaagact

SEQ ID NO: 9220 - protein, 129 aa, Zea mays
  misc_feature: Ceres CLONE 379463-F
YSSDDIEEAQGSLERDDEDVYFDDESAEVVISSLRLGDDQEGSLFTNSNWFTFDGERGIDDRSSASVPSSSPNSEETSLKTEEADDGKVIGTEDEMETVYLGNGSVEEVKDVAECTEQPNCCTEEERLK

SEQ ID NO: 9221 - DNA, 433 bp, Zea mays
  misc_feature: Ceres CLONE 379466-F
  misc_feature: Encodes the peptide sequence at SEQ ID NO. 9222
  misc_feature (149)..(149): n is a, c, t, g, unknown, or other
aaacccacacagcaagccagcagagcagaaagcagccgcagccccagcccccacaagacgaggcaacaatggcgctagaagcagccaccgccccccgcgcactcctcgccgcgtgcctcgtcctgctggtcctcggcggcggasycggntgcttgctatggaacttttgaggcgttcagatacaagatccctggattgctaaagatcagatacattgggcaaaccaccgttggcagcgctgcgatttttgggcttttcttgggggctgggagcttgattcactgtggaaaatcctactagtttgtttccctttttttttctgaagtctgaacacacctttgtcgatgggcttcagtgaaaactattcaatgcctgtttcatgtaacagctaatagctcagggttggaaaagaacaatcaagtttatgtccgag

SEQ ID NO: 9222 - protein, 33 aa, Zea mays
  misc_feature: Ceres CLONE 379466-F
  misc_feature (26)..(26): Xaa is any aa, unknown, or other
MALEAATAPRALLAACLVLLVLGGGXGCLLWNF

SEQ ID NO: 9223 - DNA, 327 bp, Zea mays
  misc_feature: Ceres CLONE 379482-F
  misc_feature: Encodes the peptide sequence at SEQ ID NO. 9224
  misc_feature (49)..(49): n is a, c, t, g, unknown, or other
ccatagctctccccctcctggttagtgtagtgagcgcasscgagtgcangttgagagtaccgagatggctgagggaagaggcagtgcaagggccatcgggccatggcgttcgccgttgcctgctgctactgctgcgtcgccatcgccgacgcrsscaccacctactacgtcggggacagcaacggctggtcctttcagcagccccagctggcccaacggcaagcacttccgcgccggagacactctcgtgttcaggtacatcccctggatccacaacgtgtgggccgtggacgaggacgggtacaacgggctgcacgacgccgccgg

SEQ ID NO: 9224 - protein, 87 aa, Zea mays
  misc_feature: Ceres CLONE 379482-F
  misc_feature (30)..(30): Xaa is any aa, unknown, or other
  misc_feature (31)..(31): Xaa is any aa, unknown, or other
MAEGRGSARAIGPWRSPLPAATAASPSPTXXPPTTSGTATAGPFSSPSWPNGKHFRAGDTLVFRYIPWIHNVWAVDEDGYNGLHDAA

SEQ ID NO: 9225 - DNA, 169 bp, Zea mays
  misc_feature: Ceres CLONE 379499-F
aataaactgtcatttataggagacggtacggkgacaccacacgctcccgcactctctctcaactcattggcagcagcaaccgcagccgcgagggccaagcaggggggacaaggaaaagggccgacgaagaggaaaaaggaagaacgcgtcgcggagccatggggcttgg

SEQ ID NO: 9226 - DNA, 440 bp, Zea mays
  misc_feature: Ceres CLONE 379508-F
  misc_feature: Encodes the peptide sequence at SEQ ID NO. 9227
gcctaggtttaggcttccagcggccgcagcctccacaccaagagcggaaggagatcgctggaagaggggggaggcgcggagatgagcgggagcgcgttcaacgcgttcaagtcgcgtgtgccggtggcgtggagtccccggctgtacatcacgctggtgcggggcctaccgggcacgcgccgcctccaccgccgcacgctcgaggccatgcgcctccgccgctgccaccgcaccgtcgagcaccgcaccacgccgtcgctgctcgggatgctcacccaggtgaagcgcctcgtcgccgtcgagaccgaggagatgtacaacgcgcgcaagcaggccgaggcggagaggcgcgcgcccagacccccgctcgtcgtctcccaccaccagccgccgccgcggagggtgctgctgcactgcgccatagcctctgggcatcagaa

SEQ ID NO: 9227 - protein, 119 aa, Zea mays
  misc_feature: Ceres CLONE 379508-F
  misc_feature (20)..(71): Pfam Name: Ribosomal_L30 Pfam Description: Ribosomal protein L30p/L7e
MSGSAFNAFKSRVPVAWSPRLYITLVRGLPGTRRLHRRTLEAMRLRRCHRTVEHRTTPSLLGMLTQVKRLVAVETEEMYNARKQAEAERRAPRPPLVVSHHQPPPRRVLLHCAIASGHQ

SEQ ID NO: 9228 - DNA, 440 bp, Zea mays
  misc_feature: Ceres CLONE 379530-F
  misc_feature: Encodes the peptide sequence at SEQ ID NO. 9229
aacgcagccaagaacaagagacaccgccgagcgagcgagsssggaggaagcaggtccaggaccaggagawaggaaaggaagcccagctctctctagcctggagccgagaagccgagggggcgaaggagcagcaaggcatggaggagcccgttccggctgatccccccaggattttctggaagtcaaggagatcaggttcaggaccgtgagatcaatgggctgaacgagcagctagaggaagactcccgcgtgctggagcttctgcagaagcagctggctgacgagcgcaggaagcggacagagatcgagaaggagaactccatgctccatgagcaggtcaccatgctgatgaacatgctcgacgagaacgagggtttcgacgaggacggagaggccccgccacccgattccttcgattaaacgttgttacagtactatcc

SEQ ID NO: 9229 - protein, 32 aa, Zea mays
  misc_feature: Ceres CLONE 379530-F
MLHEQVTMLMNMLDENEGFDEDGEAPPPDSFD

SEQ ID NO: 9230 - DNA, 352 bp, Zea mays
  misc_feature: Ceres CLONE 379552-F
  misc_feature (236)..(236): n is a, c, t, g, unknown, or other
  misc_feature (258)..(258): n is a, c, t, g, unknown, or other
gcgcaaaacacctcgccttttgtactcttgcgtctctgccctcgcgttatcgccttcgtcacgctcgctcgcctggctggcttgtgtgccttgccttgctcggcgtacgcgaacgcagcgagagggaggagcaaggaaatagagagagacagagagagagagagagaaaaaatcaagtcatccccctttcctctgagctcgttccatggagaactcttctcacaagcgggcgcggngaggcgggcgacctcgtcgggncggctgcggagaggagggctcgccgcacgsgacgccaagaggctgcggccgcagacctgctcgacatgctgggaggacgacacggacgcggccg

SEQ ID NO: 9231 - DNA, 182 bp, Zea mays
  misc_feature: Ceres CLONE 379559-F
  misc_feature (124)..(124): n is a, c, t, g, unknown, or other
accatttggacaccgatccatccatccatccatccagccccgtacgtgtctcgctggccgtccgtatatatagagagaggcatcggagattggccgccacgttgccatcgcgcgckgcgccgcngccaaggccaaccatgctggcgagggctcctcctccgcggccgtgctccagcgccgtc

SEQ ID NO: 9232 - DNA, 406 bp, Zea mays
  misc_feature: Ceres CLONE 379564-F
  misc_feature: Encodes the peptide sequence at SEQ ID NO. 9233
  misc_feature (319)..(319): n is a, c, t, g, unknown, or other
  misc_feature (323)..(323): n is a, c, t, g, unknown, or other
acacacagtcacacacacaccgtcctccctccttggtccttggctccccttgctaccttgccttcacagatctcccgctccccaacagaactgtcacgtctcgacgcccgggggccgtggtattacggctcgtcgcggctcggcggtggtggcgcgcacgtgaccggatcgagcagcggatggacggcggcggcgggctgggcggcctgcggtggaccgcggaagaggcgtcgacgatcggaggcatcgcacggtgtcgctgctgcactccttcatccccacgcactggctccccttctccatcgtcgcgcgcgcgcantggnccgctctcccgcacccttctcgtcactgcatttggaggtgttcttcatgttgtttctacggctcttcttggggataactgcag

SEQ ID NO: 9233 - protein, 75 aa, Zea mays
  misc_feature: Ceres CLONE 379564-F
  misc_feature (47)..(47): Xaa is any aa, unknown, or other
MDGGGGLGGLRWTAEEASTIGGIARCRCCTPSSPRTGSPSPSSRARXGPLSRTLLVTAFGGVLHVVSTALLGDNC

SEQ ID NO: 9234 - DNA, 426 bp, Zea mays
  misc_feature: Ceres CLONE 379614-F
  misc_feature (215)..(215): n is a, c, t, g, unknown, or other
  misc_feature (222)..(222): n is a, c, t, g, unknown, or other
  misc_feature (232)..(232): n is a, c, t, g, unknown, or other
gagcggccaccgcacgcagctagcagtccaaggcagagctctcacgcggacggcggacctggccacctggggggcgcggacggagccttcgcttttcccccctcccctccctttcgaacgactaccgaggaggcatccgaggtggccagccacgatgatggccgcggcggcgctgaggccgcacaagtcttcgccggcgcgcgtgcccacgssgntgcgkcncgcgctctgncgcctgcttcctcgtcggcgtcggcgtcgtcaacaggtactggcctgttcctgagcctcatcccggttgcccagacaaggctggccctgaccactcgagggccgtgttgaaccaagcgtcacagactcgcgaagtcgtcatggcgttggacaagacgatatccgacatcgagatgcgcctggctgcggctagag

SEQ ID NO: 9235 - DNA, 247 bp, Zea mays
  misc_feature: Ceres CLONE 379630-F
  misc_feature: SWISSPROT Homolog: EC 3.1.27.1 Ribonuclease T(2)
  misc_feature (177)..(177): n is a, c, t, g, unknown, or other
atctcccacctcgatccctgcactgcaagcaacaaagttctactctgtccatctagctcccaaagaaccaatccgtaccagcgctatccggccggccdtggcggcggcgcgcggctctccctgcmcmtmgtcctgctggtcgtccatggmcgtcgccgggcgcgcggcggcgcaggnactacgacttcttctacctcgtgctgcagtggccgggggctcactgcgacaccaagcagagctgctgcta

SEQ ID NO: 9236 - DNA, 450 bp, Zea mays
  misc_feature: Ceres CLONE 379660-F
  misc_feature: Encodes the peptide sequence at SEQ ID NO. 9237
agatacggatgtctccgcccgcacatccacttcacaaacgaaaacccgcagcaaacgctagcagcggcggcgcssgcagttggtagccgcgaccgagacacggcgggtgacctgccccgccgcagtcggggtgtatgtattaccaccgccagadttccaggagacgaggaggcgccgatccgtagcggcgatatcgtggagccgctggtctcacgccgcaccgagacaatggcagaccagttagggtcttacactattagatcccatggaatgatattggcaaggttgcacatgtatgactggataatacttctcctccttgctgtcatagacgggctgttgaatataattgaaccatttcaccgttttgttgggaaagacatgatgactgacttgagatatcctatgaagggcaatacagtgccattttgggctgttccactgattgga

SEQ ID NO: 9237 - protein, 74 aa, Zea mays
  misc_feature: Ceres CLONE 379660-F
MADQLGSYTIRSHGMILARLHMYDWIILLLLAVIDGLLNIIEPFHRFVGKDMMTDLRYPMKGNTVPFWAVPLIG

SEQ ID NO: 9238 - DNA, 373 bp, Zea mays
  misc_feature: Ceres CLONE 379668-F
  misc_feature (129)..(129): n is a, c, t, g, unknown, or other
catcctaatcgaaaaaaccagctgcggagggaggaaccctagcggaacactgtgcaggtgacggcggcgcgctaccggtgacggggatacggcggcatcgtcccctcctccatccccggcgcggcggcnagcagcggtcctgcagggacgtgctccagtctccagaatccagattcagagcttgtccctgttttctggtgtgctctgttgtactgtagcctgtagccagggcaaattaaagctacaatgcaggcttcttactatgcaaaggatcttttcggtttgaagtccagttgaccgaagttggaaaatacttctgatacttacagatttcacagaggtcttgtttattttctactattttccttcaagc

SEQ ID NO: 9239 - DNA, 369 bp, Zea mays
  misc_feature: Ceres CLONE 379688-F
  misc_feature: Translation starting site: 73
  misc_feature: SWISSPROT Homolog: EC 1.1.1.1 Alcohol dehydrogenase
  misc_feature: SWISSPROT Homolog: EC 1.1.1.284 S-(hydroxymethyl)glutathione dehydrogenase
  misc_feature (137)..(137): n is a, c, t, g, unknown, or other
gtagtcctaggcactttcatctgtggcctctgcgttcgagatcgatctgagctggcaccgtcccacttcgccatggcggaggaccggagccccaagcccatccactgcaaagcggcggtgtgcagagccgccggcrngccactcaccatcgaggagatcgtcgtcgacccgccgaaagcgtacgagatccgcatccggggtcgtctgcacctcactctgccacaccgatatcaccttctggaaagctaaggtggcaccggtgtttccaagaatactagggcatgaggcgtacggggtagtggagagcgtgggggagcacgtkgagggcttcgcggcgggggacaccgtggtgcctgacgttcctggggc

SEQ ID NO: 9240 - DNA, 474 bp, Zea mays
  misc_feature: Ceres CLONE 379691-F
atcttcccaaaccatatctttctagtcttgtcgtgcccatgtttctcgcctacgcgtacgccagttcccttcactctattcctgcgcatgaaggagttacccagatgagaagttccccaggcgctgcagcaacaggagaggaggagcacggttcgtcgtgcgcagattgcgatgtattcctgagcttcaaggagtcgacgatcaagttttggcgaccaagtgatcaggctcttcgagttttacgaggctgaagatcctgagcatctgtttagtgaaggttgtccatgttgcaaccgctgctcaggagaagatgaagccatggaggaagacttccaggagttccaagagtacgacgagttttaggcgtgggttagcggcaacccctagttggctgcctatgaaggccgcatgtatctacgtttcattttcacattttgattattgttaaagactatgtggatgtctcagacatca

SEQ ID NO: 9241 - DNA, 657 bp, Zea mays
  misc_feature: Ceres CLONE 379699
  misc_feature: Encodes the peptide sequence at SEQ ID NO. 9242
acaaaaagatctaaaatacagaaaaaaaaagttgtccggaacctacgaggaaggcttaggcgttttcctcgttcgctcgccgcggcgtcggacgatgcctctggggctgacgctggggtcgctggggcgggctatgcggcagaagcggccgtcctcgctcgacatcctctcctccaagcgggcgccgcgggactactacaagggcaagaactgcaagcccaccgggttccacacgcgcaaaggcggatacgtggttgtcgatgaaaagctgccaaggttcgcagttcctgacaatgactcatttcaagtgcaccagggacctcgcagcgtcgacgacatcctcggcctctctaacttcagcacagactactgagagcaggagctgattgtcatcggactgctctagccatttgcaggaagcgagcgaccaagccttgcagtattgcggctacgttttcctggagagtgcccgtgttcagaggattagtcattagtgtcggcgtcttagcagctacaggtggtcatttcagatgtatttttctctctctctctctttatcttgtgtaagggcaaacattggcgtaaggccctgtcggccctgtctgttttcttccagaattatataatctaacttatagatcaaaaaaaaaaaaaaaa

SEQ ID NO: 9242 - protein, 92 aa, Zea mays
  misc_feature: Ceres CLONE 379699
MPLGLTLGSLGRAMRQKRPSSLDILSSKRAPRDYYKGKNCKPTGFHTRKGGYVVVDEKLPRFAVPDNDSFQVHQGPRSVDDILGLSNFSTDY

SEQ ID NO: 9243 - DNA, 447 bp, Zea mays
  misc_feature: Ceres CLONE 379703-F
  misc_feature: Encodes the peptide sequence at SEQ ID NO. 9244
acttgtcagttctcatcccatgcacgcatcggcatatatcaatggcgagctcctcctcctccgagcaccgagctcaaacacacatcaagaaagcaagaaagaaaagactgtagctagctagccaccgcgcgcgcgcacgagcactctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgtgcaccaccgggccggcgggttccccagtgtggcactgacgaacacgcttcagcgccgtcgtcgttctcgccgctatcttgtcgtcgcctcggcgacgagagccgaacaggaggccgcccctgtgacgatcgaggacgtggacctcagctctcatcaggccgcgg

SEQ ID NO: 9244 - protein, 69 aa, Zea mays
  misc_feature: Ceres CLONE 379703-F
MAATVSSCLSLVPTVHHRAGGFPSVALTNTLQRRRRSRRYLVVASATRAEQEAAPVTIEDVDLSSHQAA

SEQ ID NO: 9245 - DNA, 418 bp, Zea mays
  misc_feature: Ceres CLONE 379728-F
  misc_feature (387)..(387): n is a, c, t, g, unknown, or other
aaacctgggcgtattcctctctctttcctcatcctcatccgagtggctctctccttgtgctgtggcggcggcggcgccggctctgctcggacggactccaccgaagcgctcggctcccctcgggctgcacctgcgacggccggccctctgactgcaccgacggckccgccccccctcggcatccaccagcggtkcccggctccaagtccccgccgccactccgaccgtcctctagcagctccgtccggtggtccggccagctgcctagctccctccgaccgttccggccagcaccgcctcctgctcgcggtctcgcccagctcctccgccctccgctgagacgcagatcttggtgcggcagggcaccacagaggctgtgcgtgtgtnggtggcctggtgctagcaaccgaggagcact

SEQ ID NO: 9246 - DNA, 397 bp, Zea mays
  misc_feature: Ceres CLONE 379730-F
  misc_feature: SWISSPROT Homolog: EC 2.3.1.170 6'-deoxychalcone synthase
  misc_feature: SWISSPROT Homolog: EC 1.1.1.149 20-alpha-hydroxysteroid dehydrogenase
  misc_feature (282)..(282): n is a, c, t, g, unknown, or other
gcagatggagtacgtggacctgtacctgatccactggccggtgtccctcaggccggccggcgggsscccaagttcccgaacaggaaggaggacgcggtgccgctggacgtggcgggcgtgtggcgcgccatggaggagtgccagcgctgggcctcgccagggcgatcggcgtcassaacttcaccaccaggcacctggacaaggtcctggccatcgccgcggtcccgcccgcgttgaaaccaggtggagctgaacccggcgtggcagcagcggacgcyggtngcgtactgcgtcgaccggggcgtccacgtcgccgcctactcgccgctgggaagggcagaactgggacggtcggggcagcgcgtgctcgactcggaggtgctcgcggagatagcca

SEQ ID NO: 9247 - DNA, 330 bp, Zea mays
  misc_feature: Ceres CLONE 379731-F
  misc_feature: Encodes the peptide sequence at SEQ ID NO. 9248
aaccaaaagcaaagaagagacgaabsgtccgatcgatctcagcaactaagcaggtaggtaggcatggcggccgagaaggagggcgcggtggtgaccaagggccacgacgaggggatgaaggcggcggcggcgctgctggaggagttcgggctcccgccggggctgctgccgctggaggacgtgacggaggtggggttcgtgcgggccaccggctacttctggctcgcgcrcaagaaggtggagcaccggtttcccctgcaatgtaatcatgtcgtgactctcaagggattattccgctctgctcttatggtcagaaaaaaaaaaaaaaaa

SEQ ID NO: 9248 - protein, 89 aa, Zea mays
  misc_feature: Ceres CLONE 379731-F
  misc_feature (56)..(56): Xaa is any aa, unknown, or other
MAAEKEGAVVTKGHDEGMKAAAALLEEFGLPPGLLPLEDVTEVGFVRATGYFWLAXKKVEHRFPLQCNHVVTLKGLFRSALMVRKKKKK

SEQ ID NO: 9249 - DNA, 439 bp, Zea mays
  misc_feature: Ceres CLONE 379735-F
  misc_feature: Encodes the peptide sequence at SEQ ID NO. 9250
aggatgagcaaggaggatgtgctcaaggtgcagactttgatgctgagagtgaacatacactgtgacgggtgcgagawgaaggtcaagaagaccctccacaagatcgacggtgtctatcagagcagcatcgacgcggaacaggggaaggtgacggtgtccggcctgctggatccggacaccatcatcaggaagctcaacaaggccggcaagccgcccagctgtggggctccaagcctggcgtccctcagaacggccatggcggcggcaaaggccagcctaaggacgccggcggtggcaagggccattccaaggatgccggcggtggcaaggcccaaaagggcggtgcgggtggcggcggtcacaagggtgccggtgccggtggggccaaggatcctaagatgggtgatgccgcagccgacgccgcagcagctccagcagc

SEQ ID NO: 9250 - protein, 145 aa, Zea mays
  misc_feature: Ceres CLONE 379735-F
  misc_feature (13)..(73): Pfam Name: HMA Pfam Description: Heavy-metal-associated domain
  misc_feature (25)..(25): Xaa is any aa, unknown, or other
MSKEDVLKVQTLMLRVNIHCDGCEXKVKKTLHKIDGVYQSSIDAEQGKVTVSGLLDPDTIIRKLNKAGKPPSCGAPSLASLRTAMAAAKASLRTPAVARAIPRMPAVARPKRAVRVAAVTRVPVPVGPRILRWVMPQPTPQQLQQ

SEQ ID NO: 9251 - DNA, 733 bp, Zea mays
  misc_feature: Ceres CLONE 379746-R
  misc_feature (705)..(705): n is a, c, t, g, unknown, or other
cgattgggtaccgggccccccctcgaggtcgacggtatcgataagcttttttttttttttttttgtgcatgataaacatcgatagataggtaggctttgaatttttgcaacgagcaaaaaaaaaaagaggggagagaaatacaaaggcgcggaggtattcattctctagcgcctcaaaaaagcgcaaacgctcgcaagcatacactgatgtctgatcctcctcgttccacaggcggaaaaaaaatgcacgcgggcagttgagcacgaaacaacttcagttagcaggcagactagcggtaagaataatgcactgcaccagccgaggcatatgcatgaacgaaataataatacagacggctgacggctctgacacggtcgtctcctgttgggttgttcaccagtaagaataggaggaggacgtggctctgggtctcttgctgctgcacatcgccatctgcggcatcctgctgcccttgccctcgcagaagatctgctccggcgccatccacgcggagtagtagccgtcctgcgggccgcctgtccgagctagccctcccgcctgatacgacacgtctgcggagacgccaatggcagttgcggcggcggtctcgtccaccaggaagtcctcgacatgccacccgggcagcgtcttggtcaggtactcggagatgctgctgctgctgctgtcgttctcgtcctcctccnacggcggcgggcgcgcggcgggctctgc

SEQ ID NO: 9252 - DNA, 374 bp, Zea mays
  misc_feature: Ceres CLONE 379754-F
  misc_feature: Encodes the peptide sequence at SEQ ID NO. 9253
  misc_feature (19)..(19): n is a, c, t, g, unknown, or other
  misc_feature (189)..(189): n is a, c, t, g, unknown, or other
accaggaggcacgagccgnccccacctctcagccccaattccatctcctccgattcgaaatgtcttcctcatcatccatctcgtcctctacaacctcgtccccgctccccaaaccctaaaccctcccccaccacacgtcaccgccgcccctgatctctccatctccaccgccgtcgcgsstcgccagancccgtcatccgcggccgggttcgccgcccggtgggctcctccgccgaccgccacgccaaggtcgccggccgcggccgccgggtccgcatcccggccatggtggcggcgcgcgtcttccagctcacgcgtgaactcggacaccgcaccgacggagagaccatcgagtggttgctgcgccaggccga

SEQ ID NO: 9253 - protein, 29 aa, Zea mays
  misc_feature: Ceres CLONE 379754-F
  misc_feature: The sequence is a functional homolog of SEQ ID NO 1050 in the 10/225,066 US patent application
  misc_feature: The sequence is a functional homolog of SEQ ID NO 2690 in the 10/374,780 US patent application
  misc_feature: The sequence is a functional homolog of SEQ ID NO 1222 in the 11/479,226 US patent application
  misc_feature: The sequence is a functional homolog of SEQ ID NO 136 in the 10/225,068 US patent application
  misc_feature: The sequence is a functional homolog of SEQ ID NO 162 in the 10/374,780 US patent application
  misc_feature: The sequence is a functional homolog of SEQ ID NO 550 in the 10/412,699 US patent application
  misc_feature: The sequence is a functional homolog of SEQ ID NO 970 in the 10/225,066 US patent application
  misc_feature: The sequence is a functional homolog of SEQ ID NO 2426 in the 10/374,780 US patent application
  misc_feature: The sequence is a functional homolog of SEQ ID NO 246 in the 10/225,068 US patent application
  misc_feature: The sequence is a functional homolog of SEQ ID NO 554 in the 10/412,699 US patent application
  misc_feature: The sequence is a functional homolog of SEQ ID NO 2782 in the 10/374,780 US patent application
  misc_feature: The sequence is a functional homolog of SEQ ID NO 680 in the 10/225,066 US patent application
  misc_feature: The sequence is a functional homolog of SEQ ID NO 1391 in the 10/374,780 US patent application
  misc_feature: The sequence is a functional homolog of SEQ ID NO 166 in the 10/225,068 US patent application
  misc_feature: The sequence is a functional homolog of SEQ ID NO 220 in the 10/374,780 US patent application
  misc_feature: The sequence is a functional homolog of SEQ ID NO 316 in the 10/666,642 US patent application
  misc_feature: The sequence is a functional homolog of SEQ ID NO 1392 in the 10/374,780 US patent application
  misc_feature: The sequence is a functional homolog of SEQ ID NO 1229 in the 11/479,226 US patent application
  misc_feature: The sequence is a functional homolog of SEQ ID NO 226 in the 10/225,066 US patent application
  misc_feature: The sequence is a functional homolog of SEQ ID NO 2424 in the 10/374,780 US patent application
  misc_feature: The sequence is a functional homolog of SEQ ID NO 182 in the 10/225,068 US patent application
  misc_feature: The sequence is a functional homolog of SEQ ID NO 372 in the 10/374,780 US patent application
  misc_feature: The sequence is a functional homolog of SEQ ID NO 941 in the 11/479,226 US patent application
MVAARVFQLTRELGHRTDGETIEWLLRQA

SEQ ID NO: 9254 - DNA, 393 bp, Zea mays
  misc_feature: Ceres CLONE 379758-F
  misc_feature: Encodes the peptide sequence at SEQ ID NO. 9255
  misc_feature (340)..(340): n is a, c, t, g, unknown, or other
  misc_feature (346)..(346): n is a, c, t, g, unknown, or other
atctggctagtctacagctagtacacgacccacggcaatcgtcgtcgtggtcgtggcggattggagttgacagttgcgataccactagtactagctcgctcgctcgttctcagaactgatcgctgtgaggagtatgccgtcgctgtggccaacgaggaagaagcgggcgcgaggctcggcggtccggtcgtggtcgcgccgccgcggggagcaagaaatcatcgtcgtcgtcgtcgctgggggcgctgtggcggcggatggtcgggccacgcagggggacccggacccggactcggacccgtgcccgggggaagaagccggggctgctctcgcgcgccgnggttgncttctcctgcggccgccgctcctactgatcgatgccatccggcgcgg

SEQ ID NO: 9255 - protein, 86 aa, Zea mays
  misc_feature: Ceres CLONE 379758-F
  misc_feature (71)..(71): Xaa is any aa, unknown, or other
MPSLWPTRKKRARGSAVRSWSRRRGEQEIIVVVVAGGAVAADGRATQGDPDPDSDPCPGEEAGAALARRGXLLLRPPLLLIDAIRR

SEQ ID NO: 9256 - DNA, 165 bp, Zea mays
  misc_feature: Ceres CLONE 379789-F
ctcaaatcccagacgccacgccacccaacacatacaaacacacgcacgcgcgcgcgccttcccgctgtttccgcaaaacaaaggaaacgaaggagaggwggccattggcgccgagaacgttcagagaaaaccatggcaccggcggcggccgcttgccacggggct

SEQ ID NO: 9257 - DNA, 365 bp, Zea mays
  misc_feature: Ceres CLONE 379805-F
  misc_feature: Encodes the peptide sequence at SEQ ID NO. 9258
  misc_feature (27)..(27): n is a, c, t, g, unknown, or other
  misc_feature (93)..(93): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
acacacacagtacgtacaagcctcatnagctcgctagcatagcagcaaccagcaatggactccaccaagttatccgcgctgctggcgctcgcnatgctcgcgctctcctcgtcgccgctcgctcttgcatgggagaaggcggannnaggtgcaactcgtgcgagtycggctcgccgccgtcgaccgggtccccctgcccccgatcagcataccgtcagtccccctgcccccaatcagcataccgtcagtcccactgccccctgtcagtataccgtcggtccccatcccaccggtcaccgagctgcccccagtcgtcggactgccgccggtgacccttcctcccattccgatcatcggaggaagcc

SEQ ID NO: 9258 - protein, 67 aa, Zea mays
  misc_feature: Ceres CLONE 379805-F
  misc_feature (6)..(6): Xaa is any aa, unknown, or other
  misc_feature (13)..(13): Xaa is any aa, unknown, or other
MGEGGXRCNSCEXGSPPSTGSPCPRSAYRQSPCPQSAYRQSHCPLSVYRRSPSHRSPSCPQSSDCRR

SEQ ID NO: 9259 - DNA, 529 bp, Zea mays
  misc_feature: Ceres CLONE 379809-F
  misc_feature: Encodes the peptide sequence at SEQ ID NO. 9260
agggctgggcaaggcgccgccgcagctctggcactggagaccggccgactgcaccgccgcgccgccgccggctggttgccacttcgaccccgccaccgcgccacaactgcttccgtgcaagtctacagccagccagccagccaggcgttgttcacccgtgctcgctcgatgcagccgccccatgccagcaggtccggtcccaactcgtcgccacccgtcgtcgtcgccggctcgtcgtcatcggctccggcgtctcggcaacaacaatcggaggcgcctcgcggtcgaactctcgcgccgtggccccggtttgcagcccctcgctctcttctaagatttggagggtgaaataaaaactataagtgaagctatgaatgctatggaggtggacgatgaggttgcgacttgagatcttcaagcaagcatggattgcttgcactatcttatgtcattttaaaaactatcctttattgtaatagtctattgtgttgaacttgtccttgtgctatgttagactcttggtgatgtg

SEQ ID NO: 9260 - protein, 50 aa, Zea mays
  misc_feature: Ceres CLONE 379809-F
MPAGPVPTRRHPSSSPARRHRLRRLGNNNRRRLAVELSRRGPGLQPLALF

SEQ ID NO: 9261 - DNA, 239 bp, Zea mays
  misc_feature: Ceres CLONE 379840-F
  misc_feature: Encodes the peptide sequence at SEQ ID NO. 9262
  misc_feature (35)..(35): n is a, c, t, g, unknown, or other
  misc_feature (37)..(37): n is a, c, t, g, unknown, or other
  misc_feature (69)..(69): n is a, c, t, g, unknown, or other
  misc_feature (103)..(103): n is a, c, t, g, unknown, or other
tccccacaccaagaaagaatcacacaacagcmgcncnrdaacssaaacacacctcaacaagcagagcanagacccgggattcgccggcgcggtassagagcgngagatggacgggaggatgttcggtctcgagacccccctgatggtggcgctgcagcaccttctggacgtgcccgacggcgacgcggccgggcggcgacaaggcgagtggtgccgcggcgggcgcgggcccacgcgca

SEQ ID NO: 9262 - protein, 44 aa, Zea mays
  misc_feature: Ceres CLONE 379840-F
MDGRMFGLETPLMVALQHLLDVPDGDAAGRRQGEWCRGGRGPTR

SEQ ID NO: 9263 - DNA, 1079 bp, Zea mays
  misc_feature: Ceres CLONE 379843
  misc_feature: Encodes the peptide sequence at SEQ ID NO. 9264
acagcgcgcgagaaacccacccccgtcgccgtcgtcggcatccgccgccgcaggagaagcaccaccaccgcgggccatggacttcttccccgaccgggcgttcgtgcggctgcggaaccgcgcgtacggcacgtacctctacgccgacgacgacggcgcgggcgtcatcctgaagccgcagcgcggctccctgcaaacggcgtggcaggtgcaccgggtatggcgccacgaccgcatctacatcctcctccacagcgccgcctacggccggtacctcgccgtctcgcgcgtcacgatgtgggtcgacacccgtcaccatgcgaacctcacggtccagggcgtctacgagaccccggagcaggacgacgtcctctgggaggctgcctatgtggacaacgtccacgtcgtcatgctccaagcctctcaccgtcttctccgcgccagcacccagaacaccaccttcttcagatacgtcttcgtcgatcaccccggccattattacggcaccatgatgcattggacggtcgagtccattcccgcgagaccactaccatgtccatccgcctttcccatcccagtcccaactgaccagaatgccacttctgctcgtatgatcttatacagacgagcagatgattacgggaacgtcaacccgctctccaggagaagatgcaaattcttcggctactcactgttgcgactgagagcccacctagcgagtctgctcaaggaaccgatccaccgcatcacgttatgtgtgcgagccggttcccaagggcgaccgacccctttggtcatcgatctgccttccaaccatcaaaacatggagatcattgtcctcaccaccttgtcaccagcggctttggcattgtgtcacccagatgttgatgcacaatagaagaatacagaacgaagcaggacttctaacaacaccacggttcatctcttcagaatccacctattgctgttacgaataccatgggtgaacgattttaaacagtttcattgtttgtaattgccaactatgtatctaaaggtgataacaagaattggctcctttctcaaaaaaaaaaaaaaaa

SEQ ID NO: 9264 - protein, 273 aa, Zea mays
  misc_feature: Ceres CLONE 379843
  misc_feature (1)..(130): Pfam Name: DUF569 Pfam Description: Protein of unknown function (DUF569)
MDFFPDRAFVRLRNRAYGTYLYADDDGAGVILKPQRGSLQTAWQVHRVWRHDRIYILLHSAAYGRYLAVSRVTMWVDTRHHANLTVQGVYETPEQDDVLWEAAYVDNVHVVMLQASHRLLRASTQNTTFFRYVFVDHPGHYYGTMMHWTVESIPARPLPCPSAFPIPVPTDQNATSARMILYRRADDYGNVNPLSRRRCKFFGYSLLRLRAHLASLLKEPIHRITLCVRAGSQGRPTPLVIDLPSNHQNMEIIVLTTLSPAALALCHPDVDAQ

SEQ ID NO: 9265 - DNA, 186 bp, Zea mays
  misc_feature: Ceres CLONE 379863-F
  misc_feature (79)..(79): n is a, c, t, g, unknown, or other
acggctctcgtttccgcccgcgccacccgccakgtcgtccccgccgcgggggcagcccgccaccgccgccgtgccggtncgcggccgccacgtccccgcagttgcctgcgcgttcccacacgctcccccgcgcgtttcctcgccacatcctctccccgtgccatagtggcagcaccggcgcccccg

SEQ ID NO: 9266 - DNA, 344 bp, Zea mays
  misc_feature: Ceres CLONE 379864-F
  misc_feature: Encodes the peptide sequence at SEQ ID NO. 9267
  misc_feature (90)..(90): n is a, c, t, g, unknown, or other
  misc_feature (185)..(185): n is a, c, t, g, unknown, or other
  misc_feature (237)..(237): n is a, c, t, g, unknown, or other
  misc_feature (334)..(334): n is a, c, t, g, unknown, or other
aagaactgtaaaaggtacgaggggccaaacaggaaaagtgagcccaaaccctagacccatggaagcgtggccgcctctagcccccgckgnggccgcagcssacttccggtcgctgcctccgacgatgcggcgttcactcccgccggttccggggcgtggggaccagcggcaacggcgcasggganaggccgtggagcaggattcagcggcgcaggcggtgagccgcatcgtggcganctgcgccaactccagcggcgtggcggtcgcgttggtggacgccaacgccgtttatctccggcgcccccgccctctccacatccgcgggggcgccttntcaccgtgcc

SEQ ID NO: 9267 - protein, 95 aa, Zea mays
  misc_feature: Ceres CLONE 379864-F
  misc_feature (11)..(11): Xaa is any aa, unknown, or other
  misc_feature (15)..(15): Xaa is any aa, unknown, or other
  misc_feature (41)..(41): Xaa is any aa, unknown, or other
  misc_feature (43)..(43): Xaa is any aa, unknown, or other
  misc_feature (60)..(60): Xaa is any aa, unknown, or other
  misc_feature (92)..(92): Xaa is any aa, unknown, or other
MEAWPPLAPAXAAAXFRSLPPTMRRSLPPVPGRGDQRQRRXGXAVEQDSAAQAVSRIVAXCANSSGVAVALVDANAVYLRRPRPLHIRGGAXSPC

SEQ ID NO: 9268 - DNA, 496 bp, Zea mays
  misc_feature: Ceres CLONE 379885-F
  misc_feature: Encodes the peptide sequence at SEQ ID NO. 9269
acgactggttggaaggaggagggagtagtagtagtaaaaccaggtaggtgtggctggctcgtgcagcggcggtaggtggcagtgagagcgatgagcgcggcggcggcggcgagctcggtcaccaagttcatcaagtgcgtcacggtcggcgatggggccgtcgggaagacctgcatgctcatctgctacacctgcaacaagttccccacggattacatccccaccgtatttgacaacttcagcgccaatgtctccgtgggtgggagcatcgtcaacttgggcctctgggacacggcaggccaggaggattacagcaggttgaggcctctcagctacaggggtgctgatgtgttcatcctctccttctccctggtcagcagggcgagctatgagaacgtcctcaagaagtggatgccagagcttcgccgattttcacctactgttcctgtagttcttgtttggaccaaactagatctccgtgaagacagatcttacc

SEQ ID NO: 9269 - protein, 135 aa, Zea mays
  misc_feature: Ceres CLONE 379885-F
  misc_feature (15)..(134): Pfam Name: Ras Pfam Description: Ras family
MSAAAAASSVTKFIKCVTVGDGAVGKTCMLICYTCNKFPTDYIPTVFDNFSANVSVGGSIVNLGLWDTAGQEDYSRLRPLSYRGADVFILSFSLVSRASYENVLKKWMPELRRFSPTVPVVLVWTKLDLREDRSY

SEQ ID NO: 9270 - DNA, 1070 bp, Zea mays
  misc_feature: Ceres CLONE 379886
  misc_feature: Encodes the peptide sequence at SEQ ID NO. 9271
aaggaaagctctgcagctcttaacatcaagcagacccggccaggccagcaccagccgcagcaatgacgtccatgacggcagctacagacgtgaagccggcgccggccgctggcggcccgcagctgaagctgctggtggacaggcgttcgcggcgcgtgctgtacgcggaggcccgcaaggatgcggtggacttcctgatcggcctgctgcgcgtgcccgcgggcctcgcggcgcgcgcactggccaagcgcggcgagcccgcgccgggctccctgggctcgctctacgcgggcgcgctggccctagacgacgccttcttcgtctccagctcgcccaaccgcgacgcgctgctcagcccctcgacgctgccctccgccgcgctcccgctgctgctcggcgagggcgcggtcccgcctgcgccggcgcctcccccgccgcagcggttcttccggtgcaacgcgtacgcgcccccgtgccgcgggaacccgacgaacgtgacggacgtggcgggcctgccgtgcccggcgtgccggcagccgatgaccatggagatgcggctgccgcccggggacgcgcacggcaagcagctggcgcttgcgcgggcgcaggaggccgcggggctgggcgccggcgggtacgtgaaggaggtggtgacgtacctggtgatggacgacctcaccgtggcgcccatgtccaccatctccgccatcatgctgctcaagaagttcgacgtcaaggactgctccgcgttggaggagacgaccgttgagctcggcacaaaagaggccgtgatgctcctcaaggcgtcgctgcagtcgtcgacggcgctgacggatgtcttcagcggtggcgtttcgattgacaggattagcggttaatgagggagtcgtcgaacatgaacatcgttatgatcagtcaatgtgtatgtacataaagcatgcgaacgaatcagagcaaccatgatctcctaataatttgaaacttcagtgttaatgtgtaacggtgtatggatgactatgattgcgaaccaaaataatgcagtaaaatgaatcaaaaaaaaaaaaaaaaaa

SEQ ID NO: 9271 - protein, 271 aa, Zea mays
  misc_feature: Ceres CLONE 379886
MTSMTAATDVKPAPAAGGPQLKLLVDRRSRRVLYAEARKDAVDFLIGLLRVPAGLAARALAKRGEPAPGSLGSLYAGALALDDAFFVSSSPNRDALLSPSTLPSAALPLLLGEGAVPPAPAPPPPQRFFRCNAYAPPCRGNPTNVTDVAGLPCPACRQPMTMEMRLPPGDAHGKQLALARAQEAAGLGAGGYVKEVVTYLVMDDLTVAPMSTISAIMLLKKFDVKDCSALEETTVELGTKEAVMLLKASLQSSTALTDVFSGGVSIDRISG

SEQ ID NO: 9272 - DNA, 396 bp, Zea mays
  misc_feature: Ceres CLONE 379896-F
  misc_feature: Translation starting site: 58
  misc_feature: SWISSPROT Homolog: EC 2.7.11.1 Non-specific serine/threonine protein kinase
gatcgcctcgctgtgttgcactgctaggtagccagctcgtttcctcccccaacccaaatgggcgactccaccgccaccaacccctcctcgccgaccgcagccatggatcccgactccgaggtcgtcttcgacttcccgccctacctctgccaatacaagagcggccgcatccaccgtcccggcggcgcccccaccgtcccagctggcacggacccagccaccggcgtcgtgtccaaggacatccgcgacggtcccgcctccgcgcgcgtctacctccctcccggcgccgcsscaagatcccggtggtcgtctacttccacggcggcgggttcgtggtcggctcgccagcgcggccgggcacgcacaactacctcaacgacctggtcgcccgctcgg

SEQ ID NO: 9273 - DNA, 474 bp, Zea mays
  misc_feature: Ceres CLONE 379942-F
  misc_feature: Encodes the peptide sequence at SEQ ID NO. 9274
agtctccacccaccgcgcatgccatgtgccgtagctgcgcatcgcgccaccaggccgcccaatctcctattcatcttctccaaactgcctctccccacccatctcgcccatgttcgcgaaacccagagccgaaccgcccccagtcgacctcggctctccggcgagctgccctccatgtcctggccacacagtcgttcgtcgcgccgatcgcccaggaagatctgcgatgcgctcgtcgttgccgagatcgcgattcgtttatgagcttcgaggaatcgatgatcaagcatggcgacaaagtgatcgaactcttcgagttctacgagatcgaagaccctgagcatctgtttggtgaaggtgccttcggtgcaatctatgcttaggtaaagaagaatgcgtcgaggcggatctccaggagttccaagacttcgacgagttcgaggattaggctagcgacctcccccagtcagctgc

SEQ ID NO: 9274 - protein, 40 aa, Zea mays
  misc_feature: Ceres CLONE 379942-F
MSFEESMIKHGDKVIELFEFYEIEDPEHLFGEGAFGAIYA

SEQ ID NO: 9275 - DNA, 463 bp, Zea mays
  misc_feature: Ceres CLONE 379990-F
  misc_feature: Encodes the peptide sequence at SEQ ID NO. 9276
atcgacaccaccatgtccaccaccaccgccactcckccacagttcgaatattcctagcttgagattgcaagaggtctccaagaggagggtaggggagccgagcgctcagctctaattttctccatctattgctaacagctctggccaatcatataaaaaaacgttggttacaagccaaatggcacttcctggtagctgctgattttctatcgacaagatcagagctcagacctcaggcaagggaggtacaatgccaagagcaaatgagatgttgagggcagattcaagaatgatggtggtctttggtgccttgtcatcgaaaccagagcaactgacatttgaagaatccctcatatttgtcaagaaagttaaagtccgtgactacatgctgtacctgtcattattcgacgttctcggcagaacggaattaccccagctcgacgcctaccgagagttacagcag

SEQ ID NO: 9276 - protein, 71 aa, Zea mays
  misc_feature: Ceres CLONE 379990-F
MPRANEMLRADSRMMVVFGALSSKPEQLTFEESLIFVKKVKVRDYMLYLSLFDVLGRTELPQLDAYRELQQ

SEQ ID NO: 9277 - DNA, 440 bp, Zea mays
  misc_feature: Ceres CLONE 380066-F
  misc_feature: Encodes the peptide sequence at SEQ ID NO. 9278
aagttgagggaacrcccgccgtgggatgtcgaggtgctctggtcgagagaagtggggggtcggagatgtgagcagagatccgccgtgssctagaaccggtcacgccgtcgtcaaaccctcgggaatttctccccggaatcaagccgccaccgcagtaccgcgcgtggccatggtcagaattcagtgttgtgccgtagctgcagcgaggttacgagtcacttgaagaccaagttggtacctgggaatctcgagtctaaggtcaatgacakgtaccacaggatgaggcgcatgaaggatgatatgatgagttcgtgagtggtctaggctgtcgtctcccagtcaactatggttgttggatcgttgtcttcgtatgatgtaattatttaactattttgtacatagcttcgttatatacaaatgatgtgacattcgttcaaaaa

SEQ ID NO: 9278 - protein, 29 aa, Zea mays
  misc_feature: Ceres CLONE 380066-F
  misc_feature (5)..(5): Xaa is any aa, unknown, or other
KLREXPPWDVEVLWSREVGGRRCEQRSAV

SEQ ID NO: 9279 - DNA, 395 bp, Zea mays
  misc_feature: Ceres CLONE 380139-F
  misc_feature: Translation starting site: 61
  misc_feature (144)..(144): n is a, c, t, g, unknown, or other
  misc_feature (341)..(341): n is a, c, t, g, unknown, or other
agcagagagaagagggggaggcagtccagtgtccacgcacgtacgctccacagaagagagatggcgatgcggatggcggcggcggcggcagtggcgctggtggcggtgatgggcgtgctggcgcccgagcggcggcgcagmmrnacttgcgcggagaagctgatcccgtgctcgccgtacatgaacacgacggggacgccgccggataccytgcttgcggcccgctcaaggacgccgtcagaacgacctcaagtgcctctgcgacctctacgcctcgccggagatcttcaaggccttcaacatcagcctcgaccaggccctcggctctccaagcgttgcgncctcagcgacaccaccgccgcctgcaaggcctttctcctacgcakctcctccag

SEQ ID NO: 9280 - DNA, 464 bp, Zea mays
  misc_feature: Ceres CLONE 380178-F
  misc_feature: Encodes the peptide sequence at SEQ ID NO. 9281
atcgcaaaatgcaggctctcctgctccccgcgcgggccgccgccgacgccggsattgcttcggcagcgtgcggttttctgcctccgcgtgtgcgtcgcaggtctgccgccccctattcggtgccgccaattgcatctcctgtggggtctacggaagcgttcggcggcacctcacagtggcggtggcggcggccccgcctcgccttcgtcctcaccttcgtcgggaccgctctacccgacgcctccacccaccgagcaggaggtggagagggtcaagctcgagcaggttatgaggagactagataaaacagcaaggtatttcaagaattttaggtaccctggggttctggtcccaattggtgtgcacaattatttctgctggaatttggcattctctacagttgtaacggggaaggtgacatcacccttttacattctatgcaactgctgctggtattgctgctg

SEQ ID NO: 9281 - protein, 154 aa, Zea mays
  misc_feature: Ceres CLONE 380178-F
  misc_feature (18)..(18): Xaa is any aa, unknown, or other
IAKCRLSCSPRGPPPTPXLLRQRAVFCLRVCVAGLPPPIRCRQLHLLWGLRKRSAAPHSGGGGGPASPSSSPSSGPLYPTPPPTEQEVERVKLEQVMRRLDKTARYFKNFRYPGVLVPIGVHNYFCWNLAFSTVVTGKVTSPFYILCNCCWYCC

SEQ ID NO: 9282 - DNA, 447 bp, Zea mays
  misc_feature: Ceres CLONE 380224-F
  misc_feature: Translation starting site: 101
  misc_feature: SWISSPROT Homolog: EC 5.2.1.8 Peptidylprolyl isomerase
ctttttttcttttcctcgcttgccctaattccgcatccccggctgaggcagcagcggcggcgcssgcagcggcaccggctcaccagcgataccaggaagaatggggagttacagtcccgcgtacagccccccgaggagaggacatggcggcaggggaaggagcccacctcccaggagaggatatggcggtggccgtggtgaccatggctctgtcagcctcctggtccgcaacattccattgagatgcaggcctgaggaactacgtgtccctttcgaacggttcggccctgttcgggatgtttacctgccaagagattatcacactggggagccaagaggatttgggttcgtggagttcgtttgatgcttatgacgcttctgaggcacagtaccacatgaatcgccagatgtttgctgggcgtgaaataactgttgtacttgctgcgg

SEQ ID NO: 9283 - DNA, 486 bp, Zea mays
  misc_feature: Ceres CLONE 380263-F
  misc_feature: Encodes the peptide sequence at SEQ ID NO. 9284
aaaaggaggcccatcctcggcgacatgacgaccacgacacctgccgccgctgtcccggccgcggtggacgtgaacacgacggcgttcaccatgcatgactctgctgcgtcggcgtctccccatggtgccgaaaaccttgagatgtactactgcttcctctgcacggagcgccacccgctgctgattcactactgccccatctactgggacgagtgccacctcaactgttgggatgatgacacgccgacctccatggacacggtgcggggcaaggagtgctacgtcatgaagctgtacatgtccggtcgctacgtcatcgtccaacgcctgagctgcgacggcgtcgcctcgtgcttcctcacctgcggcggcggggagctggccgacaaagttgctgccggtgccatgggaaccacggcgtcggcgagcgcggtccagctccaggggaacgctctgcctttcgatctgtgcggcacacagcaggtc

SEQ ID NO: 9284 - protein, 154 aa, Zea mays
  misc_feature: Ceres CLONE 380263-F
MTTTTPAAAVPAAVDVNTTAFTMHDSAASASPHGAENLEMYYCFLCTERHPLLIHYCPIYWDECHLNCWDDDTPTSMDTVRGKECYVMKLYMSGRYVIVQRLSCDGVASCFLTCGGGELADKVAAGAMGTTASASAVQLQGNALPFDLCGTQQV

SEQ ID NO: 9285 - DNA, 460 bp, Zea mays
  misc_feature: Ceres CLONE 380264-F
  misc_feature: Encodes the peptide sequence at SEQ ID NO. 9286
acccacacagccagtagtgctccacttgctagtccactcctctctcagtcgaggcaatggcctccgcttccagtagcttccgcctcgctctgttcttggttctgctggcgtttgtcagcttggcacggcacgccacgggggaggccagcccgagcaggaggctcatggagctgtacaagccgccgcccagcgatctcctaaggtaccacgacggcgccgtgctgagcggcgacatccccgtctccgtcctctggtacggccgcttcacgcccgcgcagaaggccatcgtcaccgacttcctcctctccctctccgccgcgccgacgtcccctgcgccttccgtctcccagtggtggggcaccatcgaccggctctacctatcgaaggcggcggacgcggccgccgtcgggaagagcggcgcgcacggcggcggtggtggcaggaaaggcgctcgggtggt

SEQ ID NO: 9286 - protein, 134 aa, Zea mays
  misc_feature: Ceres CLONE 380264-F
MASASSSFRLALFLVLLAFVSLARHATGEASPSRRLMELYKPPPSDLLRYHDGAVLSGDIPVSVLWYGRFTPAQKAIVTDFLLSLSAAPTSPAPSVSQWWGTIDRLYLSKAADAAAVGKSGAHGGGGGRKGARV

SEQ ID NO: 9287 - DNA, 471 bp, Zea mays
  misc_feature: Ceres CLONE 380277-F
  misc_feature: Encodes the peptide sequence at SEQ ID NO. 9288
aaaaatcataggttctccacgacgcggccacctccgcygccgccagcgccccctgctagggtcaacacccgctctctgcggactgcgtgaaacaccagcggcggccaccgggcaggacgagccccctccccaaacagagaggggcggggatcagtgcgtgcgctcctggtggagggcgtggaagagctgggcaggcggcaagcaggggtttgggaggatggtttcgctctcgacttggttccgctatgccgcacaaaagttcgagtactgcgtttccctctcgttgaagaaatataatgatgtgggccagatcagcagcacacagttaactgatgtgttacacaaaaatttattccaaggcaagctcacctacgtgtgtcggaccaaaggggaagaagccatggctcccatcgcatctccaactggaggagccgtccttgtcagaaaactcgcaaatttgagccccacgca

SEQ ID NO: 9288 - protein, 84 aa, Zea mays
  misc_feature: Ceres CLONE 380277-F
MVSLSTWFRYAAQKFEYCVSLSLKKYNDVGQISSTQLTDVLHKNLFQGKLTYVCRTKGEEAMAPIASPTGGAVLVRKLANLSPT

SEQ ID NO: 9289 - DNA, 254 bp, Zea mays
  misc_feature: Ceres CLONE 380283-F
aaatccaagaagaaaggagcatagaacataagaggagagacckcactacacacctcacgcctgaagttcagatctaagccttctcgtcctcgcccaaggacaacgataaacatctaagaaccaaacaaaaacagagcacgaccatcggtctctaagcaaaacgcgcmrcgccgggcgctccacgcacgtaggctagcagagcgcgcatggggcttctggaccagctgtgggacgacacggtggccgggccgcgc

SEQ ID NO: 9290 - DNA, 378 bp, Zea mays
  misc_feature: Ceres CLONE 380291-F
  misc_feature: Encodes the peptide sequence at SEQ ID NO. 9291
aaaaaccccccttggcatttcacaaacgcagagacgtttctccgcctccccgctcctcaccgccgcgccgcytcgtccactgcctcagccgcatcaattgacccccggaccacgcgaatggccgctgaagactcaaaagatatcctaaagaagcgtctcccaaagaaaatcagagaagtccctgactgctattttctccctcgtcgatcatggccttctgcactggcaatctacggtgctgtatgtgctgctagctttggtgcagggatgcttattgaggtttggataaacaaaaagatcaaagaggacagtggcattatctgggagatggataaatgatgcaatgcatgctttgttgtggtgaaatcccgcgttgtc

SEQ ID NO: 9291 - protein, 73 aa, Zea mays
  misc_feature: Ceres CLONE 380291-F
MAAEDSKDILKKRLPKKIREVPDCYFLPRRSWPSALAIYGAVCAASFGAGMLIEVWINKKIKEDSGIIWEMDK

SEQ ID NO: 9292 - DNA, 212 bp, Zea mays
  misc_feature: Ceres CLONE 380293-F
akaccagccacgcgctcaactccacgggccttgagctagggttttcttcgccgctacctccctacgaggcgggcgtgcagcatggcgctggtgcaggcgggcatgggccktacccgggtcgttatcctcgtcggckccggcgttgccgttccgtcgtcctccgcaacggccgcctcgccgagatcctcggsactccaggagatactcgacaa

SEQ ID NO: 9293 - DNA, 446 bp, Zea mays
  misc_feature: Ceres CLONE 380309-F
  misc_feature: Translation starting site: 235
  misc_feature (267)..(267): n is a, c, t, g, unknown, or other
aacccacgtggttttgcttcgacaacgacgcattggcatcgcacacgacgggagaagaaatggcatctttgtcccgcacagccgtcgccgccgtgagtccgcagcccgctcagcaccccttaccggccgcgtcccaggtgcgccactgccttcccttgcctcgtcttccgctgcccggtccgcccggatcctccgcagtcggcggccgcgtcgtcgtcggggctggagacgctcatgccgctgcacagsscggtggcggccgcgggncttaggtcctgcatcgccgttgacttctcctgctggagctcgctctcacaaggatacgctttgcctttgtgacagagagaagaaaccaatgaacattaggaatcactatcaagggctgtaataatgtgattcttgtaaactaattttgcctttatagttcattggatttttgtaacctg

SEQ ID NO: 9294 - DNA, 522 bp, Zea mays
  misc_feature: Ceres CLONE 380331-F
  misc_feature: Encodes the peptide sequence at SEQ ID NO. 9295
atttcagacagtggctagctagctaggcgacgttcagtgaagctccgagccgagctctcatggaactccagctctaccactccaccacaaccctcctcctgccgctgctgctgcttcttcttctcctgctaccctcttcttcttcctcctcctctcacggcctgcgctctgccgacggtagtagagcgccgcattaccggctcaaggatccgcgtccaccaaagatcggcgacggcgagggggctgcgacggcggagtcgctgatcgggtcgaggccgccgcggtgcgacggcaagtgcgcgccgtgcgggcggtgcgaggcggtgcaggtgccggtggcgccgcgggcgacagccgcgggggcgagcccccggcgccgcggagggctgttcggcagcgccggaggagagctacaccgactacaagcctctcaactggaggtgcsgctgcgcggaccggcgagcactggacccgtgatcgatccggatgttgcgawcccctcgtcaggtctccagctgctgc

SEQ ID NO: 9295 - protein, 154 aa, Zea mays
  misc_feature: Ceres CLONE 380331-F
  misc_feature (129)..(129): Xaa is any aa, unknown, or other
  misc_feature (146)..(146): Xaa is any aa, unknown, or other
MELQLYHSTTTLLLPLLLLLLLLLPSSSSSSSHGLRSADGSRAPHYRLKDPRPPKIGDGEGAATAESLIGSRPPRCDGKCAPCGRCEAVQVPVAPRATAAGASPRRRGGLFGSAGGELHRLQASQLEVXLRGPASTGPVIDPDVAXPSSGLQLL

SEQ ID NO: 9296 - DNA, 471 bp, Zea mays
  misc_feature: Ceres CLONE 380372-F
  misc_feature: Encodes the peptide sequence at SEQ ID NO. 9297
agaggcccgcacgtttccccttgcgacgtcaacctcgttctacccaccagccggcacaaattctccctttccacaagaacatcacacggcgatassaaaaccttccgtcggaggatggcttccgccggcgctggagaaggcaaggagacggggacggctgccgggagcagctccacagcaagactctcctcaagagccaaccactgtaccagtacatactggaatccaccgtcttcccacgcgagccggactgcctgcgggagctccgcgttgccaccgccacccaccccatggcgggcatggctgcgtcgccggacgaggtgcagctgctgcagctcctgatcgagattcttggcgccaagaacgccatcgaggttggcgtcttcaccgggtactcgctgctcgccaccgccctcgccctccccgacgacggcaagattgtggccatcgacgttacccgcgagagctacg

SEQ ID NO: 9297 - protein, 156 aa, Zea mays
  misc_feature: Ceres CLONE 380372-F
  misc_feature (73)..(156): Pfam Name: Methyltransf_3 Pfam Description: O-methyltransferase
  misc_feature: SWISSPROT Homolog: EC 2.1.1.104 Caffeoyl-CoA O-methyltransferase
  misc_feature (31)..(31): Xaa is any aa, unknown, or other
  misc_feature (32)..(32): Xaa is any aa, unknown, or other
RPARFPLRRQPRSTHQPAQILPFHKNITRRXXNLPSEDGFRRRWRRQGDGDGCREQLHSKTLLKSQPLYQYILESTVFPREPDCLRELRVATATHPMAGMAASPDEVQLLQLLIEILGAKNAIEVGVFTGYSLLATALALPDDGKIVAIDVTRESY

SEQ ID NO: 9298 - DNA, 503 bp, Zea mays
  misc_feature: Ceres CLONE 380383-F
  misc_feature: Encodes the peptide sequence at SEQ ID NO. 9299
acatgtgcatctcagcagcactagcagtgacaaactcgaagcttgccttctagcttgtttacaccccaaaactaaaactagagtcggcggcggcaacaagcggtacgtagaggatgaagagcaggagcagcactctgttggtgatcctagttctccaggcccttctgctctctgcggctgtggccaaaggacctgcagggccgaagaagcagtgctggtgcggcgagtgcaccagctggtcgggcgtgtggacctgcgacgacctcctcaccaagtgcgccgccacctgcaagaactgcgtccccgtctccacggacaagggcgccaccaagtacagatgccgcgacttcctccccgaaaactgcggctgcaagatccactagagactcatccaatcaaccatggccacagccgatggacccttcttccatatgcatgctctcctccgtccgtccgcctagcttgctacaagcaggcgctaataagctagcaagctgttgttg

SEQ ID NO: 9299 - protein, 89 aa, Zea mays; identical to SEQ ID NO: 3974
  misc_feature: Ceres CLONE 380383-F

SEQ ID NO: 9300 - DNA, 267 bp, Zea mays
  misc_feature: Ceres CLONE 380409-F
  misc_feature: Encodes the peptide sequence at SEQ ID NO. 9301
  misc_feature (105)..(105): n is a, c, t, g, unknown, or other
ctctcgcctcgcctcgccacgcgacgagcccaacacgcaaacggaasscttccgcgcccctccgccttatccgatggcgtccctcaccaccacaacatcctcacnggccgccctcccggcgcagccaccgcccccgcgcttcgtccatatctccccacgccggatcgaagcggccgctcctcgcgggcgacgacgcgccctggcgggccaccgggccacctccgcggggcaggggatccgacccgtgcccgcgcatcaaccacgcct

SEQ ID NO: 9301 - protein, 88 aa, Zea mays
  misc_feature: Ceres CLONE 380409-F
  misc_feature (15)..(15): Xaa is any aa, unknown, or other
  misc_feature (16)..(16): Xaa is any aa, unknown, or other
  misc_feature (35)..(35): Xaa is any aa, unknown, or other
LASPRHATSPTRKRXXSAPLRLIRWRPSPPQHPHXPPSRRSHRPRASSISPHAGSKRPLLAGDDAPWRATGPPPRGRGSDPCPRINHA

SEQ ID NO: 9302 - DNA, 397 bp, Zea mays
  misc_feature: Ceres CLONE 380445-F
acgcccctcccaacactcccagtcccaaacccatttcccttgccttcccctcckgctccgctcctcgaccactccgacaaccccagcgcctccgggagctccacccctccaccggctgcggcgagaagcggcgggggctaactaagtctgtaggcggcggcggaggtgatccgggagccggagccgagtctagggcgatggggcagcagtcgctgatctacgcgttcgtggcgcgtggcaccgtggtsstgggctgagtacaccgagttcaccggcaacttcaccaccatcgccgcccaktgcctgcagaagctccccgccaggcaacaacaagttcacctacaactggcgacggccacacccttcaacttacctcgtcgaggactgatttcacgta

SEQ ID NO: 9303 - DNA, 392 bp, Zea mays
  misc_feature: Ceres CLONE 380458-F
  misc_feature: Encodes the peptide sequence at SEQ ID NO. 9304
  misc_feature (293)..(293): n is a, c, t, g, unknown, or other
accacctccctgctctgctttgctgtttgcatcgcatcgcatcgcatcgcctttgctgaatcccagcgacggacgggccgctacgggcactgtacggtgcgacgagcattgcttgctgctgcctcggccggcatggcgatggcggcgcggtggaggtcggcacgcagggcacggtgggctcgctggtgctccgggaggtcgagcacttccggagatggaggtcgccggcggccacggcaagaagagcagcaaggtcgttgcagccggcggcgccagccccgtagcaacggcgncaagawgcycaggccgaagaagggcgccgcagtagtaggcaatgcgtcgtccttcttgccgaggatgtgctcgtcggcggaggtcgcggaggaccccgc

SEQ ID NO: 9304 - protein, 86 aa, Zea mays
  misc_feature: Ceres CLONE 380458-F
  misc_feature (54)..(54): Xaa is any aa, unknown, or other
  misc_feature (56)..(56): Xaa is any aa, unknown, or other
  misc_feature (57)..(57): Xaa is any aa, unknown, or other
MAMAARWRSARRARWARWCSGRSSTSGDGGRRRPRQEEQQGRCSRRRQPRSNGXKXXRPKKGAAVVGNASSFLPRMCSSAEVAEDP

SEQ ID NO: 9305 - DNA, 350 bp, Zea mays
  misc_feature: Ceres CLONE 380467-F
  misc_feature: Encodes the peptide sequence at SEQ ID NO. 9306
  misc_feature (291)..(291): n is a, c, t, g, unknown, or other
aaaaaaagggcgtgattgcagtagagcatctccttttctttatttgctatatatatgcatgttctgatcttcaagcagctcggccgatcaaacccatagcatcgccaccaaattaaaggtcttctctagatcattacatacacatatatatggggcctcagcaagacgggcggtcgtccacggcgaacggcggcacggcggcgaggcgcaaggaggccgccgcgamssaggtggtgcggtaccgcgagtgccagcgcaaccacgcggcgtcagtcggcgggcacgctgggnacgggtgccgcgagttcatggcgtccagcgcggacggcacggcggcggcgctcacgtgc

SEQ ID NO: 9306 - protein, 67 aa, Zea mays
  misc_feature: Ceres CLONE 380467-F
  misc_feature (26)..(67): Pfam Name: ZF-HD_dimer Pfam Description: ZF-HD protein dimerisation region
  misc_feature (26)..(26): Xaa is any aa, unknown, or other
  misc_feature (27)..(27): Xaa is any aa, unknown, or other
  misc_feature (48)..(48): Xaa is any aa, unknown, or other
MGPQQDGRSSTANGGTAARRKEAAAXXVVRYRECQRNHAASVGGHAGXGCREFMASSADGTAAALTC

SEQ ID NO: 9307 - DNA, 462 bp, Zea mays
  misc_feature: Ceres CLONE 380474-F
  misc_feature: Encodes the peptide sequence at SEQ ID NO. 9308
atgattcgacagtggagcacacccgagctatatatacatctggatatgcacacacagtgttctgatgcagtgttcaagggaccggaaggattagagggggcagaaggagcgagatgggttccaggaaagcacacggggttttggtacttgttcttctgcttattgttttgcctgcgctctcgatcggtatgcaccgcagcagattgatttccctgttcaatctgttgttatctttattttctacacatttcttgttttttttcgtcaaattgtacgagcaggtatatatgtaaagagagaaaaaaactcaggaacttgtcaaaatatactcaacatgtgctattggaagtatgtagtagatttttgtcaggcatgcaaaagtgacggatttgattcattagtattctgaaatttgattttgcaggaggaagggagttggcggatgaaaaggatcacaaggag

SEQ ID NO: 9308 - protein, 59 aa, Zea mays
  misc_feature: Ceres CLONE 380474-F
MGSRKAHGVLVLVLLLIVLPALSIGMHRSRLISLFNLLLSLFSTHFLFFFVKLYEQVYM

SEQ ID NO: 9309 - DNA, 462 bp, Zea mays
  misc_feature: Ceres CLONE 380476-F
  misc_feature: Encodes the peptide sequence at SEQ ID NO. 9310
aacagctacatttcatgccatggttacagctttgcatgttcaattggctctcttggacagttgtgtatacaacttgtggatctttatgcatatttaatctaaactcttgtagttttgcttagactcatttaatcactaaggtttatctcactttttttcttcctcaaggctttgaggacaggttccagagagaagcaaatctgtctgcttcagcaatctttccatcacttgtgaagcccccctgaatacatgtccgagaacctagcaaggtactcggcctggttgggtggtgcgatattggccaaggtcgttttccctgaaaaccagcatatcaccaagggcgagtatgatgagacggggcgtctattgtgcaccagaagtgcttttagagacaaactgccttgaactagcacggttgtgcaccatttgctgctgttcatgtcacagctgtgctcgtacctg

SEQ ID NO: 9310 - protein, 51 aa, Zea mays; identical to SEQ ID NO: 8364
  misc_feature: Ceres CLONE 380476-F

SEQ ID NO: 9311 - DNA, 365 bp, Zea mays
  misc_feature: Ceres CLONE 380489-F
  misc_feature: Encodes the peptide sequence at SEQ ID NO. 9312
  misc_feature (207)..(207): n is a, c, t, g, unknown, or other
  misc_feature (209)..(209): n is a, c, t, g, unknown, or other
  misc_feature (337)..(337): n is a, c, t, g, unknown, or other
aatttttctccagccgccgcgctcctgatccttatctctgcgcgcgctgcatcggcgcccgcssggaggmttcccgcccgcctcgtccatgttgtgggtccgcaatatccgccgcttcgtcgacacgggcgccggcctcggatccgaggcaatcatggaactggagactaaaaggatattgcttgagattttcaaggagcggcastnanagaggtgccgaggctggttccatcccaagtttttacaagaaacctgaagaagggatccattagctctagagttcaaaggttggccaagtacagggtttctaaagaaacaatcagagcttctgctgaantgctgatgatcttgatgccatgtgggtt

SEQ ID NO: 9312 - protein, 55 aa, Zea mays
  misc_feature: Ceres CLONE 380489-F
  misc_feature (39)..(39): Xaa is any aa, unknown, or other
  misc_feature (40)..(40): Xaa is any aa, unknown, or other
  misc_feature (41)..(41): Xaa is any aa, unknown, or other
MLWVRNIRRFVDTGAGLGSEAIMELETKRILLEIFKERXXXRCRGWFHPKFLQET

SEQ ID NO: 9313 - DNA, 261 bp, Zea mays
  misc_feature: Ceres CLONE 380501-F
agtctagctcttgcacccgatcgagccggccttcacttcacgccatgttcagtgccatgtccgccctcctctcctccctggcccggcggctggtggtgcccctccgccgcagaagagcatcacgtcctccgctttcgccgccagacgttcgttcttcccgtgcggcgcgggccaccsagcccggttccgcgacagctccttcgtcgtcgtcatcaagcgcaagacgctgaggaaggtgatgcccagcagaagggtggggga

SEQ ID NO: 9314 - DNA, 401 bp, Zea mays
  misc_feature: Ceres CLONE 380523-F
  misc_feature: Encodes the peptide sequence at SEQ ID NO. 9315
aaccaagawtccgactcggcgctagacgaattcggacggaaggwagacgagaaggccctgaggcgagcgggggatcaaagaagaagatgaaggtccgtkcggcggtgaagcgcctgtgccggttctgcaaggtggtgaagcgccggggaatcgtcttcgtccaatgcacggccaacgccaagcacaagcagcgccagggcttctccaccatcgccgaagcagccgccgtctcgtgcgttcacctgcctccgccgccgcccgctagcggttccgcctccgccgcagcgttcgcagaggcttcgaaggtggcgagacaagagatgtctatgatttcaattggcggctgggtttagctgccctgttcaagaatggagaaaaataatgtatcaggcctactacca

SEQ ID NO: 9315 - protein, 88 aa, Zea mays
  misc_feature: Ceres CLONE 380523-F
  misc_feature (1)..(38): Pfam Name: Ribosomal_L36 Pfam Description: Ribosomal protein L36
  misc_feature (5)..(5): Xaa is any aa, unknown, or other
MKVRXAVKRLCRFCKVVKRRGIVFVQCTANAKHKQRQGFSTIAEAAAVSCVHLPPPPPASGSASAAAFAEASKVARQEMSMISIGGWV

SEQ ID NO: 9316 - DNA, 469 bp, Zea mays
  misc_feature: Ceres CLONE 380528-F
  misc_feature: Encodes the peptide sequence at SEQ ID NO. 9317
agaaaccctaacactcatcacgccgccactgatctgctctgttgctggtgactaggagcagtagcgagagggattctggatggccaagtcgaagaaccacacggcgcataaccagtcgttcaaggcgcacaagaacggcatcaagaagcccaagcgccaccgccagacctccaccaaggggatggacccgaagtttctgaggaacttgaggtactcaaggaagggcaacaagaagagtggcgaggctgagtccgaggagtaagatgatggtgattgagtttgtggcgacaaatgcatctcttgtatcgctaagagtcttagctgtgaacttagttctcacttctgtgtgactgtgatcaaaggacttgtgtatgatcaaaggagatccatcagttggtaccgaagtgtattttatgtcttgttggttacctggaatttaattaaaaccatcactttgtatccttttgag

SEQ ID NO: 9317 - protein, 60 aa, Zea mays; identical to SEQ ID NO: 1569
  misc_feature: Ceres CLONE 380528-F
  misc_feature (3)..(42): Pfam Name: Ribosomal_L29e Pfam Description: Ribosomal L29e protein family

SEQ ID NO: 9318 - DNA, 377 bp, Zea mays
  misc_feature: Ceres CLONE 380540-F
gagaaagcgagctgaggagcgcaggcgctgtcgctggcgaggacatgctcgcggcagccggttatgggctcaaaccataggcgtgtcaggaacggtggagagcggcgaccactactcgccttcgtctcggtcctcgcgcgctcctgggctgcctcttcgtgctagaaaccctcgcgtcgcgggagcttggttgcgactgcaagcgccaagctgctgtgccgtgggtggcggcggcgggagtggaagtggaaccgcagccgccagccggtgctgtgatggacgcgcmsagcagctggatttggtcatgcgtcaccagagcatggccaccgtctgcgagagcgaggacgcgctggggtcgtcggagtcggatcccgcga

SEQ ID NO: 9319 - DNA, 103 bp, Zea mays
  misc_feature: Ceres CLONE 380544-F
acctcaaatcccagacgccacgccacccaacacatacaaacacacgcacgcgcgcgcgcctcccgctgttccgcaaaacaaaggaaacgaaggagaggaggcc

SEQ ID NO: 9320 - DNA, 255 bp, Zea mays
  misc_feature: Ceres CLONE 380585-F
  misc_feature: Encodes the peptide sequence at SEQ ID NO. 9321
gttcgtcagctctagcctaccctgcgctggctcttctttaattctgcagggaagttccagtttcagctagagtgcaggcggagaaccaatgggggcggcgcgtcgtccgassactcgtcacgcgccggagacgsscgggctgtggcgagcagcgctgcctctggactggcactggcagcaacagcaaccaggcccagtcgaagcgggckccgccgcctccacaagttccacgagatagttgcgcaggaggcgacg

SEQ ID NO: 9321 - protein, 49 aa, Zea mays
  misc_feature: Ceres CLONE 380585-F
  misc_feature (8)..(8): Xaa is any aa, unknown, or other
  misc_feature (16)..(16): Xaa is any aa, unknown, or other
  misc_feature (41)..(41): Xaa is any aa, unknown, or other
MGAARRPXTRHAPETXGLWRAALPLDWHWQQQQPGPVEAGXAASTSSTR

SEQ ID NO: 9322 - DNA, 443 bp, Zea mays
  misc_feature: Ceres CLONE 380592-F
  misc_feature: Encodes the peptide sequence at SEQ ID NO. 9323
gggtgtggctcgcttcctctctgtccgactcctttccttcattttcctcttctgacctccggcagcaccatggagaacgtcgccgcgaatccttccgctgcggccgccgccgaggaatggcgtccaagcatcgggggccggagggagcgcccggagacsstccgaagcagaacctggcgcaggtgacgagctcgatccagaagacgctgggcctgctccaccagctcaacctcaccgtctcctcctttcaactctgcctcccagcttcccctcctccagcgcctgaacgcgctcgtggcggasstcgacacgatgcagaaactagccgagggttgtaacatccaggtgccaatggaggtcgtcaatttgatcgacgatgggaagaaccccgacgagttwactagggatgtgctcaacagctgcattgccaagaaccagatcac

SEQ ID NO: 9323 - protein, 43 aa, Zea mays
  misc_feature: Ceres CLONE 380592-F
  misc_feature (29)..(29): Xaa is any aa, unknown, or other
MQKLAEGCNIQVPMEVVNLIDDGKNPDEXTRDVLNSCIAKNQI

SEQ ID NO: 9324 - DNA, 195 bp, Zea mays
  misc_feature: Ceres CLONE 380602-F
  misc_feature: Encodes the peptide sequence at SEQ ID NO. 9325
  misc_feature (32)..(32): n is a, c, t, g, unknown, or other
accgttccgagaccagcgccagacgcagacgnccccgaacgccggcgggagcatcaggtcgtcgactccgagcatcgacccgccgcgatggagaagggaaagggcctcgctcgccgctgggcgtgggagctccccgacgcctcctcctcctcccccgccgtccccgacccgcccggcttcaccagatccgcgcct

SEQ ID NO: 9325 - protein, 36 aa, Zea mays
  misc_feature: Ceres CLONE 380602-F
MEKGKGLARRWAWELPDASSSSPAVPDPPGFTRSAP

SEQ ID NO: 9326 - DNA, 388 bp, Zea mays
  misc_feature: Ceres CLONE 380619-F
  misc_feature: Encodes the peptide sequence at SEQ ID NO. 9327
  misc_feature (282)..(282): n is a, c, t, g, unknown, or other
aactcatgtcagaccagagctccaccctcgcctcgaagggcaaatcctcgacggctggcggcggccgaagcgatgtcgcgcggccgttggagtgtcatcttgcggcgtaagacccggactaccacccactggccagacgacggaggaggaggaggcgcgcgtcaggcgagggcggagaaagccgakctcgaggaggagatcgccacgttgaaggcggagatcttcgccctggaggaagagttggccaggatggatgccgccgccgccgctacgcgcgcgakntttcttcactctcgtgtttcagctaggccacttgtgattgggctggagctgttgtcgtagatctcggaggttaggtagatggaattccccattgcaattacttcag

SEQ ID NO: 9327 - protein, 89 aa, Zea mays
  misc_feature: Ceres CLONE 380619-F
  misc_feature (38)..(38): Xaa is any aa, unknown, or other
  misc_feature (70)..(70): Xaa is any aa, unknown, or other
MSRGRWSVILRRKTRTTTHWPDDGGGGGARQARAEKAXLEEEIATLKAEIFALEEELARMDAAAAATRAXFLHSRVSARPLVIGLELLS

SEQ ID NO: 9328 - DNA, 338 bp, Zea mays
  misc_feature: Ceres CLONE 380624-F
  misc_feature: Encodes the peptide sequence at SEQ ID NO. 9329
gaaagcacccgcgagaacacgcgctccgcagtccgcagtccgcacgtctgaaatccaggaccatcaccaacccaaagccttgcgccttgcccggtccccgccttttcggagaccgcacccaatggccggctcaaccaaggtgctggccgccatcctgctcgtcgacctcgtcgccttcggcctcgccatcgggcggtgcagagccgcccctcggcgaggctggagacggacgagaggcaggagtggacctactgcgtgtaccgcacggacgccgccacgssctgggcggcgcgcgctcgcgctggtgttcgtgggacaggcggtggccgcgccgccag

SEQ ID NO: 9329 - protein, 72 aa, Zea mays
  misc_feature: Ceres CLONE 380624-F
  misc_feature (54)..(54): Xaa is any aa, unknown, or other
MAGSTKVLAAILLVDLVAFGLAIGRCRAAPRRGWRRTRGRSGPTACTARTPPRXGRRALALVFVGQAVAAPP

SEQ ID NO: 9330 - DNA, 433 bp, Zea mays
  misc_feature: Ceres CLONE 380630-F
  misc_feature: Encodes the peptide sequence at SEQ ID NO. 9331
cttctgatcctctccctctcccacgcggccgcggccacgcccccgccccccgctgactcacgcagcgcgcgcgacgacgcggaggagaaaaccaggaatcccataaagataaaggtttcagtttcggaagccaagccactcccacacccccacgctcgagcgaagggagccagcaatggcgcgtcgcgggccgtgagagacgggaacaagaatggctgccatggtgcgcgggccggcgatggcctctgcggctgggccgggtgcgacgtcggcggctgctgcgaccgcggcggaggagatgcggtggcggcagctagacagcggcgtgagcgcggtgtcgttcgggttcgtggccaccgccatactcgtgtccatgttcctcgccatggccatcctcgagcacttcctccgccccacgacgtcgacccacgcg

SEQ ID NO: 9331 - protein, 74 aa, Zea mays
  misc_feature: Ceres CLONE 380630-F
MAAMVRGPAMASAAGPGATSAAAATAAEEMRWRQLDSGVSAVSFGFVATAILVSMFLAMAILEHFLRPTTSTHA

SEQ ID NO: 9332 - DNA, 498 bp, Zea mays
  misc_feature: Ceres CLONE 380635-F
  misc_feature: Encodes the peptide sequence at SEQ ID NO. 9333
gtactgacccccgcaccgccaaaccctagtccacagcggcgaggcgaccttgcgacctccgttcctctgcgctccggctgagttgctgatttgggataatcatgttctctctgagtgaatgaacatgtctgggaatgatgataagccacatgctgctgcaaacagaataaaggcagccacgttatcagtgactaagggattgagcagggctcaagctgaatgggctgcgactgctgctacccgcaatgtgaatgcctatgggcagaaggaagagggacgaagccgctggcaggagaggaagaaagccaagagtcagatgtatctgatgagtacagagaaggttgcgambtggggcactgtgaagcaaaaagcttcataaacttcttctgttggcgcatatacccaatgccagaaatgtttccagcatggtcactggacatatgagtgcaaaaagagcgggtgtacatatcacggccctcaagaacgtagcagcttaag

SEQ ID NO: 9333 - protein, 84 aa, Zea mays
  misc_feature: Ceres CLONE 380635-F
  misc_feature (75)..(75): Xaa is any aa, unknown, or other
MSGNDDKPHAAANRIKAATLSVTKGLSRAQAEWAATAATRNVNAYGQKEEGRSRWQERKKAKSQMYLMSTEKVAXWGTVKQKAS

SEQ ID NO: 9334 - DNA, 202 bp, Zea mays
  misc_feature: Ceres CLONE 380693-F
  misc_feature (50)..(50): n is a, c, t, g, unknown, or other
aggcctccgcagtccgcacacccctcctgtgctttgagattcgcgcgtcncttgccgacctcgtgcctcccgcggactcgccggcgaacgctcttggagatgccgcccgccgcgssgcgctcctccggtgcgctccggcggtcccattcgcggcccgcagtagcgctgtttcccgctcaggcatggcgcggcgtctggtggc

SEQ ID NO: 9335 - DNA, 458 bp, Zea mays
  misc_feature: Ceres CLONE 380709-F
  misc_feature: Encodes the peptide sequence at SEQ ID NO. 9336
  misc_feature (231)..(231): n is a, c, t, g, unknown, or other
  misc_feature (361)..(361): n is a, c, t, g, unknown, or other
aattctacaatacagctcgcaaggkatcgcgttcacccctcagccaccggctagcagctagaccttcaggacctcgctgcattcccccatgggtggcgccatgaggcagctgctcagctttctgggagcgagcaatggccgccccagggagaagaagacgaagaggacgacgctgcggcggcgcctgctggtgcccacggtggagctcagggtcaggatggactgcgagcnctgcgacgcgaggttcaagaaagcgctctccggcatcagaggagtggaacatgtggaggtgaacaggccgcagcagaacgtcacggtgactggcgaggtggacccggtggcggtgctacggagggcccantccacgtggaataaggcggasattggcgggggccggggcacgaccaggacactgccggctactacgcgaccccggcggccgcggccctctacggcgt

SEQ ID NO: 9336 - protein, 123 aa, Zea mays
  misc_feature: Ceres CLONE 380709-F
  misc_feature (39)..(99): Pfam Name: HMA Pfam Description: Heavy-metal-associated domain
  misc_feature (48)..(48): Xaa is any aa, unknown, or other
  misc_feature (91)..(91): Xaa is any aa, unknown, or other
  misc_feature (98)..(98): Xaa is any aa, unknown, or other
MGGAMRQLLSFLGASNGRPREKKTKRTTLRRRLLVPTVELRVRMDCEXCDARFKKALSGIRGVEHVEVNRPQQNVTVTGEVDPVAVLRRAXSTWNKAXIGGGRGTTRTLPATTRPRRPRPSTA

SEQ ID NO: 9337 - DNA, 338 bp, Zea mays
  misc_feature: Ceres CLONE 380728-F
  misc_feature (133)..(133): n is a, c, t, g, unknown, or other
  misc_feature (316)..(316): n is a, c, t, g, unknown, or other
actgactaataacaaaagaactcgctccattcagagattcagagaagacccgcctctcccgtgagccgtgacgcgacgccggatcgtcctcgtctcctagctcgtggaatgaagggaggtggcgtcatcaggnccgccggcggaggtgccgsgtkgcgggtctgttgcgaacgcgactgcggcttcccgtggtgctcctctcctgctccctcttcttcctcgccggcttcttcggctcgctcctcttcacccaggatccggagaggcggatatgccggttgccgagagagcggctgttggaggcggcgtggccggnagatgccttacggcgagtccgg

SEQ ID NO: 9338 - DNA, 473 bp, Zea mays
  misc_feature: Ceres CLONE 380767-F
aggaatagatgtgtattcgacagtkagcaactagaggtccatgaagttccccaggaggttgtagacaagggtagtgtttgggtgagggctgatactgtagctttggggcagctaacacatcagtagacagtagtctcaggactcaggagtgatgtgcagctctcttgcatattcgagaaaaaaatcaagaggagtttgaaaagaaaaacaagtatggagctgtttcatctycacgggggctttgatcgataaggattcaggagtgctggaagaagatttggagcaagagctgtcgctgtccggcgtctggcggtctgggggagaccagtgattttcctacgcacgcctgccaaaagtgggatggagttgaacgcaaaatgtgttgtttgtcattgggtagatggaggaggacacctcgtttatacgcgcggaggaggtgtagtgcgactgtgcgagttgaaatttgtaagaac

SEQ ID NO: 9339 - DNA, 293 bp, Zea mays
  misc_feature: Ceres CLONE 380776-F
  misc_feature: Encodes the peptide sequence at SEQ ID NO. 9340
  misc_feature (200)..(200): n is a, c, t, g, unknown, or other
acactctgcagcagtgcggtgcgggcgtgcggcctccctttttttctccagttcctccggcggcggcgtgcttggcggtgcgcaggtgcccagatctccaccatcttagtcgccggcgacgagcatcaccaggttcccgatgaccatggcgcmgcacgatgtssctgcttcggcggtccattgggtttacagcgccgcancagagagccctgagtaccactgccgcaccagcsssggagggtgcggccgtggctgaagctacggcgaaggaggcgaagaggaggaggaagaat

SEQ ID NO: 9340 - protein, 45 aa, Zea mays
  misc_feature: Ceres CLONE 380776-F
  misc_feature (2)..(2): Xaa is any aa, unknown, or other
  misc_feature (14)..(14): Xaa is any aa, unknown, or other
  misc_feature (26)..(26): Xaa is any aa, unknown, or other
MXLLRRSIGFTAPXQRALSTTAAPAXEGAAVAEATAKEAKRRRKN

SEQ ID NO: 9341 - DNA, 268 bp, Zea mays
  misc_feature: Ceres CLONE 380781-F
  misc_feature: Encodes the peptide sequence at SEQ ID NO. 9342
  misc_feature (126)..(126): n is a, c, t, g, unknown, or other
atcaaaaaacaaggggaaaaaacaacacagcatgaactgcttgaagaactcgcgttctgtcctctcgcgactccttcgccacaggccccacgtagccgcgccaccgccgccgacgccgsssacgcncgcggccaccggcttcacggtactactactacgcctcccgcgtcaagccagccgtctcccgaccgccgccccakttgccgagatctaggcactactacacatccccgcggcggcacaggtcgtccacttcaaccgccgccgc

SEQ ID NO: 9342 - protein, 60 aa, Zea mays
  misc_feature: Ceres CLONE 380781-F
  misc_feature (30)..(30): Xaa is any aa, unknown, or other
  misc_feature (32)..(32): Xaa is any aa, unknown, or other
  misc_feature (57)..(57): Xaa is any aa, unknown, or other
MNCLKNSRSVLSRLLRHRPHVAAPPPPTPXTXAATGFTVLLLRLPRQASRLPTAAPXAEI

SEQ ID NO: 9343 - DNA, 230 bp, Zea mays
  misc_feature: Ceres CLONE 380795-F
  misc_feature (24)..(24): n is a, c, t, g, unknown, or other
agattagagatagcaaaaggcganrccggtaaccgccaccaccaaatcgctaccaccaatccgccatgatgctcccgacggccaccgcgacggccgtcttcctcaccgcggcgccttcctctttctccacccgccgtcggccagcgccatcttcgcatccctttcgccgtccttctcctcctcggaggagccgctgctggtgcgcgcggcggggggcgaggacggcctcc

SEQ ID NO: 9344 - DNA, 455 bp, Zea mays
  misc_feature: Ceres CLONE 380824-F
gtacatctttgtcctgggcctgctcatgagccagtacacgctcacaggatacgacgcctcggsgcatatggtacgcacgcaccaaacaacagagtagcctatctccaatgccgcggcgtcctctgtcctgatgagccctgacgcggtcgagtgcagaccgaagagacgaagaacgcggacaagaacggccccatcggcatcatcagcgccatcggcatctccatcctcgtgggctggggctacatcctcggcgtcaccttcgcggtcaaggacataccctacctgcttagccccgacaacgacgccggcggctacscatcgccgaggtgttctacctcgccttcaagagccgctacggcagcgcgccggcgggatcgtctgcctgggggtcgtcgccgtcgccgtctacttctgcggcatgagctccgtcaccagcaactccaggatggcctacg

SEQ ID NO: 9345 - DNA, 459 bp, Zea mays
  misc_feature: Ceres CLONE 380826-F
aattaatcaaagaatacggtagtacctgccactgccaaacagccaaagcccaatgaactagacgaattgctcactgctgtgccgtctgtggactgcggaaggcggcaagcggcagtagagcagactcggcgctcgacgctcgggggcggcagaaacggagagacgagcggatttctatacgtcagctcgtttcggcccccgcttgggggcttctcctcggcgtcgtcgctccctccgccgcctcttcctcttcgtgccgagcgctacagagaaagcttgtggacgggcaacgaaccagcggtgtttccatacgcggaaattgcagtacgtgctacaacctacaatatcacatatctcgggtttatccgaagagctcacccatcgacctcatcrgtggtgtgattgattcacgttacaacatctttctgattacctcatcagtggtgtcattacgtcgaa

SEQ ID NO: 9346 - DNA, 432 bp, Zea mays
  misc_feature: Ceres CLONE 380844-F
  misc_feature: Encodes the peptide sequence at SEQ ID NO. 9347
aataagtcagtaagcagcagtaggtcgaaaatggcgatgaggtcgctagcgctactggtcctcctcagcctgctggttgttggtgtggcgcaggcggtggagttggagatggagttggtgcctgctgatgcaattgcgatgactatggatcgtgagccgccgcagagtgcgcgaccccggtgagcgtggaggaggcgtgccgcagcgcgtcggagvsvccgccggcgtggcctacgaccactgcatggcgtcgctgggcgccgacccgcgcacaaggaggccggcaacaagaacatgcacgcgctggcggtgctggccaccaggatggccatcgaccacgccgccagcaccgagtccaagatcgacgacctcgcggactgggagggcggcgtcgtcggatccgcagcgcgcgcacssttcaaccactgcctg

SEQ ID NO: 9347 - protein, 46 aa, Zea mays
  misc_feature: Ceres CLONE 380844-F
  misc_feature (41)..(41): Xaa is any aa, unknown, or other
MHALAVLATRMAIDHAASTESKIDDLADWEGGVVGSAARAXFNHCL

SEQ ID NO: 9348 - DNA, 400 bp, Zea mays
  misc_feature: Ceres CLONE 380891-F
  misc_feature: Pfam Name: LMWPc Pfam Description: Low molecular weight phosphotyrosine protein phosphatase
  misc_feature: SWISSPROT Homolog: EC 3.1.3.48 Protein-tyrosine-phosphatase
  misc_feature (147)..(147): n is a, c, t, g, unknown, or other
acttgttccacttgtagccacccgtcgctacgtgcgtggctgccgcggcgcgtcctagtcgccagtccccaccacgctccaaaccctcgcctccgattcgcgtctgcggcagaggggatggctgcggaassgagcacggcggtgcgncgtcggcagccgaggcgaacctttcgccgtcctcttcgtgtgcctcgggaatatttgccggaktcctgctgckgaagctgtgttttcggaccctcgtaagcaagcgtggggcttgactccaagtttctcatagactctgctggtaccatcgggtatcatgagggtaataaggcagactcaaggwtgagagcagcttcaaagaagcggggggattgaggtcacatcaatatccaggcctatcaaaccctcagat

SEQ ID NO: 9349 - DNA, 470 bp, Zea mays
  misc_feature: Ceres CLONE 380896-F
  misc_feature: Encodes the peptide sequence at SEQ ID NO. 9350
accctaacactcatcacgccgccactgatctgctctgttgctggtgactaggagcagtagcgagagggattctggatggccaagtcgaagaaccacacggcgcataaccagtcgttcaaggcgcacaagaacggcatcaagaagcccaagcgccaccgcagacctccaccaaggggatggacccgaagtttctgaggaacttgaggtactcaaggaagggcaacaagaagagtggcgaggctgagtccgaggagtaagatgatggtgattgagtttgtggcgacaaatgcatctcttgtatcgctaagagtcttagctgtgaacttagttctcacttctgtgtgactgtgatcaaaggacttgtgtatatcaaaggagatccatcagttggtaccgaagtgtatttatgtcttgttggttactggaatttaattaaaaccatcacttgtatccttttgagaattggacaa

SEQ ID NO: 9350 - protein, 39 aa, Zea mays; identical to SEQ ID NO: 7358
  misc_feature: Ceres CLONE 380896-F
  misc_feature (3)..(40): Pfam Name: Ribosomal_L29e Pfam Description: Ribosomal L29e protein family

SEQ ID NO: 9351 - DNA, 476 bp, Zea mays
  misc_feature: Ceres CLONE 380917-F
  misc_feature: Encodes the peptide sequence at SEQ ID NO. 9352
aaaaaaactcccaaacaggacctgttgaactgtccttgcttctaaacggagtgagtagcgatagtgacgcagtcgtcttgccgccgccgtcccaaacgtccgcgcggtcgtcctcgatcttcccgtaccatcccgacgcgatggccgccggcgcgaagcccgataccgccgcgcccccgcaagcgccttcggcggcgaagggggtcttcatgcgccgcatcttccccttcctcctcgcgacgaacgtcttcatcggagtttatgtatttgccaagacctacaaaagagaccaggaaaagaaaaatgctcagactactgccgctgcagcattgtcatccccagcaagtacatctgccgaggctccagatcctgctcctgcacctgcgcccaaatcggttctcccacctctatccgaagatgagcagtggaatctgtacaaatggattctggaagaggagcggaagatcaaaccacgc

SEQ ID NO: 9352 - protein, 112 aa, Zea mays
  misc_feature: Ceres CLONE 380917-F
MAAGAKPDTAAPPQAPSAAKGVFMRRIFPFLLATNVFIGVYVFAKTYKRDQEKKNAQTTAAAALSSPASTSAEAPDPAPAPAPKSVLPPLSEDEQWNLYKWILEEERKIKPR

SEQ ID NO: 9353 - DNA, 394 bp, Zea mays
  misc_feature: Ceres CLONE 380927-F
  misc_feature: Encodes the peptide sequence at SEQ ID NO. 9354
gagtcgtcttcccgttgatcggcaaagagactttagggttttagcggcttctatttctgagcgagggtttatccgccagkgsscgcgacgcggcggcagttgagctgggatttccttcccatcccgttcccttccaggcgaggcgatggacgaggcggcggtcgacgacctcatccggcggctcctcgaggcccgcggcgggcgcaccccgcgcaacgsaggttgaccgacgctgagatccggcgcctctgcgcccgccaagggatgtgttcctctcccagcccaacctccttggagctcgaggcccccatcaagatatgcggggatgtccatggtcagttattcagaccttcttcgattattttgagtatggtggctatccaccagatgcaaa

SEQ ID NO: 9354 - protein, 43 aa, Zea mays
  misc_feature: Ceres CLONE 380927-F
  misc_feature: SWISSPROT Homolog: EC 3.1.3.16 Phosphoprotein phosphatase
MCSSPSPTSLELEAPIKICGDVHGQLFRPSSIILSMVAIHQMQ

SEQ ID NO: 9355 - DNA, 426 bp, Zea mays
  misc_feature: Ceres CLONE 380931-F
  misc_feature: Encodes the peptide sequence at SEQ ID NO. 9356
atggaccggttaacacacccacgcctaaaaaaaccgtaataggaaaaacgactccacacggtccacggcgtcgtctccggcgaaccttcgcgagccctcggctcccctctaccaccgctgccgcgaccccgcctacggagcatcctcgggtagcgctctggcttcccgtgccggcggacgtcctgcaggaggcggcggcctccgtggcatgttgatgagggccgccgctgccctccctcgccgatcgtcgcggccctcggagccggggtcctcctcctcccgggctcccgcccctggggcctcctccagccgggctcctgcccccggggcctccttcgaccccttcgatgtcgataccgacccgccatcgcggcttgagctgacgcccgagcagatcgggctctgcgttgaccgcgctcgcgcatt

SEQ ID NO: 9356 - protein, 72 aa, Zea mays
  misc_feature: Ceres CLONE 380931-F
MLMRAAAALPRRSSRPSEPGSSSSRAPAPGASSSRAPAPGASFDPFDVDTDPPSRLELTPEQIGLCVDRARA

SEQ ID NO: 9357 - DNA, 255 bp, Zea mays
  misc_feature: Ceres CLONE 380985-F
  misc_feature (162)..(162): n is a, c, t, g, unknown, or other
  misc_feature (227)..(227): n is a, c, t, g, unknown, or other
atcactcaccaagactccaagcactcacctcctcagctcattgccagcctttgttccttccagctagcaaccggacggccagccagccagcagactagtagtagctcttctcacacctactgtgtctgtgtctgtatgtgctcgcctttagcggcaagcgancccacccccccttcggtagcgagcgacaatgcagtacgcggcggcggacaggcgtggtacatgcnggcgaccacgacgatgatggcggagagc

SEQ ID NO: 9358 - DNA, 477 bp, Zea mays
  misc_feature: Ceres CLONE 381012-F
  misc_feature: Encodes the peptide sequence at SEQ ID NO. 9359
akcgtgtcgtttcttccctttcccgtttcccccgttcagttcagcttcggttggctcgccgtactcgggtttgttcctcgcctcgcttccttcctccgcagtcctcgtctcgaattcgctcgcggtgggagaaatcggggcgcgaggatgaccgtgatcgacatcctcacccgggtggacgcgatctgccagaagtacgacaggtacgacgtcgacaagctcaacggcgcgaacgtcgccggcgacgacccgttcgcccgcctctacgcgtccgtcgacsssacatcaaccaatgcgtcgataaagcggaaacggcgaacgaagagaagaaccgggccgcggtagtggcgcttaacgccgagatccggcgcaccaaggccaagctcctcgaggaagacctccccaagcttagcgcctcgccgttaagaaggtgaaagggctgacaagagaagaaattgcgacccgtagtgatctggt

SEQ ID NO: 9359 - protein, 65 aa, Zea mays
  misc_feature: Ceres CLONE 381012-F
  misc_feature (45)..(45): Xaa is any aa, unknown, or other
MTVIDILTRVDAICQKYDRYDVDKLNGANVAGDDPFARLYASVDXTSTNASIKRKRRTKRRTGPR

SEQ ID NO: 9360 - DNA, 216 bp, Zea mays
  misc_feature: Ceres CLONE 381018-F
  misc_feature: Encodes the peptide sequence at SEQ ID NO. 9361
  misc_feature (104)..(104): n is a, c, t, g, unknown, or other
gcgcgctagacgcacgagcgcgaacacgaacacgaacacgaacaccataacgcggcggccatggtgggcggcggcggcggcggcgacccaaggccggagacgangcccttctccgacggagacgccacggagtcggacaccgacgatgtctcctccgcagggattagtgctcgccgccccggsccaccaccaacccgatcctgactcgcctcgcgg

SEQ ID NO: 9361 - protein, 47 aa, Zea mays
  misc_feature: Ceres CLONE 381018-F
  misc_feature (15)..(15): Xaa is any aa, unknown, or other
MVGGGGGGDPRPETXPFSDGDATESDTDDVSSAGISARRPGPPPTRS

SEQ ID NO: 9362 - DNA, 470 bp, Zea mays
  misc_feature: Ceres CLONE 381021-F
  misc_feature: Translation starting site: 90
  misc_feature: SWISSPROT Homolog: EC 2.5.1.18 Glutathione transferase
  misc_feature (343)..(343): n is a, c, t, g, unknown, or other
gcttgcaggttcctcttcttccgtcgctctcgctctcggtctcggactacggttgagcgaagtcgtcactgtaatctactgatctgcaaatggcggaggcggaggcggaggcgacggtggggcgactgatgctgtactcgtactggcgcamgcgtgctcccaccgtgcccgcatcgctctcaatctcaaaggtgtggattacgagtacaaggcggtgaaccttctcaagggcgagcagtctgatccagaattcgtcaagcttaatcctatgaagttcgtccctgcgttggtcgatggcagttctgtaataggtgactcttacgcgatassactgtatttggangacaagtacccagagcctcctcttctacctcaagaccttcaaaagaaagctttgaatcaccagattgcaagcattgtagcttctggtattcaacctctccataacctcacagtgttgaggttcattg

SEQ ID NO: 9363 - DNA, 435 bp, Zea mays
  misc_feature: Ceres CLONE 381032-F
  misc_feature: Translation starting site: 184
  misc_feature (299)..(299): n is a, c, t, g, unknown, or other
  misc_feature (300)..(300): n is a, c, t, g, unknown, or other
agccttatagccacatcccggccagccgcagcaagtgcccagaaggccagaaccagaaccaggtagcccgtgcamctcatatcatcccctgccacgcacctccgtccgccgcgccatggaatcgaggaggagggccgtgccaccgtgacggcggttgckgtggcgacgctgctgctgctgctgatgtcgtcgggcgtgggcggcgacttcgcggcggaccgggcggagtgctcggagcagctggcggggctggcgacgtgcctgacgtacgtgcaggagcaggcgacggcgacggcsanncgcccgactgctgcgcgggcctgaaggcggtgctgcagagcvscggcaagtgcctgtgcgtgctggtcaaggaccgggacgaccccaacctaggcctcaagctcaacgtcgacaaggcgctcggccctccccgcc

SEQ ID NO: 9364 - DNA, 342 bp, Zea mays
  misc_feature: Ceres CLONE 381046-F
  misc_feature: Encodes the peptide sequence at SEQ ID NO. 9365
attagagtgtttacgccgagacttgaaaacggcatcagtagcagacggaggcgaccacgagcgacggggccagccgcggtccccaacgtcagaggatctcgttccagccgcggcagggcgcacaacaccggcacctcatgggcgccgacgacgacgccgccgccgccatggaggcgcaagagagggaggcggagatcgagaaggccatgcgcgcccgcgtcgcagmttcaagaagcaggccgattccttgactcttgaaggcgttaggagagcactggaaaaggacctggatttgaagatatattcacttgatgcacataaaaagtttataaagcaatgtgt

SEQ ID NO: 9365 - protein, 113 aa, Zea mays
  misc_feature: Ceres CLONE 381046-F
  misc_feature (75)..(75): Xaa is any aa, unknown, or other
LECLRRDLKTASVADGGDHERRGQPRSPTSEDLVPAAAGRTTPAPHGRRRRRRRRHGGAREGGGDREGHARPRRXFKKQADSLTLEGVRRALEKDLDLKIYSLDAHKKFIKQC

SEQ ID NO: 9366 - DNA, 479 bp, Zea mays
  misc_feature: Ceres CLONE 381110-F
  misc_feature: Encodes the peptide sequence at SEQ ID NO. 9367
  misc_feature (384)..(384): n is a, c, t, g, unknown, or other
  misc_feature (408)..(408): n is a, c, t, g, unknown, or other
caggccacaatggcgtcgctgctgcgcctcccctcgctgctctccccgtccaagcccctgctccggcgccggctgacggcggcgaggttcgcggcatacgccgcatccaggggtcaagcctcggcgaccgcgggcgcggcgtcgccggcggccgcggagacccgcggcggggacagggaggggcaggtcacgccgcggtccgtggacttcaacgcctggtacacggacgtcatcgccgctgcmgagctcgcggactacgggcccgtgcgaggtaccatggtcattcgcccctacggatacgccatctgggaggccatccaggattatttgaatgtcaaattcaaggagacaggtcacagcaacatgtacttccctcagttcatnccatactcatttatagagaakgangctagtcatgttgaagggtttagcccggagcttgcattggtcaccattggaggaggaaaagaactagagga

SEQ ID NO: 9367 - protein, 156 aa, Zea mays
  misc_feature: Ceres CLONE 381110-F
  misc_feature: SWISSPROT Homolog: EC 6.1.1.15 Proline--tRNA ligase
  misc_feature (125)..(125): Xaa is any aa, unknown, or other
  misc_feature (132)..(132): Xaa is any aa, unknown, or other
  misc_feature (133)..(133): Xaa is any aa, unknown, or other
MASLLRLPSLLSPSKPLLRRRLTAARFAAYAASRGQASATAGAASPAAAETRGGDREGQVTPRSVDFNAWYTDVIAAAELADYGPVRGTMVIRPYGYAIWEAIQDYLNVKFKETGHSNMYFPQFXPYSFIEXXASHVEGFSPELALVTIGGGKELE

SEQ ID NO: 9368 - DNA, 371 bp, Zea mays
  misc_feature: Ceres CLONE 381125-F
  misc_feature: Encodes the peptide sequence at SEQ ID NO. 9369
  misc_feature (33)..(33): n is a, c, t, g, unknown, or other
  misc_feature (79)..(79): n is a, c, t, g, unknown, or other
  misc_feature (82)..(82): n is a, c, t, g, unknown, or other
  misc_feature (130)..(130): n is a, c, t, g, unknown, or other
  misc_feature (319)..(319): n is a, c, t, g, unknown, or other
gtaggagtaggagcaggagatagcgcgggcggnggaggggaaggagacaagtgaactcagagaagaactagcgckgtyntgntagcattgcaakccgagctgcaggggcccggagcggagaccggagaknggagacgtcgcttcgatgtcaccggcagcatccgccgccgaaaccgccgtcgtcgtcgtcgtcgcaagcgtcccgagccagcagcagagcagccaccgcgccgsscgccgttccgtcccgtcgtcctacgccgtctgggagaaggagcggtaaggcgtctgcagctttacgacgacgtskcgtccttgnccacctacctactgctgctgctgctgcaagtggaagtaaaaagggaacggaa

SEQ ID NO: 9369 - protein, 45 aa, Zea mays
  misc_feature: Ceres CLONE 381125-F
  misc_feature (30)..(30): Xaa is any aa, unknown, or other
MSPAASAAETAVVVVVASVPSQQQSSHRAXRRSVPSSYAVWEKER

SEQ ID NO: 9370 - DNA, 965 bp, Zea mays
  misc_feature: Ceres CLONE 381133-R
  misc_feature (888)..(888): n is a, c, t, g, unknown, or other
  misc_feature (916)..(916): n is a, c, t, g, unknown, or other
tattacattctctcaactcccaacaaccttttccttttttagggtgcaattgggtaacgggccccccctcgaggtcgacggtatcgataagcttttttttttttttttttcacgagtcgaggcgacgaggtttataatcagttgaagtgtggtaactccggttactgtcaccctaaatggtagcgctaatcaagaaccctaatcatatatcagatgatatcacatcaaagttgacacgggcacacggcacacacaaacacactagcgctgtcggtggatcagacagcaaagtcggcgacgcggcgcatccggctgcccctcccgcgcctatgcaacaccgcaacgtctccacctcgaccagaggaaccccccggacctccccgacaacgctgtacccccggcagcggcctatgggttatcttaggtcagcacccctttcatatataatatgtacatgtaagcgcagctcccgctattccactcccttagacttaaacacttgcaccgggaatgcacaatccacggctattcgtctgtacaaacgattaaacactgatccccaccctttaaacttcctccgcatcttatcaccatacacattatatggctcctgttaacgccctcttcaccgctcccaaagacctgcaaccacacttaacacaaaattcctcacctatcaattctcagcacgtgagtaaacattggacacatccacactatatgctaccacatgaaaatactctgtagccgcgtgggcaccagacttgttgacccctactccacttcgctcaccgcttatcccccacattctgaactctatgaaccagagtgaatctagtatatttaaatctgtcgcacaactgtgatttccctgtcttaacacacctnttattaacatgaagtatcagagtatggntcattctaagaacttctctaatccctcttctacactcattcaccagtcg

SEQ ID NO: 9371 - DNA, 415 bp, Zea mays
  misc_feature: Ceres CLONE 381139-F
  misc_feature: Translation starting site: 212
  misc_feature (119)..(119): n is a, c, t, g, unknown, or other
  misc_feature (343)..(343): n is a, c, t, g, unknown, or other
agttccagttgagttcacctcttggctcttgcctcctgcatctctagagaggcacatcccagctccaagcttcgcgccttgttggatcgtggcgtccaagcaacggtggtagcggassngaggcagtggccgcagaaggaagcgcgacgatccatggaccaacgccaggtggttagcgagaattatgccaatcccataacatgcttcttccatgtgctattcaaggcgggggcgctacttctacatcctattctcgctctttgtgaagagcttcgtcatcatcttcgtgatcacggtgctcctcgcagcgcttgacttctgggtggtgaagaacgttcakkgncaggatactagtcgggctgcggtggtggaatgagatcgatgatgacggaaacagttgtgtggaagtttgaat

SEQ ID NO: 9372 - DNA, 494 bp, Zea mays
  misc_feature: Ceres CLONE 381161-F
  misc_feature: Encodes the peptide sequence at SEQ ID NO. 9373
  misc_feature (251)..(251): n is a, c, t, g, unknown, or other
  misc_feature (314)..(314): n is a, c, t, g, unknown, or other
  misc_feature (372)..(372): n is a, c, t, g, unknown, or other
  misc_feature (443)..(443): n is a, c, t, g, unknown, or other
agaccattcccaacgaaattgtaacctgttgcaaccggcctatctccttgcccgcgamscatggcggatgccccgcgatggcctcatcaccaccggcgtccgctgacgacggcggtccatcctcgccttccgtagccgtccctcgtgtacttccctccagattgctcctagacaccccgcctccttccagcggtaggacgcggggcccssggggcgcagtgcggctgcgtcgtcgaggcgcggcgggcgangcggaggcacgaggagggagtccacttttgccggctgcggcttcaaacggtacaggaggggangaggccggagcgggactggctcgccgaggcggttatgatgatcggggggccagtcgangacgcgggactggcatccgccgacattcttcagctggcgatggcgawggggcctatgttcgagtggctganctactggccggagaggggtactcaacgaagatcatccctactgacgcacgg

SEQ ID NO: 9373 - protein, 139 aa, Zea mays
  misc_feature: Ceres CLONE 381161-F
  misc_feature (45)..(45): Xaa is any aa, unknown, or other
  misc_feature (58)..(58): Xaa is any aa, unknown, or other
  misc_feature (79)..(79): Xaa is any aa, unknown, or other
  misc_feature (99)..(99): Xaa is any aa, unknown, or other
  misc_feature (114)..(114): Xaa is any aa, unknown, or other
  misc_feature (122)..(122): Xaa is any aa, unknown, or other
MASSPPASADDGGPSSPSVAVPRVLPSRLLLDTPPPSSGRTRGPXGAVRLRRRGAAGXAEARGGSPLLPAAASNGTGGXEAGAGLARRGGYDDRGASRXRGTGIRRHSSAGDGXGAYVRVAXLLAGEGYSTKIIPTDAR

SEQ ID NO: 9374 - DNA, 486 bp, Zea mays
  misc_feature: Ceres CLONE 381201-F
  misc_feature: Encodes the peptide sequence at SEQ ID NO. 9375
  misc_feature (370)..(370): n is a, c, t, g, unknown, or other
tttccttcgtttccgtccgtttccgttttcatcctacctgctcgagacagcccgcctaccgtccatatgcactcgtgctgtgtgctgtcacttccctttcttctttccctaatccccatctccccttctctcgctgctggtggcctgcgaatggcgggcggaagcggcgaggcggctatgtctccgccgtcctctagtgccagcgggaagcgcgggcgggacccggagaggacgtgtacgtggacaatctccattcccacaaacggtatctcagcgagataatggcatccagtctgaatggactgtctgttggggattcactgcctgacaacatcatggagtcccctgcaagtcagagactgcttcctgntacagggatgagatattatcccaatactcaccgatgtcagaagactcggatgattaccggtgctatgacactcaattaaaccccagtgggaatcatcctgatgcgatgatcagccc

SEQ ID NO: 9375 - protein, 55 aa, Zea mays
  misc_feature: Ceres CLONE 381201-F
  misc_feature (30)..(30): Xaa is any aa, unknown, or other
MASSLNGLSVGDSLPDNIMESPASQRLLPXTGMRYYPNTHRCQKTRMITGAMTLN

SEQ ID NO: 9376 - DNA, 455 bp, Zea mays
  misc_feature: Ceres CLONE 381225-F
atgtatgatggatgtgtgtggtttctgattctgtgcttgtgcgtgggttggcccagtcgatgcgagcgaggactccatgysagagctccgaagagatggtgacccccagggccgccgcgtcggagccggacgaggaggagaggaaggcccccgcgggccgaggttcccgtggagcgtgccgtcgaggcggacgtcgccgggtctggggaggtcactgtggacgcgtttccaccggaaaccgctgggcatgtacgtgagggcgaggtggatgaagcagaggtggaggtgcacaccgtggtggcacaggaaccggaggtgaaggatgtgttggtggccgaggaatccgtggtacaggagtcagtggctgatgcgccggcggtgaaggaggtggccaaggtgcatccggtgcttgaatctgagctgaaggttgatgaagttgtgstggtcgagcaaac

SEQ ID NO: 9377 - DNA, 509 bp, Zea mays
  misc_feature: Ceres CLONE 381273-F
  misc_feature: Encodes the peptide sequence at SEQ ID NO. 9378
aatccatctaaccaaacacccatgaacccaccgaaaaaccctccgtttcaccgagggctcagttcgcacgcttcccaacatggctctcggtgccctagcccgcctcctccgccttgcgcccacccctcgcctcgcgcgccccttcgctgcaaaggtccgtgcgtctcggccgcaggaaccggagcttccgtcggaggacgacaacgacttcgccggcggcgaggtcaccgcccccaccgagggcatcggcaagccgctcgccgaggtgctcaaagagctcgggaagagggttccggactcccttgtcaagacccgcgtcgagaataatggcttcgctatcaagtacatcccatggcacattgtgaacaaaattctcaacatacatgctccagagtggtcgggtgaggtacgcagcattgtttactcatttgacgggaaaacagtatctgttgtctatcgargtgactccttcatgggattgatgccgagatctatagagaggccactgg

SEQ ID NO: 9378 - protein, 143 aa, Zea mays
  misc_feature: Ceres CLONE 381273-F
  misc_feature (128)..(128): Xaa is any aa, unknown, or other
MALGALARLLRLAPTPRLARPFAAKVRASRPQEPELPSEDDNDFAGGEVTAPTEGIGKPLAEVLKELGKRVPDSLVKTRVENNGFAIKYIPWHIVNKILNIHAPEWSGEVRSIVYSFDGKTVSVVYRXDSFMGLMPRSIERPL

SEQ ID NO: 9379 - DNA, 467 bp, Zea mays
  misc_feature: Ceres CLONE 381283-F
  misc_feature: Encodes the peptide sequence at SEQ ID NO. 9380
atagtaccattcactgatccaagacaaaacatggctgtgaatgtaagcaccatgtggtcgtcgatgcaggcacaggtggcgatggctatggcgttggcgttcttggtgagcggcgcctggtgcggtcctcccaaggtcccccctggcaagaacatcacagccacctatggcaaggactggctggacgctaaagcgacatggtatggcaagccgacgggtgccggtcccgatgacaacggcggcggctgcgggtacaaggacgtgaacaagccccccttcaatagcatgggcgcgtgcggcaacatccccatcttcaaggatggtctgggttgtgggtcctgctttgagatcaagtgcgataagcctgtggagtgctccggcaagcccgtggtggtgcacatcacggacatgaactatgagcctatcgcggcgtaccacttcgatttggcaggcacggcgttcggtgc

SEQ ID NO: 9380 - protein, 138 aa, Zea mays
  misc_feature: Ceres CLONE 381283-F
  misc_feature (80)..(138): Pfam Name: DPBB_1 Pfam Description: Rare lipoprotein A (RlpA)-like double-psi beta-barrel
MWSSMQAQVAMAMALAFLVSGAWCGPPKVPPGKNITATYGKDWLDAKATWYGKPTGAGPDDNGGGCGYKDVNKPPFNSMGACGNIPIFKDGLGCGSCFEIKCDKPVECSGKPVVVHITDMNYEPIAAYHFDLAGTAFG

SEQ ID NO: 9381 - DNA, 478 bp, Zea mays
  misc_feature: Ceres CLONE 381342-F
ccccagtattctgctcaagcacaccgcagaaaaagaaaaagaaaaggcaaaggcaaaggaatcccaatcaggcaagcaaaaaggaagaaccaggtgctgcggccggagatgtcgtcgcagctgatcgaggagcaccggtcgggcgcggaggtgcacgtcgggcacgagctgtgcgagcgcaagtcgcgcgagttcatggtggagctgggcctccccgacggctcctcccgctgcccaggctcgacgaggtgggctacaaccggtcgacggggttcgtgtggctgcggcaggccgccggcttaccccacaccttcgggtccatcggcaagcaggtttggttacgacagggaggtgacggcgttcgtggagccggggcgtattcacggcctcgccgggtggtgaagagcaaggagctcctcatctgggtcaccatctccgagatcgtcctcagccctccggcaccaagatcgtgttccgc

SEQ ID NO: 9382 - DNA, 257 bp, Zea mays
  misc_feature: Ceres CLONE 381367-F
atcttctcgcccagatccacaagtttcttgggtagaggaggcactagatactgtgccagatcggggtctggtagtggcagttgggtgattacgacggagtgggatgggcctcctcgacaagctgtgggacgacaccgtcgcgggcccgcgcccggacaccggcctgtcttgttactttgtcatgaacctatctgtataatgtcatgctgttctttaaaaaaaaaaaaaaaaaaaaaaaaaaaaaaaaaaaaaaaaaa

SEQ ID NO: 9383 - DNA, 467 bp, Zea mays
  misc_feature: Ceres CLONE 381375-F
  misc_feature: Translation starting site: 185
  misc_feature (307)..(307): n is a, c, t, g, unknown, or other
atagccttatagccacataccggccagccgcagcaagtgcccagaaggccaraaccaraaccaaggcagctcgttgcacctcatatcatcccctgccacgcacctccgtccgccgcgccatggaatcgaggaggagggccgtgccaccgtgacggcggttgcggtggcgacgctgctgctgacgatgatgacgtcgtcgggcgtgggcggcgacttcgcggcggaccgggcggagtgctcggagcagttggcggggctggcgacgtgcctgacgtacgtgcaggagcaggcgacggcgacggsssancgcccgactgctgcgcgggcctcaaggcggtgctgcagagcasscgcaagtgcctgtgcgtgctggtcaaggaccgggacgaccccaatctaggcctcaagctcaacgtcgacaaggcgctcggcctccccgccgtctgccacgcgcccgccaacatctc

SEQ ID NO: 9384 - DNA, 274 bp, Zea mays
  misc_feature: Ceres CLONE 381406-F
  misc_feature (119)..(119): n is a, c, t, g, unknown, or other
acgttgagctagctctagctataggtacagtacagtcacggagtctcggctcggccatgggcaactgcgtccagatcagcagcggcgcgtcggcgtcggcggcagtagaagctgcgcgnccgccgtagaagcagggtgccagcagccgcaacggaggagaagcactgccggcggtgatgaggaggaggcaataattgatcaagcgatgacaccgtcgtcaatcttgaaggtgaagatggtgctgaccaagggcgagctggggtggctcgtggcg

SEQ ID NO: 9385 - DNA, 450 bp, Zea mays
  misc_feature: Ceres CLONE 381409-F
  misc_feature: Encodes the peptide sequence at SEQ ID NO. 9386
atacgtttcctgaaccaatccattaaagatcacaacagctagcgttctcccgctagcttccctctctcctctgctgatctttttcgtccaccagcatgtaggagaagaggaagctgcagtggcggcgagggcgtgatggcatcgtgcagtaccctcacctgttcttcgcggccctggccctggccctcctagtcgcggacccgttcggcctcagtccgctggccgaggtcgactaccggccggtgaagcacgagctcgcgccgtacggggaggtcatgggcagctggcccagagacaatgccagccggctcaggcgcgggaggctggagttcgtcggcgaggtgttcgggccggagtccatcgagttcgatctccagggccgcgggcgtacgccggcctcgcgacggccgcgtcgtgcggtggatgggcgaggaggccgggtgggagacg

SEQ ID NO: 9386 - protein, 58 aa, Zea mays
  misc_feature: Ceres CLONE 381409-F
MGSWPRDNASRLRRGRLEFVGEVFGPESIEFDLQGRGRTPASRRPRRAVDGRGGRVGD

SEQ ID NO: 9387 - DNA, 448 bp, Zea mays
  misc_feature: Ceres CLONE 381417-F
  misc_feature (137)..(137): n is a, c, t, g, unknown, or other
  misc_feature (379)..(379): n is a, c, t, g, unknown, or other
gcacctggctgcgtgtcgtcattcctcttccctcggctgcttcttgcctccacattcccgccatgaaatcctagcgccagttcggctaaatctagggacaacaagcggtgcaaacaaatggggtggtgccgcmgtancagccgctcccgcgcgcgtggcagcacgtagcgcgcgctgtgcggtgcagcgggcagcctcgactggcattggcggcttggcgttccgctgcccgctggaggcaaggatgaaccacattggcacatcgccatcaattaggaacataccatgtcttttctgaaattcgaatgcaaatgaacacctcatccaacagaatgttcagggagggaacacctttcagaaaagaagagaaacggagwgntgggaactcaactgtgaaggctgcgtctgcgcttasctttgtgaatatggtgatggatcttatggtcat

SEQ ID NO: 9388 - DNA, 438 bp, Zea mays
  misc_feature: Ceres CLONE 381419-F
  misc_feature: Encodes the peptide sequence at SEQ ID NO. 9389
  misc_feature (186)..(186): n is a, c, t, g, unknown, or other
  misc_feature (347)..(347): n is a, c, t, g, unknown, or other
acccgcgakgccgcgaccggcgaccgcccgcccctgacgcggtgactgctcctcctccgctctccgtgcgccaccctgaagckgtgaggcggcgacctccaggcaccgcctcccccggttcggcggctccctcgaggccttcctccccaccggttcagcagctcccgatccacacggccaaaggcntttcgcgctcctccagccttcctccgcgtccaacagcaagtgaaaaacttcaacccaggaatggcgatgtcttggacaagagggttaaagcatggtgttgttccgaggcatgccgctcaattggtagagagcagaagccttgcaattgcaagcaaggcganacaagggtggaaaagggtgatgctggcaaaactcctgctctcagccaagagctcaagagttacaacagtgtttcggggcaaacatcttcaa

SEQ ID NO: 9389 - protein, 64 aa, Zea mays
  misc_feature: Ceres CLONE 381419-F
  misc_feature (34)..(34): Xaa is any aa, unknown, or other
MAMSWTRGLKHGVVPRHAAQLVESRSLAIASKAXQGWKRVMLAKLLLSAKSSRVTTVFRGKHLQ

SEQ ID NO: 9390 - DNA, 449 bp, Zea mays
  misc_feature: Ceres CLONE 381420-F
  misc_feature: Encodes the peptide sequence at SEQ ID NO. 9391
  misc_feature (171)..(171): n is a, c, t, g, unknown, or other
gtttcccagacccacacacgcaagaagccagcgcgcacaacagaacgaacgccacagcgcgagtggagtcggtggacgagacagagagggggaggaacgacggcgacggccatktgagacggtggcggacacagaggggtggacaactgggcgacassaccgcagcggcgncttctggttgagaacggagatcgagacggaccggggggtcccattcccaggtaggggccccgggttcgggtttgccgccgccgtgcggagccgctggtgaagctccggcggccccggtatgacttcgagaggtgggactggggctacttcgtctggcctcacgaccgtctcgacgccaatcttgagatgagggacagtgacccggagcgacgcttgaagccgacttgaaggcgggcgagacttcgtgaaccagagaacgctgcagctggagagctacg

SEQ ID NO: 9391 - protein, 89 aa, Zea mays
  misc_feature: Ceres CLONE 381420-F
  misc_feature (38)..(38): Xaa is any aa, unknown, or other
  misc_feature (52)..(52): Xaa is any aa, unknown, or other
  misc_feature (53)..(53): Xaa is any aa, unknown, or other
  misc_feature (57)..(57): Xaa is any aa, unknown, or other
FPRPTHARSQRAQQNERHSASGVGGRDREGEERRRRPXETVADTEGWTTGRXXRSGXFWLRTEIETDRGVPFPGRGPGFGFAAAVRSRW

SEQ ID NO: 9392 - DNA, 484 bp, Zea mays
  misc_feature: Ceres CLONE 381430-F
  misc_feature: Encodes the peptide sequence at SEQ ID NO. 9393
aaaaacacaagacctcctattcaccatgccgaccgaagagggttccgacggcggtggcggcgcggagccggagccggggagaagaagagctcgcaggcgcccgcaaagcctggagcgtgcggcgccgcaaagttcctcgcggggttgccgtcgcgcggcaatttctcttccggctccgcccctccaatctgggagggttcagggtttacgtctgcgagcacagcacagatcccccagaaggacaagttataaagacggattcaacgaatattttaatcaggcatctccagttgaacaagcagaagactgagggcaaagatgtggattccagaactgtcggcgaaaacaacagaggtaaaagatctgctgccagaagtttggatgtcaacaattcagcaaagaaggctaacttgggtacttcatctggatcatcagcctatgaggaaatttctggcttttcacaacacacactgcagtcatttac

SEQ ID NO: 9393 - protein, 160 aa, Zea mays
  misc_feature: Ceres CLONE 381430-F
KHKTSYSPCRPKRVPTAVAARSRSRGEEELAGARKAWSVRRRKVPRGVAVARQFLFRLRPSNLGGFRVYVCEHSTDPPEGQVIKTDSTNILIRHLQLNKQKTEGKDVDSRTVGENNRGKRSAARSLDVNNSAKKANLGTSSGSSAYEEISGFSQHTLQSF

SEQ ID NO: 9394 - DNA, 514 bp, Zea mays
  misc_feature: Ceres CLONE 381431-F
  misc_feature: Encodes the peptide sequence at SEQ ID NO. 9395
actgtaatagcacaaagcggtccattcccttcgtgcttgttttctctagggtttttgccacgccgccgccgctctgccccttccaccccaccgatataccaagatgacggcgcaggctgcggaggagctcgccgcccagatcgagcagcagaagctcgaggagcagaagaccgaggcagaagaggttgtggtggaggaggatgacgaggatgatgaggatgacgatgatgatgacaaggatgatgatgaactggatggacaagaaggggatgggagtggcaagtcgaagcaaagcaggagtgagaagaagagccgcaaggccatgctgaagcttggcatgaagcccatcactggtgtcagccgggtcactgtgaagaaaagcaagaatatgctttttgtcatctcgaagccagatgtgttcaagagcccaaactcggacacctatgtcatattcggcgaggcgaagatcgaggacctcagctcccagctgcagacccaagctgcagarcagttc

SEQ ID NO: 9395 - protein, 137 aa, Zea mays
  misc_feature: Ceres CLONE 381431-F
  misc_feature (65)..(124): Pfam Name: NAC Pfam Description: NAC domain
MTAQAAEELAAQIEQQKLEEQKTEAEEVVVEEDDEDDEDDDDDDKDDDELDGQEGDGSGKSKQSRSEKKSRKAMLKLGMKPITGVSRVTVKKSKNMLFVISKPDVFKSPNSDTYVIFGEAKIEDLSSQLQTQAAEQF

SEQ ID NO: 9396 - DNA, 328 bp, Zea mays
  misc_feature: Ceres CLONE 381449-F
  misc_feature: Encodes the peptide sequence at SEQ ID NO. 9397
  misc_feature (103)..(103): n is a, c, t, g, unknown, or other
ccggggcacgaaaccctaactgaaccccatggcgctctccaccgctcgccggctctccaccaccgcgtcctcctcctccgtcgccgacgmrccgccaaagctncgtcgctgttccagaacccgaagcctcgaccgctgccggtccccggcgtcgaggtgccgcggcggggggccaggcccaggccgaggcagccctgggaggaggaggcgggggcgctgctgctgcggctccacaaggggaggtacctcccgggccccgacctctcgtcgcgccgcacgctgtctcaccgacgccgtcaagaccgccgccgagtggttcgggcatgac

SEQ ID NO: 9397 - protein, 108 aa, Zea mays
  misc_feature: Ceres CLONE 381449-F
  misc_feature (31)..(31): Xaa is any aa, unknown, or other
  misc_feature (35)..(35): Xaa is any aa, unknown, or other
PGHETLTEPHGALHRSPALHHRVLLLRRRRXAKAXSLFQNPKPRPLPVPGVEVPRRGARPRPRQPWEEEAGALLLRLHKGRYLPGPDLSSRRTLSHRRRQDRRRVVRA

SEQ ID NO: 9398 - DNA, 468 bp, Zea mays
  misc_feature: Ceres CLONE 381477-F
  misc_feature: Encodes the peptide sequence at SEQ ID NO. 9399
agagcagagaacgcaggcagaggcaccataccagtcaaccaccgcttcgttctcctcccacaccgctcgccttcgcctccccatcttctatcatccccgagctccagttctccacacctcacgtctataaataataaataaggcgcccgcccatcaattcgtgtcaccgcgtcccgagagcgcaaatcattccgcgcgacgcaaaaaccctagcctagccaccgatccctctcatggcaaccaccaccacccaggcgagcctcctcctccagaagcagctaagagatctcgcgaagcaccccgtggatgggttctctgctgggctggtcgacgacagcaatgtcttcgagtggcaggtcaccatcatcggaccgcctgacaccctatatgatggaggttacttcaatgcaataatgagcttcccacaaaattacccaaacagcccgccatcagtcagatttacctctg

SEQ ID NO: 9399 - protein, 78 aa, Zea mays
  misc_feature: Ceres CLONE 381477-F
  misc_feature (11)..(78): Pfam Name: UQ_con Pfam Description: Ubiquitin-conjugating enzyme
  misc_feature: SWISSPROT Homolog: EC 6.3.2.19 Ubiquitin--protein ligase
MATTTTQASLLLQKQLRDLAKHPVDGFSAGLVDDSNVFEWQVTIIGPPDTLYDGGYFNAIMSFPQNYPNSPPSVRFTS

SEQ ID NO: 9400 - DNA, 311 bp, Zea mays
  misc_feature: Ceres CLONE 381508-F
  misc_feature: Encodes the peptide sequence at SEQ ID NO. 9401
  misc_feature (122)..(122): n is a, c, t, g, unknown, or other
  misc_feature (124)..(124): n is a, c, t, g, unknown, or other
  misc_feature (125)..(125): n is a, c, t, g, unknown, or other
agagattcagagaagacccgcctctcccgtgagccgtgacgcgacgccggatcgtcctcgtctcctagctcgtggaatgaagggaggtggcgtcatcaggkccgccggcggaggtgccggcntnncgggtctgttgcgaacssgactgcgacttcccgtggtgctcmtctccwgctccctcttcttcctcgccggcttcttcggctcgctcctcttcacccaggatccggagaggcggatatgccgataccgagagagcggctgttggaggcgggcgtggcggagatgccttacggcgagtccggcgaggc

SEQ ID NO: 9401 - protein, 78 aa, Zea mays
  misc_feature: Ceres CLONE 381508-F
  misc_feature (9)..(9): Xaa is any aa, unknown, or other
  misc_feature (16)..(16): Xaa is any aa, unknown, or other
  misc_feature (17)..(17): Xaa is any aa, unknown, or other
  misc_feature (23)..(23): Xaa is any aa, unknown, or other
  misc_feature (31)..(31): Xaa is any aa, unknown, or other
  misc_feature (33)..(33): Xaa is any aa, unknown, or other
MKGGGVIRXAGGGAGXXGLLRTXLRLPVVLXSXSLFFLAGFFGSLLFTQDPERRICRYRESGCWRRAWRRCLTASPAR

SEQ ID NO: 9402 - DNA, 414 bp, Zea mays
  misc_feature: Ceres CLONE 381557-F
  misc_feature (122)..(122): n is a, c, t, g, unknown, or other
atctgtcctcactcactcactcactcggtcactccacagcttaattgctcccatttctcctccgcggtttggagcctgcttcctctctcgctgctcctttggaagccccaagcccgccassnctgcaaggagagacgacgacagcaatgccggtggtggacaagggaggcgaggccgccgagtttgcccccggacatccgtgggctcggcgtcggcggggagaccagcaggccgtcgcaactccacggtggctctggctcgccaccgatgtagtccaatccaaggcgtccaccaccgccaagcgccgccgcgagactttggggctccaagtcggttgcgcgcgtcgtggaggtggtgtggatgcggcggtgcgtggaggtggaaggacaaggatgccatggtcagtcgcaagcg

SEQ ID NO: 9403 - DNA, 444 bp, Zea mays
  misc_feature: Ceres CLONE 381559-F
  misc_feature: Translation starting site: 155
  misc_feature (199)..(199): n is a, c, t, g, unknown, or other
aatccaaatccggctcctcctcctcctcctcctggcactggcagcgaagatccaaagatagcacaatcgcatctcacacgccgagctatttctacttgagagaatcccccttctcccacaaggagcgagtaatttgaggcagagaccgacagagatggcagcagttatggtgtctcgccaaggccgggagctgcagcgntacagcgcgagcacgggcggggcgcgtggtggtgggctgcgtcccgtaccgcgtgcgcgggggcgacggcgaggtggaggtcctggtgatcagctcgcagaagaagggccccgcgggggcktgctgatccccaagggcgggtgggagctggacgagtccatggacgaggcggcccggcgcgaggccgcggaggaggccgtcgtgctcggcgagacgggccccgcgctgggccgctggtgcctttt

SEQ ID NO: 9404 - DNA, 379 bp, Zea mays
  misc_feature: Ceres CLONE 381575-F
  misc_feature: Encodes the peptide sequence at SEQ ID NO. 9405
aagccccaaactcacgaccaccgtctccaccacggcaccaccatcactccaacaccaccgcctccctctccgttctcttcctcccaacgactcaaaccgccaccgtcgcggctccctgaaccaccagaccagcccagagcccagcccaccacaaacgctgctgctgctggagagaggggcgcgcgggcggacgggagcgatgggcaactgccaggcggcggaggcggcggcggtcatcatccagcaccccggcgggaaggtcgaccggctctactggtccaccgccgccgccgaggtcatgcggaacaacccgggacactacgttgccctcgtcatactccgtgttcctgcagataacaagcccgccgccgccgccgcc

SEQ ID NO: 9405 - protein, 60 aa, Zea mays
  misc_feature: Ceres CLONE 381575-F
MGNCQAAEAAAVIIQHPGGKVDRLYWSTAAAEVMRNNPGHYVALVILRVPADNKPAAAAA

SEQ ID NO: 9406 - DNA, 294 bp, Zea mays
  misc_feature: Ceres CLONE 381582-F
  misc_feature: Encodes the peptide sequence at SEQ ID NO. 9407
arkcragaacagctgtcgatccagaktgtcacttgctctccctccaacaagctaattaaggccggtcgtcatccctcttctagctcgttttattatccatggcggaggagaagcaccaccaccaccacctgttccaccataagaaggacgaggagcaggaggagcagctcgccggcggggtyacggcgagtccgcssagtacacggaggccacggtgacggaggtggtgtccacgggcgagaacgagtacgacgagtacaaggaggagaagcagcataagcacaagcagcacct

SEQ ID NO: 9407 - protein, 39 aa, Zea mays
  misc_feature: Ceres CLONE 381582-F
  misc_feature (33)..(33): Xaa is any aa, unknown, or other
MAEEKHHHHHLFHHKKDEEQEEQLAGGVTASPXSTRRPR

SEQ ID NO: 9408 - DNA, 451 bp, Zea mays
  misc_feature: Ceres CLONE 381597-F
  misc_feature: Encodes the peptide sequence at SEQ ID NO. 9409
atcagagttcagtgaagtgtagtgcagccagggcagcagagcgtgaggtgcactaccaggcaacaaggaaaaaaacaatggagctccaggcaaggtgcgtctgcgtcgtcgcgatgctcctggtggccagcttcgcggggctggataccgcgcacggcgcgggggagtgcggccgcgtcccggtggaccaggctgcgctcaagcttgccccgtgcgcggcggccacgcagaacccgcgtgccgcggtgccgccgagctgctgcgcgcaggtgcgcgccatcgggcgcgtccccaagtgcctgtgcgccgtcatgctgtccgacaccgcgcggaaggccggcctcaagcctgccgtggccatgaccatccccaagcgctgcgccatcgccaaccgccccgtcggctacaagtgcggcccatataccctgccatgaggtgawcatgaggagcc

SEQ ID NO: 9409 - protein, 118 aa, Zea mays
  misc_feature: Ceres CLONE 381597-F
  misc_feature (31)..(112): Pfam Name: Tryp_alpha_amyl Pfam Description: Protease inhibitor/seed storage/LTP family
MELQARCVCVVAMLLVASFAGLDTAHGAGECGRVPVDQAALKLAPCAAATQNPRAAVPPSCCAQVRAIGRVPKCLCAVMLSDTARKAGLKPAVAMTIPKRCAIANRPVGYKCGPYTLP

SEQ ID NO: 9410 - DNA, 480 bp, Zea mays
  misc_feature: Ceres CLONE 381598-F
  misc_feature: Encodes the peptide sequence at SEQ ID NO. 9411
  misc_feature (425)..(425): n is a, c, t, g, unknown, or other
aattaatcaagtagatcgattcaatccaatccaatggggttgctgataccagcvscgtccggagcaatgcacgttgagccgtgtcgtgtctctcatcaccgtcggtgtcgtcatcgtggtttgcacgtacgtcacatcttctccggccggtggcgacgcgggaaggaggagttcttcagcatatggcaccgtcgatcatcggattttrtccccgacgatctggaagtggcgctgcgcggcgcasstacgcgaaacaggacgctgatcctgaccatgctgaacaaggcttattcggaggagggcggcctcctcgacctcttcctcgagagcctgagggaaggggacggcaccgagcagttgatcgaccacgtcctcttcgtagccatggaccagcaggccttccgccggtgcaggagccttggcgncctcaagtgctacctgctccggccgacggacagcgcggacgacctctcgtccgag

SEQ ID NO: 9411 - protein, 149 aa, Zea mays
  misc_feature: Ceres CLONE 381598-F
  misc_feature (8)..(8): Xaa is any aa, unknown, or other
  misc_feature (59)..(59): Xaa is any aa, unknown, or other
  misc_feature (71)..(71): Xaa is any aa, unknown, or other
  misc_feature (131)..(131): Xaa is any aa, unknown, or other
MGLLIPAXSGAMHVEPCRVSHHRRCRHRGLHVRHIFSGRWRRGKEEFFSIWHRRSSDFXPDDLEVALRGAXTRNRTLILTMLNKAYSEEGGLLDLFLESLREGDGTEQLIDHVLFVAMDQQAFRRCRSLGXLKCYLLRPTDSADDLSSE

SEQ ID NO: 9412 - DNA, 468 bp, Zea mays
  misc_feature: Ceres CLONE 381650-F
  misc_feature: Encodes the peptide sequence at SEQ ID NO. 9413
acccgacacgaggacacgcgacgactgacaaggcgaggggagcagtcggcgggcgatggtcggcggcggcgcacatggcggcaccacctacaaaggctacaccatcccacacaacaagcgctggcacaccgtcgccggcaagggcctgtgcgctgtgatgtggttctgggtcttctacagggctaagcaggatggtgctacgctcttgggtttgcgtcatccttgggatgggcatgatgaccactctcatggtcatggacatgggaatgaggcatcgtgacattaagttgcctactctcggcggacggtgatttgatgctttgcatgtcacaacaactaaagattgagttaataaattctaccacccttcatggtactcatgttgtatgtactcatgttgtatgcaactggtttagcacaaactggtttcgttacgattgtgcttatgtatttgatttgaagcatcgg

SEQ ID NO: 9413 - protein, 74 aa, Zea mays
  misc_feature: Ceres CLONE 381650-F
MVGGGAHGGTTYKGYTIPHNKRWHTVAGKGLCAVMWFWVFYRAKQDGATLLGLRHPWDGHDDHSHGHGHGNEAS

SEQ ID NO: 9414 - DNA, 388 bp, Zea mays
  misc_feature: Ceres CLONE 381686-F
  misc_feature: Encodes the peptide sequence at SEQ ID NO. 9415
aaccaaaaccaaatccagaactctccctgggaatttggtggccgatttgccgccgcgtgggtgtggtggggcatgcgccgaacgactcctgcgtcggagctcaagcgcctcggggtctccagcaatggtatgaccatcatcggagctcgctgctcgtggatggtggcgaggcaacgtcgccagctccatcctcgtcacacccgcggtcaagagcaggtaccacaggatgaggcgcatggaggatgctgtgacgagttcgtgagaggtctaggccgtcgtctcccagtcaactttgggttgctggaccgttgtctccatataatgtaattatttatttattgttggtacaaractccgattatatagtaaagatgtgacattcgatcca

SEQ ID NO: 9415 - protein, 108 aa, Zea mays; identical to SEQ ID NO: 6970
  misc_feature: Ceres CLONE 381686-F

SEQ ID NO: 9416 - DNA, 481 bp, Zea mays
  misc_feature: Ceres CLONE 381694-F
  misc_feature: Encodes the peptide sequence at SEQ ID NO. 9417
acctcgtgcaattgcattgcacccctctccaccaacgaggagaactcgaccccaatttacagcgccgttgaataagtccgtcggtaattcgagcggggagcgataatggcgtcacccgtcgacgaggatctccccgggttgcctcccatcaagactacacctctgccgcccccggtgccgtcgtccgccacggccacggccacgtcctcggcctcgtcctctccgtcgccggtgtcgtcggcggtggacagcgcgaaggccgcggaggaagaggatcgcgagccgtcgacgccgacgtcggaggggagcaggctgcggtcgcccgccgtgtgcccgccggcgccgcgcaagccgccgccccgcggctgcccgccaagcggaagccgccgcccgcgcccgtgcgggttgttcgtcgccgtcccgcgcgamctctccaccgtcttccggtcgctgtcccccawgawgcgggatccgggtatcg

SEQ ID NO: 9417 - protein, 125 aa, Zea mays
  misc_feature: Ceres CLONE 381694-F
  misc_feature (108)..(108): Xaa is any aa, unknown, or other
  misc_feature (119)..(119): Xaa is any aa, unknown, or other
  misc_feature (120)..(120): Xaa is any aa, unknown, or other
MASPVDEDLPGLPPIKTTPLPPPVPSSATATATSSASSSPSPVSSAVDSAKAAEEEDREPSTPTSEGSRLRSPAVCPPAPRKPPPRGCPPSGSRRPRPCGLFVAVPRXLSTVFRSLSPXXRDPGI

SEQ ID NO: 9418 - DNA, 767 bp, Zea mays
  misc_feature: Ceres CLONE 381727
  misc_feature: Encodes the peptide sequence at SEQ ID NO. 9419
actattttcctcctttccccacttccacttcgctctgtcctcccatgcgccggattaccactgaccacttcacagtcacagtagtacagagcggcagagtggagaagtagactctaggtgagatggcggccgtggtggcggcggtggaggcaggggtggtggcggtggtaagcgggaggggatgcagcagccggctggtgcggggcctgtactggcgccttcgcgcggttctgcggcggctgcggtcggagcgggccaggcgcggccggaggttcagcttccactacgacgcgctcagctacgcgctcaacttcgacgacggccgcgccgcccccgcccccgccccggcccccgccgcggccgacctcgtccttgcccccggcgacaacgacgcgctacggtgaatcggcgtccgacgatccgcccaagagccagctggggtctcttccttgctccggacgccgcttgccttttccactctcctgtggtttcgctttttcgataaatgggggttgtgtaatggaaaaaaaggaagatggtagggtggtgtcgcctccgcgttctgcgattctttgcattgacgcgcagctagctagctagggggattgcgcgggctcccggtgatcaggaaagcagcgcttcggcgctgcggtgacgccgtgatttgcagggagatcgagagaaacacatgtgttcttcttcgccgtctcggtgcttgcttcctttctcgagtagtattatttcttgccaaaaaaaaaaaaaaaaaa

SEQ ID NO: 9419 - protein, 93 aa, Zea mays
  misc_feature: Ceres CLONE 381727
MAAVVAAVEAGVVAVVSGRGCSSRLVRGLYWRLRAVLRRLRSERARRGRRFSFHYDALSYALNFDDGRAAPAPAPAPAAADLVLAPGDNDALR

SEQ ID NO: 9420 - DNA, 324 bp, Zea mays
  misc_feature: Ceres CLONE 381757-F
  misc_feature: Encodes the peptide sequence at SEQ ID NO. 9421
agggtgtctcgcagctccagacggccacgcggccagccgtcggccactcgcttcgactggcaggctcctacccttgcagacaaaaaacgcaaacacgaggacgaggacgaaggttcgttcagttcaagaccagacgaggaggaagagaggcgcgcaassstccggtctcatggcgcccttccccgccctccgctcatcgtcgccggtggccgccgccgcggccgtcgctcggtcgcgtgtccggccacgcatctgcggcgcccagcaagaggcgcgtcgtctcctgcagggccgtcagcagcaggtcgctgtccatcatcaggt

SEQ ID NO: 9421 - protein, 107 aa, Zea mays
  misc_feature: Ceres CLONE 381757-F
  misc_feature (52)..(52): Xaa is any aa, unknown, or other
  misc_feature (53)..(53): Xaa is any aa, unknown, or other
GVSQLQTATRPAVGHSLRLAGSYPCRQKTQTRGRGRRFVQFKTRRGGREARXXPVSWRPSPPSAHRRRWPPPRPSLGRVSGHASAAPSKRRVVSCRAVSSRSLSIIR

SEQ ID NO: 9422 - DNA, 289 bp, Zea mays
  misc_feature: Ceres CLONE 381769-F
  misc_feature (81)..(81): n is a, c, t, g, unknown, or other
acgagcacaatgacaggtgggtccggctgcctcgcggccacggtgcaccgttggattcgttccatggtctacatgccagtnagaaagtgcacggggactctagagtaaatcccggtgctaccggcggcggcggcgacgaatcgagcaggcgcggcggccatggcggcggcggttgagagcgtggtggtggtccataacgtggcgaacggcacaacgtggggacgctggcgcggacgacggcgttcggcgtcgcggaggtggtcgtcgtcggccgccgcgatgttcagcg

SEQ ID NO: 9423 - DNA, 394 bp, Zea mays
  misc_feature: Ceres CLONE 381791-F
  misc_feature (198)..(198): n is a, c, t, g, unknown, or other
gtgacagtctcatgggctttctcgtgtagcatcatttccgctacccaaatctctccgtccacggcgacgcagacggcatccgtcagccagcaacatctccaccacaccctccccgtccccgacgaagaagcacagcggagaggcggccgaagccgacgcctcaccaagtcaccagtagcttctccgcgctcgtgcscnctttcccgcacttggatgctccctgcgccggcgcctagagcggcggccgtctagcgggcgcccggagtgaacccaccgattggccgacgctctccttcaamgccgcttcctcgcgccgttgtcagtcgtactccggagcctcttcatcagcctcttcgtccccgccgtgtctttgggtgctctcgtcgcccggctc

SEQ ID NO: 9424 - DNA, 143 bp, Zea mays
  misc_feature: Ceres CLONE 381818-F
  misc_feature: Encodes the peptide sequence at SEQ ID NO. 9425
gttgattccattccaggtgtgaaggatgtggcgttcgacgcgccaaggacctggtgarggtgacgggcmcatggmcgccgccgttctgccggcgtacctcagggagaagctcagccgggaacgtcgaagtcgtcgcgcccggc

SEQ ID NO: 9425 - protein, 39 aa, Zea mays
  misc_feature: Ceres CLONE 381818-F
  misc_feature (15)..(15): Xaa is any aa, unknown, or other
  misc_feature (17)..(17): Xaa is any aa, unknown, or other
MWRSTRQGPGEGDGXMXAAVLPAYLREKLSRERRSRRAR

SEQ ID NO: 9426 - DNA, 472 bp, Zea mays
  misc_feature: Ceres CLONE 381840-F
  misc_feature: SWISSPROT Homolog: EC 3.2.1.51 Alpha-L-fucosidase
  misc_feature (224)..(224): n is a, c, t, g, unknown, or other
cccgaattaaccactaataatgcaacgcgcaassagggtgagagcctgaacatgagctacctgagcccgtacctggaggccgtgggctctgacttcacgggcggcgcaacttcgccatctccggctcctccacgctgccccgcaacgtccccttcgcgctccacgtccaggtccagcagttcctgcacctgaagcagcgctcgctcgacctcgccgcccacggngacggctcccgtcgacgccgacgcttccggaacgcgctctacctcatcgacatcggccagaacgacctgtccgccgcattcggtagcggasstccttacgacgacgtsstccaccagaggatcccggctatcgtgtcagagataaaggacgctatcatgactctctacttacaacggcgccaagaacttctgggtccacggcaccggccctctggywgtcctgcccccagaagctcgccgcgccgagg

SEQ ID NO: 9427 - DNA, 215 bp, Zea mays
  misc_feature: Ceres CLONE 381845-F
  misc_feature (72)..(72): n is a, c, t, g, unknown, or other
aatccctcccaactccagcgccgctaggggtcaaatcgaaaaaatggcgttgctgakcccgcgcgtgccgsnctgccgccctccaccttcacctccgttgccggtgcccggtgctttggccctgccgcgaggtgccaggcgacggcggcgggcggcgtggcggccgcggggccccgtcgtcggagctggaggccatacggtggggcagcgcaagc

SEQ ID NO: 9428 - DNA, 243 bp, Zea mays
  misc_feature: Ceres CLONE 381875-F
  misc_feature: Encodes the peptide sequence at SEQ ID NO. 9429
  misc_feature (91)..(91): n is a, c, t, g, unknown, or other
  misc_feature (200)..(200): n is a, c, t, g, unknown, or other
gcacagtctgcgcaccctgccacgacgagatggcttcctgttcctcatcgccacggccacccaccatccctctcctcctcctcctcctctncctcctcctccacttctcctccgtcctcgccgcaccagctcctccagccttgtcacaacaggctggtaccggcggcggcaatgcgacggattcggcggcggcgtggacnggcttgaggaagacgttcttggacggcggcatggagcgctggc

SEQ ID NO: 9429 - protein, 71 aa, Zea mays
  misc_feature: Ceres CLONE 381875-F
  misc_feature (21)..(21): Xaa is any aa, unknown, or other
MASCSSSPRPPTIPLLLLLLXLLLHFSSVLAAPAPPALSQQAGTGGGNATDSAAAWTGLRKTFLDGGMERW

SEQ ID NO: 9430 - DNA, 259 bp, Zea mays
  misc_feature: Ceres CLONE 381879-F
atcatgcatggtgccggcgcaagatagacacgaacacaaggcagcggcgamssaacactagcagaggagaagaatgcggaactacgggcagtcgctgtacaaccggcagagccggtggcgcggtgssaactttcgtgtgcgcggtgctgctcaccctggtcctcatcgccggcgtcatcctcttcgtgctgtggctgagcctccggccgcaccggccaggttctacctcgccgacttytccatccccaacgttaaccgg

SEQ ID NO: 9431 - DNA, 159 bp, Zea mays
  misc_feature: Ceres CLONE 381889-F
aaaccttgcccctgctcctcacgccgccgccgccgccgatcgcagtggttgcgtcgtggtcgcaccgttactcacagttgttatgctactatgttaaacttgttttagatctgtggtttcttctggcgattaagttttgaacttgtctgttatgcaaaa

SEQ ID NO: 9432 - DNA, 433 bp, Zea mays
  misc_feature: Ceres CLONE 381891-F
  misc_feature: Encodes the peptide sequence at SEQ ID NO. 9433
atctattctaccattctacctcacctgacccgccgccggcgtgcctcaaccgcttccgcgcggccaacgcgtcttccggtctgccccgtcggcgataatccgccgcctagcaaagcggccgagccgagccgatggcgatgtcgatggccgtgctcccccacgctgcttcccgcctcgtgcctcgtgtccgccagcctcccttccgcgctctctgcgccgcagctgcggccggcgatgcctcgaagcggatgctggtactgtacaccaagcccgggtgctgcctctgcgatggactcaaggagaagctccacgccgcgtccatgctcgctggcacgccctactcactcgcgtctctcgagctccaggagagggacatcacgacgaatccggagtgggagcggctctaccagtacgagattccagtgttggccaa

SEQ ID NO: 9433 - protein, 100 aa, Zea mays
  misc_feature: Ceres CLONE 381891-F
  misc_feature (40)..(100): Pfam Name: DUF836 Pfam Description: Glutaredoxin-like domain (DUF836)
MAMSMAVLPHAASRLVPRVRQPPFRALCAAAAAGDASKRMLVLYTKPGCCLCDGLKEKLHAASMLAGTPYSLASLELQERDITTNPEWERLYQYEIPVLA

SEQ ID NO: 9434 - DNA, 297 bp, Zea mays
  misc_feature: Ceres CLONE 381913-F
  misc_feature: Translation starting site: 110
  misc_feature (177)..(177): n is a, c, t, g, unknown, or other
  misc_feature (185)..(185): n is a, c, t, g, unknown, or other
actgctcctctctttcgacaagttcctcttccactacctgadgcgccgctggttctccggcggcagcggcgccaccgtcccaagggcccccgccaaatcgaggcggaacatggcggccgcaagtggagcgagacggccatgctcgttatcgacatgcagaaggacttcgtggaccgnggcgatgnscagtccgatgctggtagccggtggcgaggccgtcgtccctgccgttgccggggccgtcgccgtcgcaagggagcgcggcattttcgthgtctgggttgtcagagagcatga

SEQ ID NO: 9435 - DNA, 393 bp, Zea mays
  misc_feature: Ceres CLONE 381918-F
  misc_feature: Translation starting site: 196
  misc_feature (257)..(257): n is a, c, t, g, unknown, or other
  misc_feature (258)..(258): n is a, c, t, g, unknown, or other
  misc_feature (287)..(287): n is a, c, t, g, unknown, or other
aaaactactccgtcactttgtttgcaaagctcctcctcgatcgatccatcgatcactgcaccggccggcggcaccgcgctcgcaggggctagccaacgagacggcagcaatggcggaccgtgaccgcagcggcatctacggckggcgccacgcacctacgggcagcagcagcagcagggaggaggcgggcgcccgatgggtgagcaggtgaaaaagggcatgctccacgacaaggggccgacggcgtccaggcsstnnacggtggcgacgctgttcccgctgggcgnctgctgctggtgctgtcggggctggcgctgacggcctccgtggtggggctggccgtggccacgccggtgttcctgatcttcagccccgtgctggtccccgccgcgc

SEQ ID NO: 9436 - DNA, 401 bp, Zea mays
  misc_feature: Ceres CLONE 381919-F
  misc_feature: Encodes the peptide sequence at SEQ ID NO. 9437
  misc_feature (307)..(307): n is a, c, t, g, unknown, or other
  misc_feature (324)..(324): n is a, c, t, g, unknown, or other
gagaacctgacgcggcatcatgcaaacaaaaccgagcagagagatggcggccgtctcctccaccgccaccgcctcctcgcagccggagctsscgacctccaccgcccaccctaccgccaatgccgccgccaacagcaggctggcgcggcggccgcggcgaaacaacagcttcgtgatggtggaggaggcgtcctatgccagckgcggcggcgacggcggggtggccaggacgaagagcctcacggaggacgacctggaggagctcaagggctgcgtcgacctcggcttcggcttcgcgtacagsagnatacccgagctctgcgngacgctgcccgcgctcgagctctgctactccatgacccggagttcctcgacgagcagagggcgccggggacaggatg

SEQ ID NO: 9437 - protein, 119 aa, Zea mays
  misc_feature: Ceres CLONE 381919-F
  misc_feature (14)..(119): Pfam Name: DUF1685 Pfam Description: Protein of unknown function (DUF1685)
  misc_feature (17)..(17): Xaa is any aa, unknown, or other
  misc_feature (54)..(54): Xaa is any aa, unknown, or other
  misc_feature (87)..(87): Xaa is any aa, unknown, or other
  misc_feature (88)..(88): Xaa is any aa, unknown, or other
  misc_feature (94)..(94): Xaa is any aa, unknown, or other
MAAVSSTATASSQPELXTSTAHPTANAAANSRLARRPRRNNSFVMVEEASYASXGGDGGVARTKSLTEDDLEELKGCVDLGFGFAYXXIPELCXTLPALELCYSMTRSSSTSRGRRGQD

SEQ ID NO: 9438 - DNA, 191 bp, Zea mays
  misc_feature: Ceres CLONE 381937-F
ctcggtcggtcgaacaatcttcaataacccagtcggcaggcgtgacccgatgctctcgcgtcgtcggatcgtcgccaccgtctcctccgcgtcdcctacaccgacatggacgaccggcagtatgcaccttgaccaaggcaggcttgggcgtgctggccttcaactcgggcctcgccatctacaactcctgg

SEQ ID NO: 9439 - DNA, 480 bp, Zea mays
  misc_feature: Ceres CLONE 381972-F
  misc_feature (304)..(304): n is a, c, t, g, unknown, or other
aattcatctatcccccgctctctccatctctctaccctttctctctctcggatagctagctcttcttcttcctccttcctccgtttggatcagacgagagggtatgtagtggtgcaccacgagttggtgaagctgccagcatgatctggttctgatggtggtggtatatgtaagatggatgtaatctatactacggcccctgttaatttctctctctctccccggtccctgactgtcatatatggatcgacgaatccaagatgagaggggaatggagagagagagagagggtaattatgagcancaggaccaggtcatgctgtagtttcatctgctggtggccgcacatcgaaaaccctagctagctctagtagctagctcatcctcgtgcaattcatatccatgctgcactcgccagaccaccagtcaagctagcttatttccgccgttgacgacgttgattaattattcgtgataata

SEQ ID NO: 9440 - DNA, 475 bp, Zea mays
  misc_feature: Ceres CLONE 381982-F
  misc_feature: Translation starting site: 109
  misc_feature (290)..(290): n is a, c, t, g, unknown, or other
acggtactccaccgctaaaaccttcggaaagaatccccaaatctcccacacctcgaagccttcgaggcccgaaaccctagctcctcggcctccccgccgcttccacccatggctccaggactgcagcgcttcactgacattgccgacgacggcacgccccagctcgacgccgcgtccggssaggagctggtccgtgtggacgcaccgtggctgtcgcccttggcccccgctcgccggagtccccggggactctgttcaccaccaggagggtgatttggctcagcgavssnagaagggcaagggctacgcggtggacttcctcgccatctcgcttcacgctgtgtcgcgcgacctcgaggcgtacccctcgccctgtatctacactcagattgaggcagccgttggtacagaagatggaggctggggaatcaaatcctgaagcaaatgaactagagctatctagagtatctgaaat

SEQ ID NO: 9441 - DNA, 332 bp, Zea mays
  misc_feature: Ceres CLONE 382004-F
  misc_feature: Encodes the peptide sequence at SEQ ID NO. 9442
gagcccaaccctagcagcaccccgcgctgaacccatcaccgtcagccatcaccatgcgaggcatcggcgccgcssccgccgccagrcacttccattcctctcctcccgcgctctcgccttctcctcctcttctagaagcgggggcggttgatggcggtttcgggcacgggcgcggacsssgcctgccgaccgccgggcagccgcgcgctcccgggaggcccatttccaacgacgatgacgcggatcccttctctgccacagcacccgtcggccgtggtcgcggggatcctgaggttccctcctccccaggcatcccgtccttcgctgtgttc

SEQ ID NO: 9442 - protein, 60 aa, Zea mays
  misc_feature: Ceres CLONE 382004-F
  misc_feature (10)..(10): Xaa is any aa, unknown, or other
MAVSGTGADXACRPPGSRALPGGPFPTTMTRIPSLPQHPSAVVAGILRFPPPQASRPSLC

SEQ ID NO: 9443 - DNA, 228 bp, Zea mays
  misc_feature: Ceres CLONE 382018-F
ctaatcccatcgttatcagtcatcacctcccactcgcaacgcacccacagtccctcaccgcccgcacacaggcgcgacgaagcagaaaagtatggccgctgccacagcgacggcggcggtgctgggatgcagcaggcgccagagcgacattgcgggasscggcataccgaagaagggaaaggtggggaggtcgccgccggsaggaggtggaggcgttcctcgccgcag

SEQ ID NO: 9444 - DNA, 535 bp, Zea mays
  misc_feature: Ceres CLONE 382058-F
  misc_feature: Encodes the peptide sequence at SEQ ID NO. 9445
  misc_feature (261)..(261): n is a, c, t, g, unknown, or other
  misc_feature (307)..(307): n is a, c, t, g, unknown, or other
aagcaaggagcgctacatccaggccagcagtttccatttgcaatccgaccccatcttcatcccgttgtcgcagcagcagccagcagccatccaagcagcgatggacggcggcaagaagagccggaacccgcacaaggcctccgcggactaccgcagcgaccgcaagtcagcctccgggatgagcggcgaccccaagaagggcggccgcggcggcaagttcacctgggagggcgccgacgactacggctacggctacgcsancgaggacctcggcctcatctccaagaaaggcaacagcaacagcggnacgcgctaccaggcccagggaggcggcgcgctaagaaggacgacgacgagtaggcctcgccgcctcggctcgcccgtccggtcccgtcgatcgccagcaagaaccaacaagcccttctggctgtttaattccagtctcagttcgattctcatgttgaataatcatgatcatgtgggtttaggtgtcgtgctcacgagtatgtagtgtagctcctgctagcacagagca

SEQ ID NO: 9445 - protein, 136 aa, Zea mays
  misc_feature: Ceres CLONE 382058-F
  misc_feature (54)..(54): Xaa is any aa, unknown, or other
MDGGKKSRNPHKASADYRSDRKSASGMSGDPKKGGRGGKFTWEGADDYGYGYAXEDLGLISKKGNSNSGTRYQAQGGGALRRTTTSRPRRLGSPVRSRRSPARTNKPFWLFNSSLSSILMLNNHDHVGLGVVLTSM

SEQ ID NO: 9446 - DNA, 472 bp, Zea mays
  misc_feature: Ceres CLONE 382068-F
  misc_feature: Encodes the peptide sequence at SEQ ID NO. 9447
actccacgggaatccagacccaggaaggacaggacagcagccaggaggcccgaccgagaggctgcataagtaaccgcggctttccgcgccgattcccacctaatcccatcgttaccagtcatcaccttccaactcgcaacgcacccacagtccctcaccgcccgcaccgcacacaggcgcgacgaagcagaaaagtatggccgctgccacagcgacggcggcggtgctgggatgcagcaggctccagagcgacattgcgggcgccggcataccgaagaagggaaaggtggggaggtcgccgccggcggaggaggtggaggcgttcctcgccgcagcggagcgcggcatggcgcggcgcttcgcggtcaagtacaactatgacatcgtcaaggacgctcccatggacggcggcccggtacgagtgggtccgagtgcggcccggttaactgccagatgcccagatccaatccaa

SEQ ID NO: 9447 - protein, 92 aa, Zea mays
  misc_feature: Ceres CLONE 382068-F
  misc_feature (33)..(77): Pfam Name: CDI Pfam Description: Cyclin-dependent kinase inhibitor
MAAATATAAVLGCSRLQSDIAGAGIPKKGKVGRSPPAEEVEAFLAAAERGMARRFAVKYNYDIVKDAPMDGGPVRVGPSAARLTARCPDPIQ

SEQ ID NO: 9448 - DNA, 373 bp, Zea mays
  misc_feature: Ceres CLONE 382094-F
  misc_feature: Translation starting site: 111
  misc_feature (137)..(137): n is a, c, t, g, unknown, or other
atcgtcacaacgcgtcctcgaataaaaatccagacgaaacccaaaatccccaccgaacgcaacctaaaatctccccatccctcctcgatccagccccgcggagaagagccatggccgattccgcaaccaacgacrhncccctggtvsgccagcaaccagcccacggaggaggaggtgacggtggagagggccgcggcgacggaggacaggaggaggagaggctgcggtacctcgagttcgtgcagcaggcggcggcgcaggcgctggtgctggcggccgcggcgtacssstacgcaagcagggcgccggccgctccgccccggggtcgatcaggtcgagggcacgttgaaggccgtcgtcggcccgtctacga

SEQ ID NO: 9449 - DNA, 419 bp, Zea mays
  misc_feature: Ceres CLONE 382121-F
  misc_feature: Encodes the peptide sequence at SEQ ID NO. 9450
  misc_feature (103)..(103): n is a, c, t, g, unknown, or other
  misc_feature (138)..(138): n is a, c, t, g, unknown, or other
gcctcccaactgggcaattccccaaacctaactaacctttgccaccgcgggagccaccatgggtsscagatgccggacgccgacgggaaggcccgctcggcgnactcctcgtcctcttacgggtacacgccgtcggcncgccgcagcaccagtacggcacctttggccccccatccggagcctccggggagtttccgcagccggcggtcgggttcccccagccggcgccgcsgcctggggttgcagcactacccgcagcctccgccggcgtcgtatgccgtctacccacccccggcagcaaccctactcgaccgccgcgccgtactacgcccaaggctaccagatcgctcaaggttatattcctgttgttgaaggaaggcctgttagaawtccgtcctcttccatgttgtggccttggc

SEQ ID NO: 9450 - protein, 48 aa, Zea mays
  misc_feature: Ceres CLONE 382121-F
  misc_feature (39)..(39): Xaa is any aa, unknown, or other
MPSTHPRQQPYSTAAPYYAQGYQIAQGYIPVVEGRPVRXPSSSMLWPW

SEQ ID NO: 9451 - DNA, 450 bp, Zea mays
  misc_feature: Ceres CLONE 382129-F
  misc_feature (283)..(283): n is a, c, t, g, unknown, or other
attgaaacgcacccagtccccgctcctgtttcgatctcccgaatcccgatcccgctaccggagcggaggcgatggcggcggcgcggcggtaaggttcccggtcttcgggctcgtgcggctgctgggcttggccgccgcggcggattcctcttctgggccgtccacttccgaggcggcatggcgctctccaccgaagaggagagcaagctccccctcttcaacgttcacccagtgttaatgctgattggtttggtggccttgaatggcgamsstcttttggctnataaaactggtgccaggaaccaagaaactggaaaaagctagtgcaccttgccgtgcagttccttgccatgttttctgagtctaattgggtctgtgggctgtatggaagttccatgatgaaagaaaaatcgatcatttatatacactkcactcgtggttgggccttac

SEQ ID NO: 9452 - DNA, 374 bp, Zea mays
  misc_feature: Ceres CLONE 382160-F
  misc_feature: Encodes the peptide sequence at SEQ ID NO. 9453
attccccatctccggaccagcgccgccgccagtcgctgtccacgggcaccccgggcgcgcctcctccgagcccagactcgagctccatcccgccgtggatcaccgcgtgaggtggggcgcaccgaccggaccccggagccagatggtgtccggcgccggatggggcgagtagcgcgttcggcggccacgaacggatcggcggcgacgcggcgaggcgtcggtcagggcgggggccatcatgtctgcggtagtgtgcggcaagaggtcctcctccatcttcggcgacgagcttgtaccttccccttcctcccctccgtccccttcccaccaccatcaccccgccaagagggcccgttgctccccgtcccgccgga

SEQ ID NO: 9453 - protein, 45 aa, Zea mays
  misc_feature: Ceres CLONE 382160-F
MSAVVCGKRSSSIFGDELVPSPSSPPSPSHHHHPAKRARCSPSRR

SEQ ID NO: 9454 - DNA, 667 bp, Zea mays
  misc_feature: Ceres CLONE 382162-R
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
actcgctactctccttccaccccccccgcgtgagtgggggggggnnnaaccagtatcaccattatatatttccaagtttacaattggtctcaatcaacagaattattaacagggcgctgagaattgaaacataaagtcaattaatcctaatattttcctatgaaattgatcatgcagagagtgaaaaaaatatatagttcaagatcaaaatggtgccgcaaagatgactccagaccatgtttattccaatccaactgaatcgaaaataaattcctagagcccaaaaacactcggcacttcagtgcttgagcaccaaggataggccaactttcgtgctcttctcaatcgccttggtgtcaacgtcaccagagatggtgacgaaggacttggggagcccattcatgctgggacaaagggcactggcccatgcccggagttgttgaaaccgtgctcttgataagccgcgcggggcgatccagcggaagtggctggggacccccaaagatttagcggggctcctcattttctcgaacatgcgtgtggagaagaaactcaatctcccaccagcaactgtccttgaaatggagtctttttaccccggcggggttattttaggaacccttacccacggggattccccccggggtcttatctccaaataaaaagg

SEQ ID NO: 9455 - DNA, 438 bp, Zea mays
  misc_feature: Ceres CLONE 382186-F
  misc_feature (77)..(77): n is a, c, t, g, unknown, or other
gttccttctctcccctgagaccaccaacgccggggccggaaaaaagggaagccagagcacagagccagacctggcgncgctggacatccaaaaacgccgccaaggatccttctctctctctctctctctcttcgcgtccatcgacctgaccgcggaggcgcgtgcttcttcttcccgctctccactgtcatgaagattgagggaaacttgcatgtttgatatacccagctgctttctgtaacgaaaaactcgtgatcattttgttgaattggtcactgtcagggagggatctacttgtcagtttttggtattaaggctgctggccttcccttgcaggtatctgtagaatawatgggagaaagcacactcggatgaatttgccattgccagggggtgtgctggcaagtatgcactactcagagacggagaaacccacga

SEQ ID NO: 9456 - DNA, 472 bp, Zea mays
  misc_feature: Ceres CLONE 382206-F
  misc_feature: Encodes the peptide sequence at SEQ ID NO. 9457
aatgaagtcgccgaaccacctcctatcggtaccaaactagcagcgccaatggggtcagggtgagaccgccgacgctgttcctcaacttcgccatcggtcggagtctgccaggcggccgggtttgggaacgccaatgccgggagagaaattaagatcgacctgtgtggatcttcctcaagcgcgagatgtagggatggatggcctcggccatggtgttcccttgccggtgcgggtctcgccgcggtgccgcaaccccgacgtggaccgatctcgtctcaaccttgtcgctgacgagcaagctacagaggattctgaggttcagctggtagagactgctgagcaggagctcgttgaaggagaagaataggtggttcaagtggagccaagtatcgaggagttcgattcgatctaggtggcgtctcccagtcagctttctggcgccaaggatagattttagatcctgcgatattta

SEQ ID NO: 9457 - protein, 77 aa, Zea mays; identical to SEQ ID NO: 7792
  misc_feature: Ceres CLONE 382206-F

SEQ ID NO: 9458 - DNA, 1589 bp, Zea mays
  misc_feature: Ceres CLONE 382241
  misc_feature: Encodes the peptide sequence at SEQ ID NO. 9459
aactcgttctcgtcctccaccaccggcgcctcgtctcttcccgtctccccagtccccactctcgtccccgctccctccaaagtccaaaccctaccaccccacttccccaccaccactacatggcggcggcgctcgcctcctcccgctactgctggagccgcccgtcgctgccgccccaaccgacccgcggccgccgctccgtcactagctgcgcgctctccggacgagagaaaagaaactcctttagctggagagagtgtgcaatttctgttgcattgtcagttggactaatcactggtgcaccaacgtttggaccaccggcctatgcttcttctcttgaacctgttcttccagatgtgtctgttcttatctctggacctcccattaaagatccaggtgctttattgagatatgccttaccaatagataataaagctattcgtgaagttcaaaagccgctggaggatatcactgacagcctcaaggttgctggtgttagagccttggattcagttgaaagaaatgtcagacaagcatcgaaagcactgaacaatgggagaagcttaattcttgctggccttgctgaaccaaaaagagcaaatggagaagagttgttgaataagttggctgttggatttgaggagcttcaaagaattgtggaagacagaaatagggatgcagtagctccaaagcagaaagagcttctccagtatgttggaactgtagaagaagacatggtcgatggctttccctttgaaataccagaagagtacagcaacatgcctcttctcaaaggaagagctactgtggatatgaaggttaagattaaggacaatcccaacatggaagactgtgtatttaggatagttctggatggatataatgctcctgtgactgctgggaacttcgtagatcttgtcaaacggaaattctatgatggcatggaaatccaaagagctgatggctttgttgttcaaactggagatccagaggggccagctgagggctttatcgatcccagcaccggcaaaatccgtacggtacctcttgaaattatggttgatggtgataaggcgcctgtatatggtgaaacacttgaagaacttggtcgctacaaggctcaaacaaaactccctttcaacgcttttggaacaatggctatggcaagagaagaatttgatgacaattctgcttctagccaagtattttggctcttgaaagagagtgagctaacaccaagcaatgccaatatattggacgggcggtacgcagtatttggatatgtaactgagaatgaggactacctggctgacgtcaaagttggagatgtcatcgaatcaatccaagtcgtctcaggcttggacaaccttgtcaacccaagctacaagattgtaggataacgtgttttgtatcagagtttcttgtctgtgggtctctgtcctcaagtcgatgtaaagtgctatatagtatcttactcccatatccttctcgctcgttaacgagggtttgtgtcacgcggaattcgatagtaattgaaagtacagagtcaaaaaaaaaaaaaaaaaaaaaaaagcaaaaaaaaaaaaaaa

SEQ ID NO: 9459 - protein, 426 aa, Zea mays
  misc_feature: Ceres CLONE 382241
  misc_feature (229)..(415): Pfam Name: Pro_isomerase Pfam Description: Cyclophilin type peptidyl-prolyl cis-trans isomerase/CLD
  misc_feature: SWISSPROT Homolog: EC 5.2.1.8 Peptidylprolyl isomerase
MAAALASSRYCWSRPSLPPQPTRGRRSVTSCALSGREKRNSFSWRECAISVALSVGLITGAPTFGPPAYASSLEPVLPDVSVLISGPPIKDPGALLRYALPIDNKAIREVQKPLEDITDSLKVAGVRALDSVERNVRQASKALNNGRSLILAGLAEPKRANGEELLNKLAVGFEELQRIVEDRNRDAVAPKQKELLQYVGTVEEDMVDGFPFEIPEEYSNMPLLKGRATVDMKVKIKDNPNMEDCVFRIVLDGYNAPVTAGNFVDLVKRKFYDGMEIQRADGFVVQTGDPEGPAEGFIDPSTGKIRTVPLEIMVDGDKAPVYGETLEELGRYKAQTKLPFNAFGTMAMAREEFDDNSASSQVFWLLKESELTPSNANILDGRYAVFGYVTENEDYLADVKVGDVIESIQVVSGLDNLVNPSYKIVG

SEQ ID NO: 9460 - DNA, 437 bp, Zea mays
  misc_feature: Ceres CLONE 382286-F
  misc_feature: Encodes the peptide sequence at SEQ ID NO. 9461
attatgttggcctgctagtagccggctagccgctgcctgcccgcctcacaggctcacagcgccgcaggtgccagggcgttagggccttagggcaaagcatagcaacggcggctgcgcmsaagcagattcagctcagcacctcgccggacgccggctcacccatccggccatcccctgccggccgactctccctggtccccagcgcmssaagcagttcaccggagccggcgcmsaagttagtcagttggaggcatttgagaaatgtgctaaagaatgtggtctagaccctaaaaagaccctttccttggatgttgctactagatggaactctacatatatcatgatyagagatgccatttactataagaatgcttttgatcgtctggctaaaaaagataaggacaaatatggtcacatcaatccttcaagcactgatt

SEQ ID NO: 9461 - protein, 32 aa, Zea mays
  misc_feature: Ceres CLONE 382286-F
MIRDAIYYKNAFDRLAKKDKDKYGHINPSSTD

SEQ ID NO: 9462 - DNA, 437 bp, Zea mays
  misc_feature: Ceres CLONE 382303-F
  misc_feature: Encodes the peptide sequence at SEQ ID NO. 9463
  misc_feature (310)..(310): n is a, c, t, g, unknown, or other
ctgctagctggcggggcggctcgctctcgcgccacaatggaggtcgaggacgacgacaacacggcggcgssacgcgtggccgagttcatccaggcgtcgcacctcctccagttccttctccacgcctccatgaggctcgacctccggcccatcgtcaagtacgccgcgcttaccttcttcgctggacgcttcctcccggcactcccgaggaagatggggttctgcggcgcgcgamsscssaattaagtcaggtcctggctcctcgagccctgagggacagcaatctcgagctattcgcgctcgtcgsggntgtggattgccagcaagatccacgatcagaagccaatgtcagtgaagagcctcaaagccctgggtgatcgcatcatcgccgaccagcatttcatgtgccgtgattttgccagtgccgaattggtgtt

SEQ ID NO: 9463 - protein, 69 aa, Zea mays
  misc_feature: Ceres CLONE 382303-F
  misc_feature (12)..(12): Xaa is any aa, unknown, or other
  misc_feature (67)..(67): Xaa is any aa, unknown, or other
  misc_feature (68)..(68): Xaa is any aa, unknown, or other
MEVEDDDNTAAXRVAEFIQASHLLQFLLHASMRLDLRPIVKYAALTFFAGRFLPALPRKMGFCGARXXN

SEQ ID NO: 9464 - DNA, 452 bp, Zea mays
  misc_feature: Ceres CLONE 382304-F
  misc_feature: Encodes the peptide sequence at SEQ ID NO. 9465
gctgtaattccatctccgtctccatctcgttcccaccacgccgctccctgtcgcggtgtcgccattgccccggctccaagcaaaatcccgcttgcctcgccccaagcattcctgctttcacccggccgccactcttccccagtccccgccactcaaggaaggcggaggattttatctagtcttgcagcgcggccatttccgtcccgccgtctgcgcctcctgtggcgtttgggacatcttccaattccaagctgacactacttgaacttaatgcggctctacgcacctgcgctctgtctgctgcgatcaagcacgcatccccaccctaatcagttccgtgcaggattcactcagagcatggcctcctggaagtgctcgcactcgccgtcaagcccgtaccttgcgaagtcggtyttagtcgattcttctctttaacaggaatgtaaagtctt

SEQ ID NO: 9465 - protein, 54 aa, Zea mays
  misc_feature: Ceres CLONE 382304-F
MRLYAPALCLLRSSTHPHPNQFRAGFTQSMASWKCSHSPSSPYLAKSVLVDSSL

SEQ ID NO: 9466 - DNA, 464 bp, Zea mays
  misc_feature: Ceres CLONE 382307-F
  misc_feature: Encodes the peptide sequence at SEQ ID NO. 9467
gtcgaagccggagaccccagaaagagtccgtaaacaactcccctcccgtccatggcgaccgcagaccgggtcgccgccaccttcctctcctctttccccactcaccatcccggccccttttcctccgtttccctcgtgacaaaccctgtcctatccgtctcccttcgggccgctgttacaggtggcccacggctcgcctcccgtctccgggtccgccgcgtcggcgccgccgtcgcccagctccccaccacgaatccggaggtagcttctggggagaagaagatcagatggtcatcaagggctgtgcggtcttttgcgatggcagagctggaggcccggaagatgaggtaccctaccacaggcaccgaggggctcctcatgggcattcttgttgaaggaactagtggcgcagcaaaacttttgcgtgctaatggaaccacacttctcaaagtgcgtgaggaggc

SEQ ID NO: 9467 - protein, 137 aa, Zea mays
  misc_feature: Ceres CLONE 382307-F
MATADRVAATFLSSFPTHHPGPFSSVSLVTNPVLSVSLRAAVTGGPRLASRLRVRRVGAAVAQLPTTNPEVASGEKKIRWSSRAVRSFAMAELEARKMRYPTTGTEGLLMGILVEGTSGAAKLLRANGTTLLKVREE

SEQ ID NO: 9468 - DNA, 273 bp, Zea mays
  misc_feature: Ceres CLONE 382312-F
  misc_feature: Encodes the peptide sequence at SEQ ID NO. 9469
agtagtcagcacagcagcggtagatagagtacaaatcctcacctgctcccctgcttcctgcttttcgtcctcacctcccttcccccactctcttctctccccgcggcccgtgactcatccacccacagtccactcgccactccccccggaacggcggcggcggcgacggcggaggagtaacgcaagatggcgaggaaacctctcaactacgaggagctgaacgagaacgtcaagagggtgcagtacgcggtgcgcggggagctgtacctmcgc

SEQ ID NO: 9469 - protein, 29 aa, Zea mays
  misc_feature: Ceres CLONE 382312-F
MARKPLNYEELNENVKRVQYAVRGELYLR

SEQ ID NO: 9470 - DNA, 334 bp, Zea mays
  misc_feature: Ceres CLONE 382334-F
  misc_feature: Encodes the peptide sequence at SEQ ID NO. 9471
  misc_feature (44)..(44): n is a, c, t, g, unknown, or other
aaaaccagacggccaaggcagcccccaaccccggccccakcysncagaccatctcgatacgcggccgccgcagacgagatggccgccggggacgcaggccgcgcgccgacgsagcggcgcgcaaatcgctggtggagtccttctgcggcgtgacctccgcgaccccccaggaggcggccttctatctcgagagccacaactgggccctcgaatccgccgttcgctcctactacgactccgtggacgttgaagcbsacgccgtsscggccgatccagtacccccaccaccagctgcaccagccggagggggtaaggtataccgaggatgaggatt

SEQ ID NO: 9471 - protein, 108 aa, Zea mays
  misc_feature: Ceres CLONE 382334-F
  misc_feature (13)..(13): Xaa is any aa, unknown, or other
  misc_feature (14)..(14): Xaa is any aa, unknown, or other
  misc_feature (37)..(37): Xaa is any aa, unknown, or other
  misc_feature (85)..(85): Xaa is any aa, unknown, or other
  misc_feature (88)..(88): Xaa is any aa, unknown, or other
NQTAKAAPNPGPXXQTISIRGRRRRDGRRGRRPRADXAARKSLVESFCGVTSATPQEAAFYLESHNWALESAVRSYYDSVDVEAXAVXADPVPPPPAAPAGGGKVYRG

SEQ ID NO: 9472 - DNA, 116 bp, Zea mays
  misc_feature: Ceres CLONE 382355-F
acacgcacaccgcgacccagtccagagccagtacgtgcgamggtcacgcacgctgctggtccgcgtacssagaacgacggtcaggtcggccggtgcttttcagtttggaataatga

SEQ ID NO: 9473 - DNA, 842 bp, Zea mays
  misc_feature: Ceres CLONE 382358-R
  misc_feature (12)..(12): n is a, c, t, g, unknown, or other
  misc_feature (13)..(13): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (70)..(70): n is a, c, t, g, unknown, or other
  misc_feature (81)..(81): n is a, c, t, g, unknown, or other
  misc_feature (83)..(83): n is a, c, t, g, unknown, or other
  misc_feature (503)..(503): n is a, c, t, g, unknown, or other
  misc_feature (507)..(507): n is a, c, t, g, unknown, or other
cgtgtggggttnncccccccnnnnnggggaaggaaaaaacaaacaacaaaaaactaaattagaaggcgcnatattataatntnttcgaattgggtaccggccccccctcgaggtcgacggtatcgataagcttttttttgtttttttttagataaactgaattattaagcttcacacaattccccagcttctggtccggcatgtagatgaactgaattacagtacatgttattatggccactctacgcagatggaacccgaacgggaaaccagatctgtcagtactcagttgccgccagcgcagaggagggcgtcaaccttgtccttgaggtgcgcctcgtcgtccccgaggcgggcggcggcggcgccatcctcccagcggatcagcgttggcacgcccttgagcccgaacctggggtccaccctccacgggtgcgccgggtcgcgccaagtgggcttgtccccgacgtaggcgcgcaggaataacccccctcgtgcccccnccantgccctccagccgctcggtagaatcacccggctccgcccaccgttgcagttcggggggcacccagggagaggggagggaaagccagggcttttgccggttcgggcccaggaaaagaagcagccaggcttttcacccttttgccccgttccagaaaggcgggccgtcccggggggtaaagccgaaaaaagggcggaatccgaaaggtggggccgttccaaaaaaaccgggaaaaagccccacagggttccaaccctttacttaccaaaccgttcaaattcttcgggcccttccgttcttctccacctttaccggccttggggcccaaaaatataaa

SEQ ID NO: 9474 - DNA, 498 bp, Zea mays
  misc_feature: Ceres CLONE 382382-F
  misc_feature: Encodes the peptide sequence at SEQ ID NO. 9475
gcctctccagcataggcatagctcgccgaaacgccgacctaaacgcccacaattcgcctctccgatccggcacgacaccgccgccgatccccatcgtcacggtagccatgtccaaccccggctcgttgcccgcctccgctcaccacgagcacgagcacacccctctctgccgctcctgcggggcgcccaccacgtcgccgaccccggcaccctggtcagggaccaccgactccccgccgccggcgtaccgccccatccgtctcccagccatcaacgcgcccaccaacacagccgccatagtcctctccccggtcccacagccgctccccgtgcctcccgccgcgccgccccacgccttcctggtccctgccaagcggatcacctcaccggacgatatcgcccgcttccatgcctccgtccacggccttcacttcctcgggttcgtcgccgcgctgtccgcctccgtccacggccgcaagctctcggacccgctaccgt

SEQ ID NO: 9475 - protein, 130 aa, Zea mays
  misc_feature: Ceres CLONE 382382-F
MSNPGSLPASAHHEHEHTPLCRSCGAPTTSPTPAPWSGTTDSPPPAYRPIRLPAINAPTNTAAIVLSPVPQPLPVPPAAPPHAFLVPAKRITSPDDIARFHASVHGLHFLGFVAALSASVHGRKLSDPLP

SEQ ID NO: 9476 - DNA, 315 bp, Zea mays
  misc_feature: Ceres CLONE 382402-F
aacgtttaacccaaagtaaccgtcccgtgtttccgtttgcttcgcctggtcaccttccgtggtgcttgtggctgtgtacgcggtcgtctccatccgaccgacccatcgatcatccaaaaactaaaccaaatcttccccatcgatcccaacttccagtcgatctcctcgctcggctgttgcctcccaaagccgcgccttacaacgagattcctcccctcctctctccaataaccctagcctcctccgccgccggcgacgaatccggcgttttgagtttctgttgccagcgtagccatgtccatgttcaataggatc

SEQ ID NO: 9477 - DNA, 473 bp, Zea mays
  misc_feature: Ceres CLONE 382410-F
cttccgctaccaccttcatccatcctggcgtcggtgtcttgccctgccccagcgccgccgctccttcccccaccccgaagcgccgcctcttctgcctccgtcgacggtggtggtgctcctgatccccgccgttgaactggccataggagagcaaagaggaaggggaggccgcgagggcgccagtagatatattcatcttcatctcggcttgcgatatttttgaattttctattccgtattgaaggcgtcgatggccttgtccgccctaatcagcaccctcctcgccgccgccatctggtgcgccgcttacctcgccgctgccatctcctccgccttctgattcccactccccaaccctaacctcccccctgtagcacaccccacctctagctttgtaggtcctactatacttgcaacctctcccgctgactcgcttcgatctacccgccctcgcgtcaccatggggtacgcgc

SEQ ID NO: 9478 - DNA, 472 bp, Zea mays
  misc_feature: Ceres CLONE 382471-F
  misc_feature: Encodes the peptide sequence at SEQ ID NO. 9479
  misc_feature (22)..(22): n is a, c, t, g, unknown, or other
  misc_feature (118)..(118): n is a, c, t, g, unknown, or other
  misc_feature (277)..(277): n is a, c, t, g, unknown, or other
  misc_feature (464)..(464): n is a, c, t, g, unknown, or other
aggccacaagcgcccgagcggncttaaaccctagctcgccgtcgtgctcggctcgccaccccgcgccasstcctttcaggccctaaccgttcgccgccgcgcattcgagcactcgcgnaasscacctagtgccatggcgaagaagcggaasssaccgacgcccccgcagaggcgaccggcgcagagaagcctgacgactctgcgccggcgcgcccggagcgcacgctcttcggcttcaaggacccggtccccgacgccgagcccgcctccgsgggcncgaggccgcggttggcgccgttccggaacagggagaaggtactcatcacctgctcccgccgaatcacgtataggtatcggcacctgatgcaggacgtgctgtcgctgctcccgcatgcgaagaaggacagcaaggtcgagtcgaagcagagcaagggggaacgcgctgaacgagctccttcactcangagctgct

SEQ ID NO: 9479 - protein, 36 aa, Zea mays
  misc_feature: Ceres CLONE 382471-F
  misc_feature (34)..(34): Xaa is any aa, unknown, or other
MQDVLSLLPHAKKDSKVESKQSKGERAERAPSLXSC

SEQ ID NO: 9480 - DNA, 434 bp, Zea mays
  misc_feature: Ceres CLONE 382474-F
  misc_feature: Encodes the peptide sequence at SEQ ID NO. 9481
  misc_feature (323)..(323): n is a, c, t, g, unknown, or other
atccaccacaccaccagatctgctgccgtccgcgcagagavagaagcaacttcatcgcgatgggggcggtggtgacggcggtgatcgcgatcgccgcggtggtgctcggctggatcaccatcgagatggcatgcaagccctgcctcgagaccggccgacgcgccatggaccgcgcgctcgaccccaaccacgacccggactcccccaccaacgccgccggsccttccgccaacgagccgctcctcgccgacctctccgcctccaccgcgccacccgcaaaggccatctgaatctcatcacctcccagagcgagccagagssgnaccacccttttcccctcgccttgtaatcttgcttctttctatgtcattttgtgctatgagtttgctattaatattaatggtgtttcggttatgaaacgaccactgctagca

SEQ ID NO: 9481 - protein, 76 aa, Zea mays
  misc_feature: Ceres CLONE 382474-F
MGAVVTAVIAIAAVVLGWITIEMACKPCLETGRRAMDRALDPNHDPDSPTNAAGPSANEPLLADLSASTAPPAKAI

SEQ ID NO: 9482 - DNA, 541 bp, Zea mays
  misc_feature: Ceres CLONE 382477-F
  misc_feature (257)..(257): n is a, c, t, g, unknown, or other
aggacaggttgcatttgcatctgagttcctgatcgttgtattccagtttcttccgtgagttttgtgggatcgcgaggaagaaggatgtcgtgctgcggaggcaactgcgggtgcggcgccggctgcaagtgcggcassggctgcgggagggtgcaagatgtacccggacatggctgagcaggtgaccaccaccaccaccacccagactctcatcatgggtgttgcaccatccaagggcggggtcgaggcggccgcgnagctgagaacggcgggtgcaagtgcggcgccaactgcacctgctcaacctcagcaccatcctcgccgtcgacgcccgcgccgccgccaccttcaactagctaaaacacgatacagcatatgaaaacagaccacattcatattctatcatatattatgcacccatccgaaccccaggctggcagttcatcagtatttgtactccgatatgacacatcatacatctagtagcattgcaattttcgcctagtggctaagtactagtacgcttcctgctgagaatctg

SEQ ID NO: 9483 - DNA, 515 bp, Zea mays
  misc_feature: Ceres CLONE 382484-F
ataggaatagatgtgtattcgacagtgagcaactagaggtccatgaagttccccaggaggttgtagacaagggtagtgtttgggtgagggctgatactgtagctttggggcagctaacacatcagtagacagtagtctcaggactcaggagtgatgtgcagctctcttgcatattcgagaaaaaaatcaagaggagtttgaaaagaaaaacaagtatggagctgtttcatcttcacgggggctttgatcgataaggattcaggagtgctggaagaagatttggagcaagagctgtcgctgtccggcgtctggcggtctgggggagaccagtgattttcctacgcacgcctgccaaaagtgggatggagttgaacgcaaaatgtgttgtttgtcattgggtagatggaggaggacacctcgtttatacgcgcggaggaggtgtagtgcgactgtgcgagttgaatttgtaagaaactcagccgcatgcttgcttggagatacttgagatggaacgg

SEQ ID NO: 9484 - DNA, 478 bp, Zea mays
  misc_feature: Ceres CLONE 382507-F
  misc_feature: Encodes the peptide sequence at SEQ ID NO. 9485
  misc_feature (246)..(246): n is a, c, t, g, unknown, or other
  misc_feature (461)..(461): n is a, c, t, g, unknown, or other
aaaaaaaaaatagtctcgatccccaccgagtccagcaaacagcaccaccccaccctcttcgcggctccggcagccgcgccaccatggcttctcctgcgggggctaacagcggggcctcctcctcgagagggacacccttgcctttgcccttccccttccccgctgcggcgcacttcccctcccgcggcgccggtcccttcctgtcgcagcactatcacccgccctccacctccgacggcgacgatnaggtcgaagaagacgagggaagcatggacgacggcagcgccgaagaggatgatgccgagctgtccgacggaggggctctcggctcgccgcggcgacgcgccttctccgctccaggtattggacgtatggagataaatgggggaaatggagtgaggtcaatccaagaggggcagcaatggcatttatgtaaaccatggaatcgagattgggcgtcnatcaccaggaggggatg

SEQ ID NO: 9485 - protein, 131 aa, Zea mays
  misc_feature: Ceres CLONE 382507-F
  misc_feature (55)..(55): Xaa is any aa, unknown, or other
MASPAGANSGASSSRGTPLPLPFPFPAAAHFPSRGAGPFLSQHYHPPSTSDGDDXVEEDEGSMDDGSAEEDDAELSDGGALGSPRRRAFSAPGIGRMEINGGNGVRSIQEGQQWHLCKPWNRDWASITRRG

SEQ ID NO: 9486 - DNA, 250 bp, Zea mays
  misc_feature: Ceres CLONE 382540-F
ccccctccgcctcctgctctctctcgcctctggttggcagagctctcttgaagcctcgagactcgtctcgccgctgctccctcagctctgccgctgcgtgcctccgttagctgttgcattgcagcgcagccccgcgagccttgagctgctagctcgcccttcaccacagtcctcagacatggagttcgaagaccgctgccacaaggtccaggagcccaagttccgattcggtcaaaaaaaaaaaaaaaaa

SEQ ID NO: 9487 - DNA, 444 bp, Zea mays
  misc_feature: Ceres CLONE 382544-F
  misc_feature: Encodes the peptide sequence at SEQ ID NO. 9488
attccgccaagaaccgcccaactgctcgtgctcctgtcgacctcccacccctccactccccgacggttggcggctatctcgccgaagcgacctagccagcacagccgagatggcgaagggcgacgggcgtggatgagggccacggggacttcgaccggctgtccaagttcctggtggtctgcctcaacgctatccgggatgcggtggcgcccgagaaaggcggcggcagcatccatggcgccggtgaccggggcatggagctctggaggtgttgctccacccaggcaccgtccgacgtgctcgacgctagcggcgcgtgcgccacggtgacgcagaccgcgtggctcgtctccactgcctgcgacatcgtcgctaggaaagagaggcatgggatggtcgtgtcttgccccttcctgctgtacctcgtctcgtcacaggataagg

SEQ ID NO: 9488 - protein, 63 aa, Zea mays
  misc_feature: Ceres CLONE 382544-F
MELWRCCSTQAPSDVLDASGACATVTQTAWLVSTACDIVARKERHGMVVSCPFLLYLVSSQDK

SEQ ID NO: 9489 - DNA, 1112 bp, Zea mays
  misc_feature: Ceres CLONE 382551
  misc_feature: Encodes the peptide sequence at SEQ ID NO. 9490
atccctccccctcgcgtccgcatgaacagaaccctgggatttctgcgtggtggtcgcaaggccgtcccaaccaccagccgggattccctcacgctagtggataaaaggggaccaaaccctcccatcatcagctatcgagccggtcgctgccatcacagatttggtgaggggagaagagataatcagggagatctgaagcttgcggggagggaaaagaggtcgccgccgtaggtgaaaccaaagcacgccgccgttcggggtccggcttgttctgggggtcttcactggaccacgtggttggtgtacgtggcctcatcaagcgggattagcaaccggtgaaccaacaatttctcgccgttgccaatgctctatcgcggagccacatcacgccgtggaccactccctggtcgccatctctgcttatgtttgatcttgatgaggacatcacttctatatatacaatgaatggatcgataacacgatcttgtgcacgacagctaaatctccaggtacgttctaccctagtcaattgtgtttcagagcttacgcttggggccatggatgttttgatgattaggtaccttggagaggaccagcaaggacttgggaaaggccaaggtgttgaggagaagcagcaagggcgtccacaacaggaaggagatcaagtcctagtcggctgcgactctatctcgggttccaggaccagtctgcactaaaatggacgcccaagatgcatccggactccgattgcgacagactggatatggttggaaagataacgagattatctaaccaatccaactggttccaccctaaaattcatctggagtcaacgggaatcgtcgaaacaagtcagcattcagattctgttttggtgctgcgacaccgtctgttgggccgttaggccgtgtatcgcgtcggagcccattaggggcgagtccagggctacgcacgccctaatactctatttattcagcagtcgccgccacatttaggtttggggttttgcttagatcaattctgtcatcgaacagtgtcgccgtcatcagcttgtgagaccctcctcccgtaatcaatacaattttggttgcgtttcaaaaaaaaaaaaaaaa

SEQ ID NO: 9490 - protein, 97 aa, Zea mays
  misc_feature: Ceres CLONE 382551
MFDLDEDITSIYTMNGSITRSCARQLNLQVRSTLVNCVSELTLGAMDVLMIRYLGEDQQGLGKGQGVEEKQQGRPQQEGDQVLVGCDSISGSRTSLH

SEQ ID NO: 9491 - DNA, 227 bp, Zea mays
  misc_feature: Ceres CLONE 382556-F
gtaccaccgtgacagttctattaacttgacgagacaaaaggggggaaagttctgctcctacgatcctacctccagtgatgtcagcaccaccgctggccggcgcggcgcatcatcaatgaggtcctcaccgatgacgagctacgcgcagtgctcaggcggctggggcccgaggcggacgggacssktcgggctcgtgtgccgccgctggctccggatccagagctccg

SEQ ID NO: 9492 - DNA, 176 bp, Zea mays
  misc_feature: Ceres CLONE 382562-F
aagagatgcttccccctcccgtgccggcttgggcagcagttgggctctctcggcccgcctccttcccgagcacgcacgccgcctcgcttccaattcttccccccctctcctcgtccgctccgctccgctcctgcgttgccgtggagtgccgcccggggctccattccattccaccc

SEQ ID NO: 9493 - DNA, 492 bp, Zea mays
  misc_feature: Ceres CLONE 382570-F
  misc_feature: Encodes the peptide sequence at SEQ ID NO. 9494
acactggagaagcatcaggcaaacgatacagcccttccctcttcaatcctctcgtcatttcctctcgcttctgctcagctgcaacccagcgcgtagatcttattcttggacgagaactctcctcaagctctccgatttctgttctcgcgccgcttagcaattcaaccccgaaattcttttgcggcgcaatcttcacctgaatcttgggtcgtagccaagaagatgaacaaagacaaagctccgatgccgggagacggcggccccagcgacggcttgccgccgcagtccacgcgccgtgtcggggcgccgcctcgtcgtctaccccgccgctggagtgcgacatcagccgcatgccggacttccctacccggagcaccggccaccggcgtgcgcactccgagatcctgggcctacccgacgacctcgacctcagtgctcccggagcggcgaaggaccgtcgctgtcggacgagaacgatgaggagctcttctc

SEQ ID NO: 9494 - protein, 47 aa, Zea mays
  misc_feature: Ceres CLONE 382570-F
  misc_feature: The sequence is a functional homolog of SEQ ID NO 2358 in the 10/374,780 US patent application
  misc_feature: The sequence is a functional homolog of SEQ ID NO 34 in the 10/225,066 US patent application
  misc_feature: The sequence is a functional homolog of SEQ ID NO 358 in the 10/412,699 US patent application
  misc_feature: The sequence is a functional homolog of SEQ ID NO 835 in the 11/479,226 US patent application
MPDFPTRSTGHRRAHSEILGLPDDLDLSAPGAAKDRRCRTRTMRSSS

SEQ ID NO: 9495 - DNA, 490 bp, Zea mays
  misc_feature: Ceres CLONE 382573-F
  misc_feature: Encodes the peptide sequence at SEQ ID NO. 9496
agcacggcaggcacggctgagcgaacgctcctccttccaaacccacgccgacaccgatgccgagagccggggtgtccagcagcgagagtagccgccgtggcgccggtgcgttcagaaccctctccgaagatcgccgcatcaccgtattctgctccgacggtcgcctctaccaagtcgattacgcgtggaacsttacgaagctggcgggcgtcacctccgtcggggtgcgtgggaccgactccgtatgcgtcgtcggccagcggagggcgaacacgcacgcgcccaaggacaaattgctggacatgaccagcgtttcgcgcctgttcccgatcaccgaccggctggggttgctcgccacggggatcgcaggtgaggggagagcattggcacatgaggcaaggaatcaaactgcagaatttcgtttcaattggggatatgaaatgcctcctgatgttttggcacaatggattgcagacagagcacagatctg

SEQ ID NO: 9496 - protein, 144 aa, Zea mays
  misc_feature: Ceres CLONE 382573-F
  misc_feature: SWISSPROT Homolog: EC 3.4.25.1 Proteasome endopeptidase complex
  misc_feature (46)..(46): Xaa is any aa, unknown, or other
MPRAGVSSSESSRRGAGAFRTLSEDRRITVFCSDGRLYQVDYAWNXTKLAGVTSVGVRGTDSVCVVGQRRANTHAPKDKLLDMTSVSRLFPITDRLGLLATGIAGEGRALAHEARNQTAEFRFNWGYEMPPDVLAQWIADRAQI

SEQ ID NO: 9497 - DNA, 1462 bp, Zea mays
  misc_feature: Ceres CLONE 382583
  misc_feature: Encodes the peptide sequence at SEQ ID NO. 9498
agctcactacttcactttcactctctgctgtagtcctgtggcttctttcgtggcggcgccgtcctcctcgccgggctcttcccgccgacgagcatccacctgtgcaggcactgctgcagcagcagccgctgttttctacagtaacctgtgaggcggaaagcagtttttttcggggggctacggattgctgctcgaaagcggcagcagccggcacgatactaatcgagagcagagcaggtgtatacaccctacacccatttcctgtactgggttacttcgtggcagaggcaccatgcctcctggtgacaacccgcactcagtttcagagaatacggcagcactgagggaatcaccaaaacagcccaagaatgttgttaatgagcaacccacaacttctccttttcctgaagacaaagttgctgctacagttggcataaagcgaccacagccttatggccccttgagtccgaccaatcatcacacgctgggcaatccaggggcaaatggccatcttgtgtatgtgcgaaggcggcttgaaactgatcagagcaaagggggtactgctgcccacggagaaagtgccagttctacaagcttgaagaaagctggtgcaggcagcttgcagtcacagggacgaattctgaagcatcaaaacaatgcaactcacacccagtgtgctccccgatttgcatctccagctgctgctacatcctcccctgctttgcaacctgcagttttgtctcctcactgttcttttgggaagcaatctccaggaaaggttgctgcccagccagctaatgatgtgactactagtctgccacatgctagcaatgtggtctcctctgcttcagtgcttcaaagctctgtatctgctaacttagcaccaagcagtgtttcggctgctaacacagcatctcgcgctgctatatctgctactaatttagcatcttgcagtgctctgggtaccaatgcatcatctaatgatgctactactactttagcatctaatcaagctcatgagccaagatcgagcaatcaggatcggagtgaaagattccttcgtctgcaggaattcttgagacataatgagcaatctgaccaggaagaatatgtacataagctccggtcattgtcacccgttggacgtagtaagcatgcctttgagttggagaaacgggcagccaatctattgatcgaggaagggaaggaattgcagaagatgaaatttctgaatgtgctgggcaaacttgtccccccatcacttccgaatcagcccccttctgtcatgcatcagccgccgttcactgcccatcgatgagaagagtttaagatttagttacgatgctccatgacaggcgttcagtgttgcgttatctgtgagaactgagaacatgcctgtatgcccatccggatgagtgagagtagagttggctgacttgatatcaaaaaaaaaaaaaaaaaa

SEQ ID NO: 9498 - protein, 341 aa, Zea mays
  misc_feature: Ceres CLONE 382583
MPPGDNPHSVSENTAALRESPKQPKNVVNEQPTTSPFPEDKVAATVGIKRPQPYGPLSPTNHHTLGNPGANGHLVYVRRRLETDQSKGGTAAHGESASSTSLKKAGAGSLQSQGRILKHQNNATHTQCAPRFASPAAATSSPALQPAVLSPHCSFGKQSPGKVAAQPANDVTTSLPHASNVVSSASVLQSSVSANLAPSSVSAANTASRAAISATNLASCSALGTNASSNDATTTLASNQAHEPRSSNQDRSERFLRLQEFLRHNEQSDQEEYVHKLRSLSPVGRSKHAFELEKRAANLLIEEGKELQKMKFLNVLGKLVPPSLPNQPPSVMHQPPFTAHR

SEQ ID NO: 9499 - DNA, 407 bp, Zea mays
  misc_feature: Ceres CLONE 382642-F
  misc_feature: Encodes the peptide sequence at SEQ ID NO. 9500
gtcacaaatccaagggtgcccagcggcgccaagcccaagtcagcgcgcgcggcgatggagcggcgggggcaacagcctggcgacgcgcagcagccaggcaaggacggcgccggcgactcccctcctccaccgccaccgttcctggaggtgagctgcaggagctccggcaaggttcggcggttcgcggcggggacgacggcccgctacgcgctgcacgccatcaaccgcaagctcggccccggggccccgccggcgctgcacgtcgaggccgtcagggacggcgaggagcccgtcagcttcggccccagcgcggccctcgccgactacggccgcggctggaggctgcagaccgtcaccgcgcacgacgcgcccgggatccatcacgcgccgcacgcggacacgaaaca

SEQ ID NO: 9500 - protein, 117 aa, Zea mays
  misc_feature: Ceres CLONE 382642-F
MERRGQQPGDAQQPGKDGAGDSPPPPPPFLEVSCRSSGKVRRFAAGTTARYALHAINRKLGPGAPPALHVEAVRDGEEPVSFGPSAALADYGRGWRLQTVTAHDAPGIHHAPHADTK

SEQ ID NO: 9501 - DNA, 145 bp, Zea mays
  misc_feature: Ceres CLONE 382673-F
catttaccactgaccctgtatttcgtgtcaccgtgcgactccgacgagccccaaccccgcgcgccggtgaccatggagttcatcgacccctgggactcccagtcccgcgctcgcgtcgtccattccggcgccaactccacttcgt

SEQ ID NO: 9502 - DNA, 677 bp, Zea mays
  misc_feature: Ceres CLONE 382684-R
  misc_feature: Translation starting site: 368
ccaattgggtaccgggccccccctcgaggtcgacggtatcgataagcttttttttttttttttttagttattttttttttttttaaaccaactaaaaaaacttacacctgtaaatcacggctatcattacatgtctgtaactatcctccttccccaaaccggaaaagaatagtaagaaacactagtaacaactggacaaaaaaaacaatcaaagaatcagagaccgccgtttcgcaatccgggcacgccgccggtatttggcattgccgcattggcgtctcagcccctccactccgggcactggtcggccggccgcgtgttctgcgacccggccttgatcgggcacggcgcgtacaccggcggcaccatgcagttgtacatcaggcagagcgacaccgtggaagggagcgacgacgacggcgatatctcgatgcccgtcaggaagttgtgctgcaggtacagcacctgcaggccgccggagcccaccagctcctgcaccagccgcgcgggcacctcgccgctgaaccggttgttgttcaggtacagctgcccgacgcccgcgaggagcggcgacagctggccccagaaccggttgtagctcaggtccaccaccaggatcgtcacgtcgcccgacggctgcaccggccccgcgaagaagttccgctgcagctgcagca

SEQ ID NO: 9503 - DNA, 387 bp, Zea mays
  misc_feature: Ceres CLONE 382712-F
aaacccatctcgcccccactcctatccgcagagtactacatcaccagagggaggttgcgagttgcgaccgggggccggccgaccgagccaaagtacgctaccactcttgctgcaccgaccgcgagggtgcaacaacgacttacatatatatataaatatccgcgccgcagctagctagctagcagagcagcccggccgaagccgttagcctagcctcctcacatatagcagcagcaggacgagatcgtcgatcgatcgatggtgtctctgcagccctcatcagcggcgccgctcctgccggasscgccaccgcgaacaagctcccgccgtggctctcactcgtcggcagcgtcgtcgcctcctccacgggtacggcggccaccagca

SEQ ID NO: 9504 - DNA, 277 bp, Zea mays
  misc_feature: Ceres CLONE 382724-F
cattttatcgagtgtgtcgtgtttcatataatgccaataatctctccgcagccgactcgccccggtgggctgactgagctccggtccgcctcgacccgcggccgtacgccccggagctccacccgtcgcgccgcgtcggagctcgtcgccggcgatggcttccgcggtgggcgcttcgaccgccacgcgtttcctcccgcggctcccggacccgtggcggccgcgtcgtgcgccgcggcgctcccgcssttcacgtggctgcctcccgcggtcacgg

SEQ ID NO: 9505 - DNA, 231 bp, Zea mays
  misc_feature: Ceres CLONE 382736-F
  misc_feature: Encodes the peptide sequence at SEQ ID NO. 9506
gacgatctccagctgtccttcaatcaaattatcaacccaacgccatttcggcgctcccgcttcccacaggagtcacagctcaacaaatccctacccaadtccwrcctbscccgccccccaccgccatggctcccccaccaacctcgcgctgcctcgccctcgctctcatcctcatcggcgccctctgcgssccgccgccgccgcggttcgccccggcggacaaccacctcc

SEQ ID NO: 9506 - protein, 35 aa, Zea mays
  misc_feature: Ceres CLONE 382736-F
  misc_feature (22)..(22): Xaa is any aa, unknown, or other
MAPPPTSRCLALALILIGALCXPPPPRFAPADNHL

SEQ ID NO: 9507 - DNA, 388 bp, Zea mays
  misc_feature: Ceres CLONE 382768-F
  misc_feature: Encodes the peptide sequence at SEQ ID NO. 9508
  misc_feature (180)..(180): n is a, c, t, g, unknown, or other
gttcctagtcgtaccccgcagcttccgtgctcacctcgcctgcagggcagcagccgctggaagaacacgaagacgacgggagtgcggggtggcgtcgcgcggagcaccagttgtagccggcggctaggcctccgcgccgctctccgtggccaacgtgccgtcatgcttgcggcgtcggcncggcggctgtccgssscttccgttttttcctcttcttccatgcgctccagccagctcgccgccgttactgaaccaacagaggtggatgcacgacaggaacaagaaggcgatgkgasctggtggccaacggatggagtgcgctccaggaggtcgaccgcgktcatcgactacgccgatcgcaacgacaagcgcctcatcccgcttctaa

SEQ ID NO: 9508 - protein, 75 aa, Zea mays
  misc_feature: Ceres CLONE 382768-F
  misc_feature (11)..(11): Xaa is any aa, unknown, or other
  misc_feature (12)..(12): Xaa is any aa, unknown, or other
  misc_feature (44)..(44): Xaa is any aa, unknown, or other
  misc_feature (45)..(45): Xaa is any aa, unknown, or other
  misc_feature (60)..(60): Xaa is any aa, unknown, or other
MLAASARRLSXXSVFSSSSMRSSQLAAVTEPTEVDARQEQEGDXXWWPTDGVRSRRSTAXIDYADRNDKRLIPLL

SEQ ID NO: 9509 - DNA, 459 bp, Zea mays
  misc_feature: Ceres CLONE 382771-F
  misc_feature: Encodes the peptide sequence at SEQ ID NO. 9510
gctttcaccccccgcatcgaacctcacccccgatctgatcgaatcgaaggctgcggcggcgatgggcggtgaccatggcggtgggcacgccggcggcacttccgccagaaggtatggagcatgacgggcggcccctactgccgccccgtccactggcgccgtaacaccgccatcgccatgttcggcgtcttcctcatctacatccccatcgctatgaagtccgcagagctcgagcaacgcccgcatcacccagtccggccaatcccatctcaactgtggtgcaaaaactttggtaagaaggaatactgaaggaccctccaactagcatgaagtgtgggcaccttgcttttgccttctttttgtggaaacctgtgcctagccataatgctggggatgggaatgcaccggacagatcgacttaatctccggttgctgctgcgtggactaggctacccgcga

SEQ ID NO: 9510 - protein, 62 aa, Zea mays
  misc_feature: Ceres CLONE 382771-F
MTGGPYCRPVHWRRNTAIAMFGVFLIYIPIAMKSAELEQRPHHPVRPIPSQLWCKNFGKKEY

SEQ ID NO: 9511 - DNA, 346 bp, Zea mays
  misc_feature: Ceres CLONE 382797-F
  misc_feature: Encodes the peptide sequence at SEQ ID NO. 9512
attcatgccgcgtgcgtgaccatttctgtgcgttcgcaggtggtcgtctgggtggcgacgcggcgatgatacgcgccgggtcgacgaccgacgtcatgatcgtgctgctgacggcgttcctgctggagtacctgcccaagatctaccacgccgtccgcgtcctgcgccggatgcagggcgtctccggctacctcttcggcaccatctggtgggggatcgcgctcaacctcatggcctacttcgtcgccgctcacgcggtgggcgcgtgttggtacctgctcggcgcgcagggtccaccaagtgcctcagggagcagtgcgcccaggccgggagcgggtgcgcgccc

SEQ ID NO: 9512 - protein, 114 aa, Zea mays
  misc_feature: Ceres CLONE 382797-F
SCRVRDHFCAFAGGRLGGDAAMIRAGSTTDVMIVLLTAFLLEYLPKIYHAVRVLRRMQGVSGYLFGTIWWGIALNLMAYFVAAHAVGACWYLLGAQGPPSASGSSAPRPGAGAR

SEQ ID NO: 9513 - DNA, 364 bp, Zea mays
  misc_feature: Ceres CLONE 382804-F
  misc_feature: Encodes the peptide sequence at SEQ ID NO. 9514
aattccccaacgcagccagcagcgcaaggtccagaagcccagaaccagacgagcacggacggatctcccccaacgcgcgtgcgtccgcaactagcgtctgccgccggccgccttcttccgcaccccccgacgcggcaaggagccccccgccatgagggtccacccggccccgcggaagcgcaccatcgccgtgcaacgctgcgcctccgcggcggcgggcgcgctcggcgggaagaagctgcgccgcctgccgcacatattcgacaaggtgctggagctcccgttcgcggccgacgcggacgtgtccgtcgaggargacgcggcggcgctgcggttcgtcgccgccgccgacgagttytccctc

SEQ ID NO: 9514 - protein, 71 aa, Zea mays
  misc_feature: Ceres CLONE 382804-F
MRVHPAPRKRTIAVQRCASAAAGALGGKKLRRLPHIFDKVLELPFAADADVSVEEDAAALRFVAAADEFSL

SEQ ID NO: 9515 - DNA, 721 bp, Zea mays
  misc_feature: Ceres CLONE 382843-R
  misc_feature (423)..(423): n is a, c, t, g, unknown, or other
ccaattgggtaccgggccccccctcgaggtcgacggtatcgatattttttttttttttttttggttttcaatcccggaactgcatgcatgaaaatgggtgttacacaagtgacaagttactaggccgcctactctgctcgctacgaaacaagctgattccaccgccaccggggctcccggctccgtcgtctctactctgctctgttcacgagatggagtttctccacctccgcggcttcctcggcgcctctccgggcgctcccggcacgtgcccgtcgtgccccgccgcgtcgccgccggtcatcttggccagcctgcccagcttcttccacccgctgctccacgccgagggcccctggctgtgattcttgccaccaacgcctcccgccgccgtggccttgagcccccgccgcaggggcgacngcgcgccacgctccaccagctttctggagcgcgtccatctcgtgctgcagctcccagtacttgggcttcatgctcttcagctccagcttcaggggggttgattccctttttcgccgcccgccaacctttctggaacaaactgggggtgtgcttcaaaaaatttccctccgggttggggggcccacccctccccccccctttttgccaaaccccccgccgcttttaagaaaaaaccccttgcccaccttttttaaattttcctttcccaaaaaaaaccttgaacccccccccggggggg

SEQ ID NO: 9516 - DNA, 409 bp, Zea mays
  misc_feature: Ceres CLONE 382870-F
  misc_feature: Encodes the peptide sequence at SEQ ID NO. 9517
aagctgaaagagaagctacagccagcaacagcaagcaggctgacgaakgaaccaaactctagcgagcaagcaaggtatagctagctagtagccaagaggccaaatacccaaaggcgagcgatggcgcccggwagcatcgccagccggtggcgcgagctccagggcgcggactcctggtcggggctgctggacccgctggacatcgacctgcgcgcgaacctgatcgcctacggcagctcacgcaggccacctacgacgggttcaaccaggagcggcggtcgcssacgccggcgcctgcgtgttcggctactccgacctgctggccggctcgggcgccgcggcggccggggagctacgccgtcaccaggttcatctacgccacgtcggcgctccccggcgtgcccgaggc

SEQ ID NO: 9517 - protein, 96 aa, Zea mays
  misc_feature: Ceres CLONE 382870-F
  misc_feature (55)..(55): Xaa is any aa, unknown, or other
MAPGSIASRWRELQGADSWSGLLDPLDIDLRANLIAYGSSRRPPTTGSTRSGGRXRRRLRVRLLRPAGRLGRRGGRGATPSPGSSTPRRRSPACPR

SEQ ID NO: 9518 - DNA, 98 bp, Zea mays
  misc_feature: Ceres CLONE 382871-F
gacgaacaacgcccgcgcagagccgggggtagctagctagctcctccgatggccagccgcggtggcgcattcgtggtgttcgttgtcctgtgcagctc

SEQ ID NO: 9519 - DNA, 477 bp, Zea mays
  misc_feature: Ceres CLONE 382877-F
  misc_feature: Encodes the peptide sequence at SEQ ID NO. 9520
  misc_feature (328)..(328): n is a, c, t, g, unknown, or other
ctaccctgcatccctactgtatgctacgagactacgacactgctgtccctgcctgcaccctgatccagttcccggtagcataccaccatgggcctctgcatatccgtgtctctctggaaggagaagctctacggcgccgacggcagcagccggtcagtgcagtgtcgcgtcgtccatgaggttgccggcgtggagagtggtgactgcgagtgcgggaacttgggaagcgacgccgacgcgctgggggtagagcacaaggcggcggcggcggcggctccggcggccatgggcgtgaaaagcggtggagtggagggagctgccgctgccngtgtcgggtggcactcctgtgcggccgatatggcagaggagggtgctgatgggcgtcaagtgccagctgccgcggttcagcgggaatggtactctacgacgagagcggcccggccggtgtgcactggcgtccgggacagagctcgtgac

SEQ ID NO: 9520 - protein, 130 aa, Zea mays
  misc_feature: Ceres CLONE 382877-F
  misc_feature (81)..(81): Xaa is any aa, unknown, or other
MGLCISVSLWKEKLYGADGSSRSVQCRVVHEVAGVESGDCECGNLGSDADALGVEHKAAAAAAPAAMGVKSGGVEGAAAAXVGWHSCAADMAEEGADGRQVPAAAVQREWYSTTRAARPVCTGVRDRARD

SEQ ID NO: 9521 - DNA, 510 bp, Zea mays
  misc_feature: Ceres CLONE 382893-F
  misc_feature: Encodes the peptide sequence at SEQ ID NO. 9522
atcagatttcaaagcgagctcgtcatgaccgctgtattgctgtttttgcgccgatggtccgatgctgtgcagtctgggaggaagaagacgcgggagcccaaggaggagaacgtgacgcttggccccgctgtccgcgagggagaacacgtctttggcgttgcgcacatcttcgcctccttcaacgacactttcatccatgtgacggatctgtctggaagggagacgctcgtccgcatcactggtggcatgaaggttaaagctgatcgtgatgagtcctcgccttatgctgctatgcttgcctcacaggatgtcgcgcaaagatgcaaggagcttggaattactgcattgcacattaagctccgtgctactggtggaaacaagaccaaaacccctggccctggtgctcagtctgctcttagagctcttgctcgatctggcatgaagataggccgtattgaggatgttactccagtccccacagacagcacacgcagaaagggtggtwgaaga

SEQ ID NO: 9522 - protein, 162 aa, Zea mays
  misc_feature: Ceres CLONE 382893-F
  misc_feature (44)..(162): Pfam Name: Ribosomal_S11 Pfam Description: Ribosomal protein S11
  misc_feature (161)..(161): Xaa is any aa, unknown, or other
MTAVLLFLRRWSDAVQSGRKKTREPKEENVTLGPAVREGEHVFGVAHIFASFNDTFIHVTDLSGRETLVRITGGMKVKADRDESSPYAAMLASQDVAQRCKELGITALHIKLRATGGNKTKTPGPGAQSALRALARSGMKIGRIEDVTPVPTDSTRRKGGXR

SEQ ID NO: 9523 - DNA, 425 bp, Zea mays
  misc_feature: Ceres CLONE 382894-F
  misc_feature: Encodes the peptide sequence at SEQ ID NO. 9524
cgaaaaatcttcactctcctggtttattcctccgtgccgatctcctcttctccggcgggaccatggcgccgtcctcctcccgattcgacgatccggcggcggtgaggcgccccccgcagcatgaacggaagccgccgtatatgttgcttctcccgctcgtctacgcccccgtcctccccctcatcaggatcgggctgcggcacaatcccgtggtgagggaccgcctcttctacggcgtcctcgccggcgcattcgcccacggcgcctacctcatatcggaactgtatgatgtggagagcaaatgatgggcatccctcgaaggatgaggggataagttttcaggtagcaaaatttgattccatcgggattccagattgttggatgagagctgacatggcaattcagactaactagtgtgctatgta

SEQ ID NO: 9524 - protein, 80 aa, Zea mays
  misc_feature: Ceres CLONE 382894-F
MAPSSSRFDDPAAVRRPPQHERKPPYMLLLPLVYAPVLPLIRIGLRHNPVVRDRLFYGVLAGAFAHGAYLISELYDVESK

SEQ ID NO: 9525 - DNA, 278 bp, Zea mays
  misc_feature: Ceres CLONE 382916-F
  misc_feature: Encodes the peptide sequence at SEQ ID NO. 9526
  misc_feature (269)..(269): n is a, c, t, g, unknown, or other
acggcaccgcssccgccgccatcctcgacccctgaagtgaagaggcaacctgaggacgcctctcccatccacgcgcgaatcctaccgccctcacacacccaaaaacctagccgcgcgcgacctgcatcccatggcggcaaccgcggccggcggggaccgggtcgtccctctcctcgcgccgcagtcgcagcgctgtctcctcgcccttccgcgcasstgcctcgcgcttccgctcgccgagatgcgtgctcgggagcgagcagctgcgngtggcgcat

SEQ ID NO: 9526 - protein, 49 aa, Zea mays
  misc_feature: Ceres CLONE 382916-F
  misc_feature (29)..(29): Xaa is any aa, unknown, or other
  misc_feature (47)..(47): Xaa is any aa, unknown, or other
MAATAAGGDRVVPLLAPQSQRCLLALPRXCLALPLAEMRARERAAAXGA

SEQ ID NO: 9527 - DNA, 482 bp, Zea mays
  misc_feature: Ceres CLONE 382919-F
gcattcgtgctgaggctctactgctgatccgtcttccaagctctggtgagtctctctcaaatatcctttgtctctggtacagttgatatgagcgttgtaaggcggagacattgtaggcgtgggcttgtgaagtgggattcgatggggtttcagcatctgttccatggatcctattggggagctttgtgccgttgctttggtcttggctggcatcttgccggcgttgcaccgcggcctgctgcagctggcctcttggcggctctgatgctcgcggcggcgccgttgttgcgtattcttctgtctctgcttatattgattattcaaagcaagcaaggttcacaactggcgtccttgtttaagcaaggatgattgtgccagtggagatttcaggggctcgttaatgatcggaaaattcatgaaagtttctatgctgagatyagagaaagttcatgaaagttcatggacattaagagagtagcaat

SEQ ID NO: 9528 - DNA, 520 bp, Zea mays
  misc_feature: Ceres CLONE 382936-F
  misc_feature: Encodes the peptide sequence at SEQ ID NO. 9529
agaacattcgattctaaaatttacaatttacaatttacagctgtgcggaggcgggagcagggggcagcgagcacctagcagcgcgcggccggcgactccaccgagacacctcagccggccgcgcggtcgcggttgcctccggctggctcctcgcctcgatggtggggatgtaccagcaccaactccgcgacgaccccttcgacaccctaagcggcggccactgcggtgagcagccacgcgttgccggcggcggcgcctcctcctcctcaccctcggctgttcatgacccgctgtctgcagaggtacatggcggcggacagccgcggcagcgggtcgaggcgcttgccgacggaagaagcatgttgcgcggcgggggaagcggtatagttggcgccgcgggtggagatctaggggtgctagtgcggtggatgcgggaactcgcagcggatcccgtgggtccacttccggcgccatcagagcacagggtgaggaagcggcacgtgctggcctggcggcgcgc

SEQ ID NO: 9529 - protein, 120 aa, Zea mays
  misc_feature: Ceres CLONE 382936-F
MVGMYQHQLRDDPFDTLSGGHCGEQPRVAGGGASSSSPSAVHDPLSAEVHGGGQPRQRVEALADGRSMLRGGGSGIVGAAGGDLGVLVRWMRELAADPVGPLPAPSEHRVRKRHVLAWRR

SEQ ID NO: 9530 - DNA, 1090 bp, Zea mays
  misc_feature: Ceres CLONE 383400
  misc_feature: Encodes the peptide sequence at SEQ ID NO. 9531
ctggccacacgctatcggctatcctctcccctctatccttttcttcacttcgctccgtcccccacacactgtcactgccagcctccccttcgcttcgcttagctcgccgtcaccatggcgacctccaccttctctccgcgccccgccaccctcaagcccctgcgggcacgcgccaagcccgccggcctccagctccacctcctccccttcccgcgcctccgcgtcgcctgcgccaccgccgccggggaggcgccgcccgttgagcagcgggacgaggtggagccggcctccgccgcggcatccaacgggactgccgtcaaggtcgaggcgcccgccgcgaagcccgagtccccgcccgcgcccgcgcccgcgcccgcgccggtcccggccttccgcgacgccaggtgggtcaacggcacctgggacctcaccaagttcgacaagggcggcggcgtcgactgggacgccgtcatcgacgccgaggccaggagaaggaaatggctcgaagactacccggaggcgacgagcacagacgatgccgtcgtcttcgacacctccattatcccgtggtgggcatggatgaagcggttccaccttcctgaagccgagaagctaaacggtcgcgccgccatggttggcttcttcatggcctacttcgtggacagcttgacgggcgtgggcctcgtcgaccagatgggcaacttcttctgcaagacgctgctgttcgtcgccgtcgccggcgtgctgctggtcaggaagaacgaggacgtggagtcgctcaagaagctcatcgacgagactacgttttacgataggcagtggcaggctacctggcaagatgaccccaccgaggggccaaagaattagttccgcgttgggggtgccaacgcagaatgctcgcttcttgtggtgtgtcttgcctatttcttcggcccctttttgtttcaccgtttagtcaggcttggaggaactttttgatgatcgtcataatctatctatctacgtgatcttgtgcaaaaacaaaagatatggactcactttctgtgctggagataataatcacgttgcagttccaaaaaaaaaaaaaaaa

SEQ ID NO: 9531 - protein, 250 aa, Zea mays
  misc_feature: Ceres CLONE 383400
MATSTFSPRPATLKPLRARAKPAGLQLHLLPFPRLRVACATAAGEAPPVEQRDEVEPASAAASNGTAVKVEAPAAKPESPPAPAPAPAPVPAFRDARWVNGTWDLTKFDKGGGVDWDAVIDAEARRRKWLEDYPEATSTDDAVVFDTSIIPWWAWMKRFHLPEAEKLNGRAAMVGFFMAYFVDSLTGVGLVDQMGNFFCKTLLFVAVAGVLLVRKNEDVESLKKLIDETTFYDRQWQATWQDDPTEGPKN

SEQ ID NO: 9532 - DNA, 708 bp, Zea mays
  misc_feature: Ceres CLONE 383544
  misc_feature: Encodes the peptide sequence at SEQ ID NO. 9533
actcttctctccacgaaagtacgaaaccaactagaccagtccagccgcaggccgcagcacgcagccaggcagccagccatggccgtggcttgcgcgtcgcttgcggttgcgggcaggtgggagatcgggggcctgttcacggaggcggagctggcggtggcggaccagctcgtgcaactcagcggcagcggcggaggggacgaggaggcggcgtcgtcggagtcgccgcggtcggtgaacacgtgcgcgggtgccgcggcgtgggaggagcgagaggaggcggccgccggtcccgcgctgggggcgatggagctggacaggagggcgaggaagaggtaccgcctcctgtccgacgtctacgccgccacgaggccggtggccggcgccggcaccggcgcggacaacgccaggaagaggaagcggggtcacgagccgaaccgaggcggagccgcggaggcggggacgacgatcaggtaggtacgacgacggagatcagtgcttctagacttgtagaatctagatggaatattacggaggtaggagatgggagggaagcgcttttgtgtaattatcgaagagtagcagggtctgttctgcaatgtcagtcctttagcttttcaaagttctcctagtagtagtagaagagaaggggcacagcagccagcaaacaacaaaggcaagctagtttgtacaaaaaaaaaaaaaaaa

SEQ ID NO: 9533 - protein, 132 aa, Zea mays
  misc_feature: Ceres CLONE 383544
MAVACASLAVAGRWEIGGLFTEAELAVADQLVQLSGSGGGDEEAASSESPRSVNTCAGAAAWEEREEAAAGPALGAMELDRRARKRYRLLSDVYAATRPVAGAGTGADNARKRKRGHEPNRGGAAEAGTTIR

SEQ ID NO: 9534 - DNA, 716 bp, Zea mays
  misc_feature: Ceres CLONE 383600-R
ccgggccccccctcgaggtcgacggtatcgataagctttttttttttttttttagaaaaagaatgaggttctcctcttattcgcaatactgtcacagaaaggtgtagaatcattaacattaacaagacactaccttagaaacatacatttgcagagaaataaacccaaaaaagggctcaaattgacgcatttacaaggcaactaaacgtcactccataaggtgactcattttccctgaaatttcgacgacaaaaagttctggaacttagaaaatccatccatcgcatcctgcggaagagggagcgtgaagggaggaagaacactttgtccagcattttgatccttagccagtggtagcgccagtgcgggctgctgcttgtttagcgtctctatgatgtacgagaaagtcccaaaggtcaggcagctctgaatcagagtttgcggtgcacctggaaagctcagcgcaaggccagtgcaacagcctgccactcctgcattgataccatcatcttttccacgtaattttcccaaaaagcgggcttacaaaactttgttacgccaagcaagggacagacaaatattcttaagcagacgaaagccaggattcaagggaaatggattccctttaaaaaccccctttccctcaatgaacccagaaccctttttacccggtaatcccgaaaaaaacggggggcccctgaacaaaagggggaatg

SEQ ID NO: 9535 - DNA, 651 bp, Zea mays
  misc_feature: Ceres CLONE 384233-R
caaattgggtaccgggccccccctcgaggtcgacggtatcgataagctctcttgccgttttttttactacaattacccacatagaaaccttttttgctgactggtgaatacaagattaaagacagggtccctcataatttgtatcgaagctattcctgtgatcgatccctgaaacaaaagatgagactcgatccacccttcaaaataatcatatagactccaatcaaactcccgaaagacgcgcaacagataaggtgcccctattatgaaggtgcgccaccaacagctgtgcggctaccaagaccaccatcatatccagcatggtgaaccctgtgagagccaacatcagctccaccttatgagccacctctgccaccacggaggagcccgtaatcacacctgtaactaaattcttgcctcccgtaagcccttcctccaccgtagttaccacgccctgctggtacattcaattctgaaattgttgcccctgcctggtgcgaaacttgcacctctgcatgaaccctctggaacaagagaccctcctttcctcaacgaaaacatggaaaacccccgaattgcttccggggaaaaccccctataaaatttttggaaagaaatagaaaccttcaaaatccctgccacccgggggaa

SEQ ID NO: 9536 - DNA, 931 bp, Zea mays
  misc_feature: Ceres CLONE 385105-R
  misc_feature (25)..(25): n is a, c, t, g, unknown, or other
  misc_feature (35)..(35): n is a, c, t, g, unknown, or other
  misc_feature (36)..(36): n is a, c, t, g, unknown, or other
  misc_feature (38)..(38): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (56)..(56): n is a, c, t, g, unknown, or other
  misc_feature (487)..(487): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
tttttagaaaccccccgcgcggcgnacaacaaatnntnttaaannnnnnnnntttntacgattgggtaccgggccccccctcgaggtcgacggtatcgatattttttttttttttttttcaaaaacacctgcatttccattatataaagtcttgtcaccatctataacagcatgtcgccacctccccgcctgaaaaatcctaacaatctgcccgcgtgtgtttcatctacctcgaacccgggggagggggggggggggggggccactcaggagccatggcaccgtataagaggacaaccaatgtgacacaggagggtcggaggttaataaccgtcgtaaactgcaaccttgctcattattagtccaacaaacgacagatggacacaacaggcgtgaacaagagtgagggattgggaaaaaaaaaaaaaaaaaaaaaccccaaccccccccccttagcgggtggttggggattaaaatgagatttaanaaaaaannnnaccccgtcgcacaccccggtggtaaaaaaaaaaaaagttaacagtgggcgtgggtgtttcctaccacaccttgcgaatccagatgtgttctgttggatggcggttccagtattctcctaatacctgctataaacaaattgacatcatgtcgttcagacattcgaagaaactcaaatatactaaacgatacagagaaagatctgtagtctttccatccctcagtaagtgtctgtcacctacttggtgtctgccatgtgcttaccgcacttttaactcaacaagtaatatacagatccttgtaattgctatcatatatgcagatgtatttaaatgtgtattctatggcatccatgttatatgtagacaacgtataagaaagtcacagcgcgcgactataaaagacacaactaggaggatatcaagaaattaaaaaa

SEQ ID NO: 9537 - DNA, 895 bp, Zea mays
  misc_feature: Ceres CLONE 385514-R
  misc_feature (27)..(27): n is a, c, t, g, unknown, or other
  misc_feature (334)..(334): n is a, c, t, g, unknown, or other
acacaccagcccaagaacaaaaacctncgcaaaaaagcacgctattttttttccgacaccaatatcgctctcctcgaataaaaagatttttttttcaaatggggtacggggccccccctcgaggtcgacggtatcgataagcttttttttttttttttttgatacttgtaaaggaccttgaattattagttatcattgcccaaatgttcaaaagaacaacacaacctgacggtacaaacggaaagattcacctgagaataaaactaacttccttggattggactagccccagctcgagttggtggagtggtgcgaccaaaccgaatttcatggnaaacttcttgtggttacagtctagcatctcgctgaggatgcagctcgagttcatctgcttaagcaccttgtggcggtactccaggatccttttgaggccatggcgaaagaactgggggtaacctaccacctcgcccatgtcccggcccatgtcttcgaacaagaaaatcgacttcccccccccagcaaaagtttgatgctctttgattgataaacaggagggtaaaccagccttaccaaaatgccgtgaaaccttgaatcccttgcctgaaaataccgcgaggcttccttttaggtaaacgcccagaatttagggggccccgcaagggaatcttttattccaacgttcttctgccaaaagataattatctcggggaaagaggtcaatggaaacaacccctttcttgggaaaaattctttggaccccccttgttaaaaccccaaatctatttccagaacctttgaagaggaaaccttccggacatagctggagggggccaacaaaatccccgcgcttttggtccggaaacggcccatgttaactccccccaattgaaactaa

SEQ ID NO: 9538 - DNA, 960 bp, Zea mays
  misc_feature: Ceres CLONE 385752-R
  misc_feature (36)..(36): n is a, c, t, g, unknown, or other
  misc_feature (72)..(72): n is a, c, t, g, unknown, or other
  misc_feature (85)..(85): n is a, c, t, g, unknown, or other
  misc_feature (87)..(87): n is a, c, t, g, unknown, or other
  misc_feature (88)..(88): n is a, c, t, g, unknown, or other
  misc_feature (116)..(116): n is a, c, t, g, unknown, or other
tttttttttttcttgtgtttagtgccgccaccggcnttatatattttaatataaaaggaagacaaaaatgtngtggttttttgtntnnttacgattgggtaccgggccccccctcnaggtcgacggtatcgataagcttttttttttttttttttagaccgaatgtatctctcagcgcatgaggttgtcataaaacacatcaagaaatttcgcaaattggtgtaagatacaacaagaagtgatctgaggtaattgtagcgtaaaatgcaagctaaccatctataggagaactgtttcagattttacaatatgatataagagataattattcatgttcatgttgcccttatattttgtgtagagttccttcaagtctgttttctcagaatctgaccctctatatttagcttcaaattcttcaatgtcagcctccgtgactttcttgaacattgttctgaactactcctcgaagattgtttgcagggttctccaaacatgtgtccccccagcgcgcgacaacattctaggcgcacttcaccggacatgtaagagtggtgaattttttggtttgccagtcgtgcgtcccaaggacagaacgatcgtaggtaagagggagtgccatgggttgcaaacacgacaccaggaaaaaatagggctgggcccttgaaaaaagagctctccatgggaatagtaccaacgggaacgcagtggggcccccaagagaaaaaggggccgccgaggcccaagaccttgaaatgggttcagggcccaacaaggaaattgctaagtgtgtcaacgagaaataaatgcgtaacagggggtgaagggccccgaggaaacggaaacggatatcaccctatcgagccaatagataagagagtctggacgtatctcaattcgaaccacatagacagagtactcagtgaataaaagggttggggtcagcatttcactcagaaa

SEQ ID NO: 9539 - DNA, 728 bp, Zea mays
  misc_feature: Ceres CLONE 385827-R
  misc_feature (163)..(163): n is a, c, t, g, unknown, or other
  misc_feature (586)..(586): n is a, c, t, g, unknown, or other
  misc_feature (592)..(592): n is a, c, t, g, unknown, or other
  misc_feature (610)..(610): n is a, c, t, g, unknown, or other
  misc_feature (627)..(627): n is a, c, t, g, unknown, or other
  misc_feature (647)..(647): n is a, c, t, g, unknown, or other
  misc_feature (678)..(678): n is a, c, t, g, unknown, or other
  misc_feature (689)..(689): n is a, c, t, g, unknown, or other
cgattgggtaccgggccccccctcgaggtcgacggtatcgatattttttttttttttttttgaaacataataccacaaatttaataagtatcattagtgattacattatcggagtttcagaaataataaccataaattttaatgcagcggaaataactaacgngagaagaaccgagtaacatggcgaagcctggccacactactcctcctggtcctctcctgcggaagtagtaacccactcgaccgtctgtcccggtggtagggacgaaggccaagtcacaccatcaacaaatcatcctaaggagtacctttattttaacacttagatagtgtttgctggggggtactcgcttggcgagcatccattggttatgtccatcctttaggtcgtccaccacggcatctcgtggttgacaccacatcactggctcgatcatcatctctcggtccgaggacttacggcgccgcggatggggctgcgcacgcccgattagagcccgacgacgagtgtgacgaggcaaaccttcgcagcagtgctgctgcactggagagagggcacgggatctagatgggaaatagcgcgacngacatngagagagctcggcccaanaaaggaactcgctggcnagcccagggaaggatttccngcaaaggatgctccctgccacccaaccaggnaggaaaggccnccaaatttggaaatataaaattccccgcccaatggaaaa

SEQ ID NO: 9540 - DNA, 760 bp, Zea mays
  misc_feature: Ceres CLONE 386042-R
  misc_feature (760)..(760): n is a, c, t, g, unknown, or other
cggggcgttcggtggggtgtttcttcgccggggtgtaagaggaggggggggccggggtgtatatgtttttgacaagtgatagcgcatccatgatcatggattcgaggtcgatactgttcagaagccagtcctatttcctacagaccgtcaaattttctatctcatattacagttttccacgacgacatactctttttattattattacttgcaaattcgctgcaaacgacaacacacacgagacaagacgcgtacagaacggacattcacgaacctggtactcttgcgccgcggtgggatctccccgcccggggaacgatacggtcgccgggggtggggcggtggcggtggggggtcctgttgggggggccgggcaggcggtggggttacgcccccggacggaaggcgcgctcccgccacgcgtcggccagggcgcgacacccgcggcgggagacaccgcgtagttcggcgcgaccgccccggtcgtcgcggggcgccggggggcgaggtgggcgacgctgctgcccctgctcggcgctggggcggcgcagcgctgccctcccccggggagtgttgcgccgatgccggcgcctgcgcgagccactcgggcggggtcgcgcttgtgggtcgcgccggtcggggccgcggtggtgcgtggcaagcggaagccaccggccacgcgcgcgacgcgcagacgcgagacggcaatgcggcgtcgagggccgccgcggcgggtaattcggccgccaccgaggtcgcn

SEQ ID NO: 9541 - DNA, 768 bp, Zea mays
  misc_feature: Ceres CLONE 386109-R
  misc_feature (567)..(567): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (584)..(584): n is a, c, t, g, unknown, or other
  misc_feature (607)..(607): n is a, c, t, g, unknown, or other
  misc_feature (610)..(610): n is a, c, t, g, unknown, or other
  misc_feature (617)..(617): n is a, c, t, g, unknown, or other
cgattgggtaccgggccccccctcgaggtcgacggtatcgatattttttttttttttttttggccacagaacattgttgaatgataacatctctgcaaatccaccagtgcaaacaaagactagaccatacagataggcaaaaacgaaatacttgtcgcagcacaggccagttgctacaccattgtcagtttgtcactaaacttggaacaacaaaaaaacttaagcaggcactatagccactaactccatagtaccttgcagtgggctcgaactaacggttgcctttgtagcacctctggaggtggggaagcaacggacgggcctacagatctagcttgagttcctggatgtcgccgtcgcgggcgaggaaatggaggatgtaaggggtggcgcggatgacggcggcgcaggaggccatgatgatgatgtgcgaccgcagctgcttgtaagcagcctccttgctcgggcgccgcgggagcgagccgagaaacatcttgatttgcttctcttctccgaaaccgatcggcggcgagggtttcggcggagattttttttttggccgggggnaaatactattnnnnagnataaatttttttttaaaaaattnaanaagaagnatgttttatagatgatagaaaatccttcgtgggggagaaaaaaaatgatgttggcttggattttcttcgggccgccctccccggcaagaaatgaaccacgaaacatccctgcctgcaccctgtccttccccaacaatgcgggccgtccaat

SEQ ID NO: 9542 - DNA, 1938 bp, Zea mays
  misc_feature: Ceres CLONE 386154
  misc_feature: Encodes the peptide sequence at SEQ ID NO. 9543
atacatgctcgctcttcctcgtcttggtgagtctgatccctctctccttccgtcatccaccatctctagggttttagcgccccatttccgcatcgccattcccgatcggatcgccccttccccacccaaccctccggcgccgccacccttcgtgtcagagggtcggtctccaccgaaagcctcgcaacaaatctcctccgtttcttgctccggccatttgttgcaaagatcgtgttttcccccctcatccatgcctcgcgttccatcccttccgtccccggaaatccctccgctttcttgagatctcccgttcctcgatctgacctcgcctcgtcccgccaccacaagcaacagctgttttgcgccacgatcctcagggttgcgattctcgcgtccatttgctcgccccaatacctttcgggagcatctgatctcgaacagtgagacaaagtagccacctttgtgccgttccttgcgtatcggtgggtggcggcgctgcccattcctatgaatggacgggagggagtccacggtggcgtcggggcccaacttctcgtccttcttcgcgcagcaccggggcatcggggcgccgggtgtccccggccactcgcaggggcttcacgccccgccgcccggtgggtaccggcagcatcttgatgctgtctctgcggggtatgcattccagaccccgcatgttgggggtcccagcattgggcaggggtacgaggcctcacctcatgcggcacagcacagcgccggtggcggctctggctccggtggttgtggtggtatggacattggcatgggtgcggccgtgagtgccgatgttaagggggatcaggggagtgggcctggccaggatgagcaggtgaagaagaagcggggcaggccaagaaaatataagcctgatggggctgtgactcttgggttatcacccacttcatcatcgacgcctcactcgtccagctcggggatgggaaccatggttaacactccaggctctggatttgggtctggaggatcagggggttcaggttctggtgcaccatcagagaaacgtggcagggggcggccacctggctctggaaagatgcaacagctggcttcgcttggaaagtggtttcttggctctgttggaacaggttttactccgcatgtgattattattcaaccaggagaggacgttgctgcgagaataatggccttctcacagcaaggcccaagggcagtgtgcatcatttcagcaactggagctatttctacagcaacccttcaccaggattcagactctggtggtgtggttacatatgagggccgatttgagatcctgtgcctttctgggtcatacttggtggtagaggatggtggcacacggtcccgaagcggaggtctttgcatagctttgtgtggtcctgaccacagggttattggtgggagtgtaggcggagtcctgacagcagctggaacagttcaggtgatagtggggagcttcatgtacggaggttcgaagaagaacaaggtgaaagcggaggtggacatggagcccgaggaggtggcactcgcggagcacagcggcatggtccctcctgcgatgagtggcggcgggtgggaagcgggcatgatgaggcagatggactcgagaactcctgccattgatatcaactcgatccgtgggtagtagggtagcagttgttgcctggttgggtggataaaggctctgtgacaaagtcgaatcctctcctcctgggacacacacagcacgcatgtactaactaactaactaacagctctgttgctgtggtttaggatactcagaactccgagtatatcgtatgtgatattgttgttgtatgaaataattaacggttggttggtcgtgttattatgttaaatatatatatgaaatgctgctgttgggtctccaaaaaaaaaaaaaaa

SEQ ID NO: 9543 - protein, 388 aa, Zea mays
  misc_feature: Ceres CLONE 386154
  misc_feature (212)..(332): Pfam Name: DUF296 Pfam Description: Domain of unknown function (DUF296)
  misc_feature: The sequence is a functional homolog of SEQ ID NO 1507 in the 11/479,226 US patent application
MDGRESTVASGPNFSSFFAQHRGIGAPGVPGHSQGLHAPPPGGYRQHLDAVSAGYAFQTPHVGGPSIGQGYEASPHAAQHSAGGGSGSGGCGGMDIGMGAAVSADVKGDQGSGPGQDEQVKKKRGRPRKYKPDGAVTLGLSPTSSSTPHSSSSGMGTMVNTPGSGFGSGGSGGSGSGAPSEKRGRGRPPGSGKMQQLASLGKWFLGSVGTGFTPHVIIIQPGEDVAARIMAFSQQGPRAVCIISATGAISTATLHQDSDSGGVVTYEGRFEILCLSGSYLVVEDGGTRSRSGGLCIALCGPDHRVIGGSVGGVLTAAGTVQVIVGSFMYGGSKKNKVKAEVDMEPEEVALAEHSGMVPPAMSGGGWEAGMMRQMDSRTPAIDINSIRG

SEQ ID NO: 9544 - DNA, 1723 bp, Zea mays
  misc_feature: Ceres CLONE 386647
  misc_feature: Encodes the peptide sequence at SEQ ID NO. 9545
atttttgcctatttggtacccagacccacgcggcggcacccgccaccgatcgagccgctccggcgagcgcagcgcagcccacggcatttgccgatttgtgaaggagcgtgaaaaagcccttcccacgctgggccccgcctccgcgacgcgagcccacacgtccgtttccggtgccttggccagacaggcagcccatgtgctgagctcacatgcctgccgctcccacacctcgccaccctcctgcctcctccgcatccgcgccccctcgcttagcctaaaccgcggggcagctagtctcgccaccgcaggccgcaccggtcatcacaccggagcgcacgcggggagcccccgtagagttccggggcgaccaggccaactaacgccatgaaggaggaaggcggcggcggggacgcggggttcgtgcgggcggaccagatcgacctcaagagcctggacgagcagctggagcgccatctcacccgcgcctggaccatggagaagcgcaaggaggaggcctccgccggcgctggcgccggcgccaggcagcaccagcagtcccggcgcccgcggagggaggactgggagatcgaccccgccaagcttgtcgtcaagggcgtcatcgcccgcggcacctttggcaccgtccaccgcggcatctacgacgctcacgacgtcgcagtgaaactacttgattggggagaggatgggcatagatcagaacaagacattgcagcactaagagcagctttttcacaagaggtctctgtttggcataagcttgaccatccaaatgtaaccaagtttattggagctataatgggtgcaagggatctgaatattcaaacggaaaacggccacattggcatgccaactaatatctgctgtgtcgttgtggagtaccttcctggtggtgcactaaaatcatttctgataaagaacaggagaaagaagctagcttttaaggtcgttgttcaaatcgctcttgacctcgccaggggattaagctatctccattccaagaagattgtgcaccgtgatgtgaagactgaaaatatgcttcttgacaaaacgagaaccgtgaagatcgctgattttggtgttgctcgccttgaagcttcaaatcccagtgacatgacgggcgaaactggaacgcttggttacatggcacctgaggttctcaatggaaatccctacaacaggaaatgcgatgtttacagcttcgggatctgtttgtgggagatatactgctgtgatatgccatatcctgacttgagcttttctgaggtcacgtctgcggttgtccgtcagaacctgaggccggagataccacgctgctgcccgagctctctatcgaacgtgatgaagcgctgctgggacgccaaccccgacaagcgacctgagatggccgaggcggtgtccatgctggaggcgatcgacacgtcgaagggtggaggcatgatccctgtggaccagcggccaggatgccttgcgtgcttccggcagtacagaggtccatgacagataggtggaaacctgttggagctgcggcctctagatctcgtggatgccgatcgatcgcgtgttgttttctggggaagcaaactggttaatggagctagcccgccttaccggctcgtgtaaatcctctgtccatcaattctgtaactctgttttatcgattaatgaaaagaaccgggcttgctcgaaaaaaaaaaaaaaaaaa

SEQ ID NO: 9545 - protein, 377 aa, Zea mays
  misc_feature: Ceres CLONE 386647
  misc_feature (73)..(347): Pfam Name: Pkinase_Tyr Pfam Description: Protein tyrosine kinase
  misc_feature: SWISSPROT Homolog: EC 2.7.11.1 Non-specific serine/threonine protein kinase
MKEEGGGGDAGFVRADQIDLKSLDEQLERHLTRAWTMEKRKEEASAGAGAGARQHQQSRRPRREDWEIDPAKLVVKGVIARGTFGTVHRGIYDAHDVAVKLLDWGEDGHRSEQDIAALRAAFSQEVSVWHKLDHPNVTKFIGAIMGARDLNIQTENGHIGMPTNICCVVVEYLPGGALKSFLIKNRRKKLAFKVVVQIALDLARGLSYLHSKKIVHRDVKTENMLLDKTRTVKIADFGVARLEASNPSDMTGETGTLGYMAPEVLNGNPYNRKCDVYSFGICLWEIYCCDMPYPDLSFSEVTSAVVRQNLRPEIPRCCPSSLSNVMKRCWDANPDKRPEMAEAVSMLEAIDTSKGGGMIPVDQRPGCLACFRQYRGP

SEQ ID NO: 9546 - DNA, 637 bp, Zea mays
  misc_feature: Ceres CLONE 386801-R
  misc_feature (1)..(1): n is a, c, t, g, unknown, or other
  misc_feature (637)..(637): n is a, c, t, g, unknown, or other
ncgattgggtaccgggccccccctcgaggtcgacttcatcaaattgtttttttttttttttctttttctttagccacaaaacgtggttaagtgttagctcaatagaatcaagtgggtaaggaccaagctcttgtgaaacacaatggtcacgaagaaaacaagcacaagaaacacggtgatttatcccgtggttcgaccaagtataacacttgcctactccacgttgtggcgtcccactggacgagggtcgcactcaacccctttcaagtgatccaatgatcaacttgaataccacggtgttttcctttcttttactatctcccgttcgcgaggaatctccataacttggagcctctcgcccttacaattgatgatcacaaagaagcacggaagtaagggaggggagagcaacacacacgactcaaagcacgagcacaatcatgcacacaagccacaacttgagctcacaacacaatgcgaggagttctctactcaaatagaactcaagtcactatcacaaagaatcaaatacacgtgaatggagtcttggtgcttagagatgatcaaagaatgcttagattccccctccatgcgcctaggggtccctttaatagccccaaggcaactaggagccgtn

SEQ ID NO: 9547 - DNA, 1309 bp, Zea mays
  misc_feature: Ceres CLONE 386820
  misc_feature: Encodes the peptide sequence at SEQ ID NO. 9548
agaaatttccccacacgcgcccacctcctccggtcctcccctctagtcctctctcccgaccccacctctgccgtccgtgcgtccgtccggcaaccgcgacgcaacaatggcggccgggcgagagctggtggtgagtttcggcgagatgctgatagacttcgtgccgaccgtggcgggggtctcgctggccgaggcgccggccttcctcaaggcggccgggggcgcgcccgccaacgtcgccatcgcggtctcgcgcctcggtggcggggccgccttcgttggcaagctcggcgacgacgagttcggccgcatgctcgccgccatcctccgcgacaacggcgtcgacggcggcggcgtcgtcttcgacgcgggcgcgcgcaccgcgcttgccttcgtcaccctgcgcgccgacggcgagcgcgagttcatgttctaccgcaaccccagcgccgacatgctcctcactgccgacgagctcaacgtcgggctcatccggagggctgcggtctttcactacggatcaataagcttgattgctgagccttgccggacagcacatctccgtgccatggaaattgccaaagaggctggtgcactgctctcttacgacccaaacctgagggaggcactttggccatcccgtgaggaggcccgcacccagatcttgagcatctgggaccaggcagatatcgtcaaggtcagcgaagtcgagcttgagttcttgacaggcatcaactcagtggaggacgatgttgtcatgaagctgtggcgacctaccatgaagctgctcctggtgactcttggagatcaaggatgcaagtactataccagggatttccatggagctgtcccttccttcaaagtacaacaagtcgatacgactggcgcaggcgatgcgtttgttggtgcgctgctccgaaggatcgttaaagatccatcctcgctacaagacgagaagaagcttgtagagtctattaaattcgctaatgcgtgtggagcaatcaccgccacgaagaagggtgcgatcccgtctttgcccactgaaactgaggtcttgcagctaatagagaaggcatagatagatcactgtaattgctttggttttcactagcttccacttctgcaaattgcaaaatgtattgtattctgatctggaacagaagaagtgggtgctccatcttacctgccattttttgcttgccctagttcctaagggtgttttgttttagaactctacttgcaataagtagagcccttttatatttatgtatatcagcatgcgctcattgacaaaaaaaaaaaaaaaaaa

SEQ ID NO: 9548 - protein, 323 aa, Zea mays
  misc_feature: Ceres CLONE 386820
  misc_feature (5)..(313): Pfam Name: PfkB Pfam Description: pfkB family carbohydrate kinase
  misc_feature: SWISSPROT Homolog: EC 2.7.1.4 Fructokinase
MAAGRELVVSFGEMLIDFVPTVAGVSLAEAPAFLKAAGGAPANVAIAVSRLGGGAAFVGKLGDDEFGRMLAAILRDNGVDGGGVVFDAGARTALAFVTLRADGEREFMFYRNPSADMLLTADELNVGLIRRAAVFHYGSISLIAEPCRTAHLRAMEIAKEAGALLSYDPNLREALWPSREEARTQILSIWDQADIVKVSEVELEFLTGINSVEDDVVMKLWRPTMKLLLVTLGDQGCKYYTRDFHGAVPSFKVQQVDTTGAGDAFVGALLRRIVKDPSSLQDEKKLVESIKFANACGAITATKKGAIPSLPTETEVLQLIEKA

SEQ ID NO: 9549 - DNA, 572 bp, Zea mays
  misc_feature: Ceres CLONE 387616-R
  misc_feature (227)..(227): n is a, c, t, g, unknown, or other
tgagaaggatagtgcatccatgatcatggattcgaggtcgatactgttcagaagccagtcctatttcctacagaccgtcaaattttctatctcatattacagttttccacgacgacatactctttttattattattacttgcaaattcgctgcaaacgacaacacacacgagacaagacgcgtacagaacggacattcacgaacctggtactcttgcaccaactggnctttcctcggatgacaactccaggttcaccttggatcaccttgtactttgggcctccttcgaaaagaccagttggtgcaagagtaccaggttcatcaaagccctttatgataccaggaacctcctcaggctttaactcggggaagctctcggactgcgcccaagcgctgccggcttgaccgacgatggcggcggcgctgagatgttgtccttcgagctcgcacatcaggtgctcatcgacgtacgcctgccacgagatcttgctccgcgtctttctttcccggggacgactacccatcttgctgtgggctgccgtggttcggccgcggtgtctcggcggggccca

SEQ ID NO: 9550 - DNA, 721 bp, Zea mays
  misc_feature: Ceres CLONE 387699-R
  misc_feature (1)..(1): n is a, c, t, g, unknown, or other
ncgattgggtaccgggccccccctcgaggtcgacggtatcgataagcttttttttttttttttttgagcaaaagcgatatactaaacttgagcatgcctcgacaggacttctcctgaccgaccggggacaccaagaaggtacctgtggtcatctttagtaaactcgacacgacaattgcgtaattatacaatttagtaatccgctgcggtaggtactttgctcgtcccttcttgcacaaacgaaagagacagtgaggaaaaaaaatgacttgggtgacctggcacagtggcagtggcagcccgaaggcccgaacacctactccgacgatgatccatctacagcttggcctgaccgggggcgcggagcttggccatgttcctcttcttcttctcctccagggccgtcaccgcctcctgcttggcagcttcctcggcgccgccgggcgccgccgggaccgggttcactacaggtcccacgctgccgcggagcttcgggccggagccggacctatcctggtctccggcgctgacgaccaccccgccaggaaccttggcggccgcctcagtggccgccatggcgggcgtttccaccgcggcgggagtgctgacatccgcgcggccgcccaccttcctggacgtcgaccctggctgcgacaggccggccatctggtcggcgtcgatggagctgatccgtatcaccgacgtgctgccgctggtgttc

SEQ ID NO: 9551 - DNA, 690 bp, Zea mays
  misc_feature: Ceres CLONE 387786-R
tcaattgggtaccgggccccccctcgaggtcgacggtatcgatattttttttttttttttttgacttcaagagacaagaatgcagtttgtttgaacaaacaatgaagcagcagaaaagtgttttgctacatctcaaattatgcatttggaaagaccctttgaatctgtatgactatacatggtttttttacttcccggatatggtacccatcaaatgaatcaatcaaataggaactcaaaatttggaaattaatgaagtaaacggattctagctacatcaagtgttgctcgttaaaattttgtagtgttatgatgctactccacaaggaaagtgcagggcttcaagaaccaaaacatgctgctggagctcccttctgcatcacatgttcttgtattattcatatccttaaccccaaagggttgcctcacagcatattttttgctctccggatccttactaggggtccccttctccttcagtgggttcttgagtggcgatcctgctatggccgcccctccaagcttaacattcttaatgcggttcggcgatggggatggaaaccgctgcggagtcggcggtgttgccttcacctccttgagcacagagggagaccttggcttccctgcttccaccttcaaccccaccttctttcccttcattgggcttggactctttttcactctttcttg

SEQ ID NO: 9552 - DNA, 1168 bp, Zea mays
  misc_feature: Ceres CLONE 387932-R
  misc_feature (759)..(759): n is a, c, t, g, unknown, or other
acccccccccccctccctccccccccccccccccacccccccccctccgaatgggtacaggcccccccctcgaggtcgacggtctcgacatcttttcttttcttttttggaaaaacagtcagcttgctaaacttatccagaaggcacaccggcgcccaagtactggttgcaataccgagcagacattgaagtgccaaagaggggggtaaatcaccgcctcctccatagcccattaagccttacgctatgcaaaactgccaaaaagctaaactacaagaccaggggctcgggtctagaagcagttcaccagtggcgatcatcaaaacgacctcctcccctgctagggcgatcatatgggcccaggcctgtccctgtaacttcccccatcataacgtgcacgtcctccaccaccctaatgattcagcaacaccaccgccgcgcggccatcccctgacattaccccccacccttgtccgcctcttagggcccatcccctgcacatacgccttcccaccacccccttgacgccattccttaacccctaaaccaccgcccgctcacggaacctcaatatcttctctcgccacaactacattttctccactttccccttccctctaaacccaatctatgggcagcggtttcctggaatcccctagtcaccaacaccctcacaatcacacctgctcctacccggctaccaactcgcgagacatcacccctcacccacgctcggcccaacataaccctcaaatccantatgtgtggcaataaaacgcgaattcctgcagggcccacccacaaggcaaccatacattgcgtacccccctcacgccctaccaccacacttttctaatcatcagcctatacccctccttataatcttacccctcctgattttttcaacagtacccattaccaccatgactacacactctcccacccctaacaccccacaccatccacacccccgcaaaatacaccccctctattccccctggcgcaccctcccaacaccatatcattccgaacaccaggacatcacttcctatcaaacccatcaaacaccacaccatatattaacgtcccacctcctctaactccccacatgtcctccacaccccccaaaaccctccctctacaaaaatgcccacaccgtacaggaacc

SEQ ID NO: 9553 - DNA, 486 bp, Zea mays
  misc_feature: Ceres CLONE 388065-R
  misc_feature: Pfam Name: MBF1 Pfam Description: Multiprotein bridging factor 1
  misc_feature (463)..(463): n is a, c, t, g, unknown, or other
ccgatgtgaacatgaacatatataaatcatttatcacatcaacggtggacaagtgcccgaatttatctactgggatcctaggcacaaaaaaacgtcgatcagattgttcatgggaaaaatggcccgagacagatgattgctcacgggcgaggttctctgtgtcatcgtcgaggcgcttggtgttgagggatgtgccgctggacgccgccttgttcataccagcgctgtacttcttcatggtctcgatctccgcgccggagcggtgcgcggcgttgacggccttctcatccttcttggcagcggtggtgggtgccttcttccgcacaaccaccggctcccagtcctgtctgatcggaccgatcccggtcatccccctctccctccttcgctgtcgcttactctacggtgcctattccctacacggaagtctctcgcgggtctcccacttctctctctcccccangacggcaagcagggagtcagttt

SEQ ID NO: 9554 - DNA, 588 bp, Zea mays
  misc_feature: Ceres CLONE 388436-R
  misc_feature (70)..(70): n is a, c, t, g, unknown, or other
  misc_feature (588)..(588): n is a, c, t, g, unknown, or other
caattggggaccgggccccccctcgaggtcgagttcacgataagcttttttttttttttttttccactgnatgcaaactagctctccgagtcataccatacgtacatacgagacgtgtttttcgcagaggacgcacaggggaggggagggcaaccaccaccagctaccagctcagctgtgagtgagagatgcaggctgcatgacaccgatagatgagaagcaggggaggacggccaccagctgtgcgtcttcagcttcttgcgctcgactggcccccgacgtcgcccacaggtcccctgggctgcttcttcttgttgttgttctccggagcgaggttgttcggcgcagctctctttggcctcagtttctcctcgcactcccggcacaagtgcctcagcaggatgttcctggcctccgcggttatcacttgattgggtggcggatctgtcctgtgggtcgcaacataagtggctggtgtgacattcgagggctgcgcgaaggggtcggcagggaccaactggctgaagttgtgcgggttgtatgacggccacccgcccagagggctccccatctccgccacgtgacggn

SEQ ID NO: 9555 - DNA, 781 bp, Zea mays
  misc_feature: Ceres CLONE 388594-R
  misc_feature (781)..(781): n is a, c, t, g, unknown, or other
cgatagggtaccgggccccccctcgaggtcgacggtatcgataagcttttttttttttttttttgctataaacttaatgcacatttcactacacttaagtgtataaaagtctttttaaaaatacaaggaaggcgtaaatgcaccggcggcttgcctggaataacactagattagtgtttattagttgacgtccacttggcgaccagcctttgtcttggcattcgttcacattatccatcttcacgttggtccgactgacgacatagtcttgcggagatgtccaatctctgcattatcttggggtcgactttgggtcgtcttccgcatcacgtgataaattatcgaaccgattcaattaagattccaaagcaacgttgcctgatccttgttcctgcctccctgtcgagttcctggcaaagggcccccgggagttcccacttcttcactcaaaactttaaaattcgcgggggggaccaaagcgaaacccccaaaagccaaattccggaccaaaccccacacccccaagttttccccacccaacacaatgggaaaggaaaatggaaactttcaagggcccagggcgaaaaaaaaaaaatgggaaaaacccccccttaaggttttttgtgcgaaatttttggggaaacccccaaaaaccctggaaaacccccaaggccccccctttgaataaacacccttaaccccggaaaacccccccaaaaaacccgggggtgttcccggaaaatttcccccccaggggccaaacccttggggcctcattttn

SEQ ID NO: 9556 - DNA, 660 bp, Zea mays
  misc_feature: Ceres CLONE 389224-R
ccaattggttaccgggccccccctcgaggtcgacggtatcgataagctttttttttttttttgttgatttctttaaatacacagcccataaaaattgataatcttgcaagttttacatgcctacatagtcctgcaattcttggctatatgtaagtatagagtgtttcatgcacagataaaacagcattactaacaaacagggacaataatcatggattgtagagtattactacaaaagtacaaaacagcgacaatatgcatggagtgcagtgcctggaaaggtacgattagacattgtgcacggaggtccacacatgggctaaaaaaaagtcctgcatcataggatcagttccgtgaacggatccaggttgatgaaaaggacgttcagttagagggaaatcttgatccacgccagcgatcagtatcttgccgtgatgagggtgcatccagtcgtgcaggaggaccatcttgcctgagcggaccacgtgaaccccagcgatcttcatcgcggctgccataaaggatgctgctgctatcaccaccgcgtttaaacttgggaatatatttactaggagcatgagcaggatcagccgccgccgcaacagctgcaagcgctgctgctgactctcgaggtggctgtgcaacaggtgcagaatctgg

SEQ ID NO: 9557 - DNA, 739 bp, Zea mays
  misc_feature: Ceres CLONE 390181-R
  misc_feature (576)..(576): n is a, c, t, g, unknown, or other
  misc_feature (577)..(577): n is a, c, t, g, unknown, or other
  misc_feature (608)..(608): n is a, c, t, g, unknown, or other
cgattgggtaccgggccccccctcgaggtcgacggtatcgataagcttttttttttttttttttgccccaacttgtatatactaggaataaataagccattacacaccctgcgccgttacggaggcaaacaagctcattggcagtgagataccggccaatctggaaacttgcagcgaactggaacttgtgaggtatcccatccgatatatttttcatctgtcgtaacaactaccactatacagagaccattgctctagggttgctttatcgtaagctcggctctcagatgcagcatcccatccacgaagaagaggttgtcatcggccaagaacttctgccatgggattgcaaagagattcctgtacccaaccgcctttccaccggtgaatgtgtagttacccttgtacttgctcacaaactcgccggatggtctcgtccttgcagcgaactcgtagtccactgtcacactcgtggagcccttctcttgcatccccaggaagagcccgaagcagtagaacgcgctttgctgctccatgtttacagtgagctgagaggaagaaaccctgcccctgcanngtgaaggcttgcgagtatatccgccctgcangaaagagtcaagagcactcgtcccgcttgagatcaaagtatgctatgcactggggggtagggccgatcaactccacaactttaaagggcctgacttctgaaaaccccctcgggatttccggcaggtatttg

SEQ ID NO: 9558 - DNA, 659 bp, Zea mays
  misc_feature: Ceres CLONE 390606-R
  misc_feature: Encodes the peptide sequence at SEQ ID NO. 9559
caattggtgtccgggccccccctcgaggtcgacggcatcgataagcttttttttttttttttttgtgcatacactagcattatccttatgtcatggatacctggacatgggattcaaatataagtagtactggtagtgctttggacacggcagcgtttaggttcaagggatgccgatgatcgggatgaacgggaagaagaagaagaaaggaggcagtcctccaaaactgaagggcggcctgttgcctccacgggacggtggagtccaccccggggtccatgccgccggtggcgtcgggcttagcgctaggtccatcggggcgttaccacccctggtgttcacggtcaggcatggtcgcaaccacagcggagccgccgatagccacaccgcacctcgtgaagaacgccaggcgggagcccagaacatacgaggcggggtaggaggcggagccaagcgcccgggacgggaccacgcgcgcgaccgtgagtccccacggcgcgcagagctgctccatggccccgaggaccctggccgcccacagggcgcccaacgctgacgctgctgctggcacggacacctcgaatttgccgcgaccctaggtctgcccctcgtggaggcccgcgccgccgtcgtcgtcgacggcacaattcgccgccacg

SEQ ID NO: 9559 - protein, 128 aa, Zea mays
  misc_feature: Ceres CLONE 390606-R
MPMIGMNGKKKKKGGSPPKLKGGLLPPRDGGVHPGVHAAGGVGLSARSIGALPPLVFTVRHGRNHSGAADSHTAPREERQAGAQNIRGGVGGGAKRPGRDHARDRESPRRAELLHGPEDPGRPQGAQR

SEQ ID NO: 9560 - DNA, 760 bp, Zea mays
  misc_feature: Ceres CLONE 390798-R
  misc_feature: Pfam Name: MAP65_ASE1 Pfam Description: Microtubule associated protein (MAP65/ASE1 family)
ttgggtaccgggccccccctcgaggtcgacggtatcgatattttttttttttttttttatttttttttttttttttttttttttttttttttttttttttttttttttttttttttttttggccccccaaacccaacacataagttatgatatggtacaggtgactggccaaatccagatcgctcccctaaatttttccgcctaattggcaatctacaaagccctcaacttgaaaaaatttaactccccacccaacccaaaccaaggcaacccggccaaaaattaaaactcccatatgggctaaaaatatgacatccggaatggacatggtaggggaaaaaattggtaacatgggggccatttacaaaaagcaataatggccatcccggcatccagcaggaagggggtcatccaaaaaagggggattctgggtcaaaacccctggtggatggaaacggtgaccgggaatcctcaccgaagttcaaatgggaagtcgatagacgcctcacatcgcccaagtatctattatggccagaagacgatctgggcgtcaaaaggtcaggagtaacactgccgagagacaatcggggaggaggtggagccttgaggcccgttggtggtcccatttggccgggaaccctttggcttcctaattaagctggtcggcttccttggggttgggctaaaaccgaaaatcggttctttctctggaaagaagatggtctccaggttcttttgggccccggaaccgtcgaatttc

SEQ ID NO: 9561 - DNA, 735 bp, Zea mays
  misc_feature: Ceres CLONE 390972-R
  misc_feature (735)..(735): n is a, c, t, g, unknown, or other
caattgggtaccgggccccccctcgaggtcgacggtatcgataagcttttttttttttttttttgaaaacaaatgacctcattcacatatattattatatgaatttaagatatttgaatacaacgtttaagtacatttatacatttgccttgacaaacaataattcccgagtgatgcgttagcaattacaggaatgtgtgaacagtaaaggaatactgttcactatttataggcacaggacacagctcatgaggaattacaattatgcccctcataaaagtttacaacaatgaatcagacctttgaaggctaaaaggtcattttatctttaagtcggttcgacccttcgtcttcggatatgctgtacttccgaagcttcgtgaacggtgtcttcggcatcatgttcaagcagcttcagctgaagctgtttctttttgtaggaccttcgacgacgaaccatggtcccaacagttcccattaacataatgatcttatcatgaacataaataacataacaaaataataggaacatggatataatgaaatattaacccaaaaccatataaagcaataacatagctccccaaatgatttagggataaacaaggtaaaaaggataaccagtctagggtgacctattaggtcccatcaaaattaaacctatgcattgataagtgataataaaagaacattgggtaaaatgaaagtgatcaagggccacaacttacctggcan

SEQ ID NO: 9562 - DNA, 634 bp, Zea mays
  misc_feature: Ceres CLONE 391116-R
  misc_feature: SWISSPROT Homolog: EC 3.4.16.6 Carboxypeptidase D
tcgaggtcgacggtatcgataagctttttttttttttttcttcaagaacacagatccatttcctttttaccccccaaatacagatcattttccgctcacatgcgaaaccacacctttaacaaaaaaagacacatggcacgatgttttagattacaacgctgtcagggatctggagacccaaactattcggcaatttctgtcccctggcttaggggataattggtactgccaaatgcaccaaccagggcgacaaaagcacggctgctgcggcaaccggacccggtagctctgatacataaacaactaccgcaagttgcagaacaagcccggttggacaactggatgacttgggtgcttggggatgttcattcatgtaccgaatcagttgcaacaacccagattacaagtcgctgcgtgagctggattgtacacgcatggaactccctgtcaacaactattcattaacgtgagggcctgtttggctcgatgaatagggacttcgtgagatgctcccctcacagagacaaaattgagtcccctcgtaccttggtggccaccaccgagcaccccgggatccacccaccaaaaaatggcctgcgacttttgttcgaaaacttgaagagaatccaatgcc

SEQ ID NO: 9563 - DNA, 694 bp, Zea mays
  misc_feature: Ceres CLONE 391198-R
  misc_feature (1)..(1): n is a, c, t, g, unknown, or other
ncaaattgggaccgggccccccctcgaggtcgacggtatcgatattttttttttttttttttggttttttttttttttcttttttttcacgtacaccgcgattacataaatgactcatcatagcacaatgcttcgaataacaataaagggtaagtaataatatgaaagactagagtcatttacattgtaaaatcaaagtacacagaatagaaacgtagccaacgtaaataaacccaccacaggcagctgactgggggtggtcgctagcctaatcctcaaactcgtcgaagtcccggaactcctggagatccgcctcgacgccttcttctttacctgagcatagattgcaccaaaggcaaccttcaccaaacaggtgctcagggtcttcaaccttgtagaactcgaagagccagatcacttggtcgcaacgcttgatctttgatccctcaaagctcggaaacagatcatagtctcgcaacgacggtagacagccagatgagctagtggcgagccacgatgacgtgctgcgcgcacgacgcgaagcgacggcgaggctgccgctacgccgcgcagactgtgacggggcacgaaatggtgagcacacagcaaggaatagcaaggacaaggcgtgggataacaaggtgcgcgatttgcagggggcatgacgagggaccctggttgtggaggatgggtc

SEQ ID NO: 9564 - DNA, 662 bp, Zea mays
  misc_feature: Ceres CLONE 391250-R
  misc_feature (238)..(238): n is a, c, t, g, unknown, or other
  misc_feature (662)..(662): n is a, c, t, g, unknown, or other
cgagaggtttttgagaaggatagtgcatccatgatcatggattcgaggtcgatactgttcagaagccagtcctatttcctacagaccgtcaaattttctatctcatattacagttttccacgacgacatactctttttattattattacttgcaaattcgctgcaaacgacaacacacacgagacaagacgcgtacagaacggacattcacgaacctggtactcttgcaccagctggncggccccccgacgacaaatacaggcgccccttggcgcaccccgccatttctgggcctctcaccgcacaagacgggggggggggcaagagcggcgcgacacggccgcgggcccgtgttaggaagcgcgggggcgtgcggctgggcgcgggcgggggcgggggcgggccgcgcggggagtgcccccccccgaggccggccgcgagcggcggcgccgcgagccgcaagccgaccgcccggcggcggacgccggccggcctcggcagcccgtggctcggggcgcacggtgcacgttgtcgccgcagcgatgccgcgccgggggcgggccgagagcacgattgtaggtgcggtgccaggcggcccgcggagggcgcagcatcgtgaccccggggccggccggcctgcggcggcgcgcccacgccgcggn

SEQ ID NO: 9565 - DNA, 935 bp, Zea mays
  misc_feature: Ceres CLONE 391489
  misc_feature: Encodes the peptide sequence at SEQ ID NO. 9566
gtagtttcattccgccgccgccgctccccgctctctcctctgcttgcggactgcgtggagcacagcggcggccagcgggcaggaggagctccctccccaaacagagaggggtggggtatcagtgcgtgcgctcctggaggagggcgtggaagagcagagcaggcggcaagcaggggtttgggaggatggtttcgctctcgacttggttccgctatgccgcacacaagtttgattactgcatctccctctcgttgaagaaatataatgtgggccagatcagcagcacgcagctaactgatgtgatattcaaaaatttcttccatggcaagctcacctacgtgtgtcagaccaaaggggaagaagccatggctcccatcgtatctccaactggaggagccgtccttgtcagaaagctcgcaaatttgagccccacggaagtgtttgtcggggacgttgtcttgttaaaagacccagagaaatctggcaattttgttattcgacgactggctgccctggaaggctatgagatggtctctaatgatgagaaggatgagccgtttgtgctcgagaaagaccaatgctgggtcctggcagacaacctagtccttaagccaaaggaagctagagatagccgcttgtttggacctgtcccaatgactgacatccttggcagagtgatatactctttaagaaccgctgttgatcacggtctagtcgagaacagcggcatggccacgaaactggatggtccagtactggcagtggagcttgatgtggaagagttggcgaagaacaataaggcgtagacacttgatgttttcgacatgctgcgctataactcaccttaacaatggatgttttttttttgtttatgatctgctgctgcttcaagtagaagtgcattggaatgttttttcaaaaaaaaaaaaaaaaaa

SEQ ID NO: 9566 - protein, 206 aa, Zea mays
  misc_feature: Ceres CLONE 391489
MVSLSTWFRYAAHKFDYCISLSLKKYNVGQISSTQLTDVIFKNFFHGKLTYVCQTKGEEAMAPIVSPTGGAVLVRKLANLSPTEVFVGDVVLLKDPEKSGNFVIRRLAALEGYEMVSNDEKDEPFVLEKDQCWVLADNLVLKPKEARDSRLFGPVPMTDILGRVIYSLRTAVDHGLVENSGMATKLDGPVLAVELDVEELAKNNKA

SEQ ID NO: 9567 - DNA, 1712 bp, Zea mays
  misc_feature: Ceres CLONE 391703
  misc_feature: Encodes the peptide sequence at SEQ ID NO. 9568
aaaaaaagcagagcaacccccaaattaaaaacagggcaggggaaaaaaaaagctcgcagaagtgagctccctcctcccccctctctctctatccgtctctccgctcggagctcgcaccaccgccgaaccctcctccgatccaaaccctcctcgcatcgtgccgcatgcctccacgcgccacgaggcggcggcgctgcagctgaccaccccacttgaccagccggggggcagaaagagagagagagacaaccggacgcggacggcaggcatgggcggcgtcacgtccaccatcgccgcgcgcttcgccttcttcccgccgacgccgccgtcctacaccgtcgtcgtcgccgacgccgccaccggtcgcctcgccatcccggagatctcccgggcaccctcgcgccgtcggaggcgggacggcgccggcgccgggggctcctcctcggcctcttccgtcgtcgcggccgccgaggaggaggacggcgcggaggtggtgcgcctccggacccgccgcgggaacgagatcgtgggggtctacgtgcgccacgcgcgggcctccgccaccgtgctctactcccacggcaacgccgccgacctcggccagatgtacgggctcttcgtcgagctcagccgccgcctccgcgtcaacctctttgggtatgattattctggttatgcgagatctacagggaagcccactgagtgtaatacatatgcagacattgaagcagcatataactgcctcaaggaaaaatatggtgtagcagatgaggatataatcttatatggtcagtctgttggaagtggtccaaccattgatcttgcttcgcggttgccagacttgcgagctgtggttttgcatagtcctattttatctggactaagagtaatatatccagtcaagcggacgttttggtttgacatttacaagaacatcgataaaattggcttggtaaattgtccggtgcttgtcattcatgctacatcagatgacgtggttgactgctcccacggaaaacagctatgggagcactgcaaagtaaaatattctccactgtggttaagtggtggtggccactgcaatctcgagctatatccagattacattaagcacttgaaaaagtttgtgtcaagcgttagcaaaaaagcatcatcgaaacctgacccaaaagaaacaacgacaaaggatgacactaccagtaaagaaacagaggaagcgtacccggagaaacctcaagaggccaagaagtgcccgcagatctcgcgaaagagcctggacagccgattcgggaaatccaaaacagtggatgttcctgataaaccacggatgagctcggacgacatcgacaagttccggaggagcagatgcttggtctggtgatgcctgtgttctgcacagattgtcgaacagtacctgagcgaggatactatagcatggaagtcaagcaactgtattacatcatgctgcgaggaacggcatcagcggttcctgcagcggagaggaaaggactgttaaataagaaaaaaaagaatcaggaagctaccgtcagcatccatcaaagacacagctacttgactgaaaactggtagttcctcagttaatttagcacttacaccgacaacatgttttgcagcatcggttagggtttccatattgtaaaagtgtaccgttattgtctgtaatcacgagggaccgaaaaaaaaaaaaaaaa

SEQ ID NO: 9568 - protein, 370 aa, Zea mays
  misc_feature: Ceres CLONE 391703
MGGVTSTIAARFAFFPPTPPSYTVVVADAATGRLAIPEISRAPSRRRRRDGAGAGGSSSASSVVAAAEEEDGAEVVRLRTRRGNEIVGVYVRHARASATVLYSHGNAADLGQMYGLFVELSRRLRVNLFGYDYSGYARSTGKPTECNTYADIEAAYNCLKEKYGVADEDIILYGQSVGSGPTIDLASRLPDLRAVVLHSPILSGLRVIYPVKRTFWFDIYKNIDKIGLVNCPVLVIHATSDDVVDCSHGKQLWEHCKVKYSPLWLSGGGHCNLELYPDYIKHLKKFVSSVSKKASSKPDPKETTTKDDTTSKETEEAYPEKPQEAKKCPQISRKSLDSRFGKSKTVDVPDKPRMSSDDIDKFRRSRCLVW

SEQ ID NO: 9569 - DNA, 1321 bp, Zea mays
  misc_feature: Ceres CLONE 391771
  misc_feature: Encodes the peptide sequence at SEQ ID NO. 9570
tttttcgaccgtgggcacctacagcaacggcagtcggcagcatcgtctgttgccggagcgcagctttgctctccgcgccgtatgcgtccaccccaccgttcccctgtcgctgttaccgaaccggagcgccccctccaccgccgccgccgctttaaccccaaccaccgcgctggcccagccgatcgccgtcggggttcatagttagttagtctgttggttggttggttggtttggttggtttggttgccggccgggtttctgatctacggtgacgacgatgatgatcagatcagcggaggaccgtgcggcggggaagttctcggcggcgagggccgagaagcagcgtgcggtgtccccgcacaaggtgggcccgggctccgtgatgggcatgggcgtctcggtcccggacccgaggcagcagcagcagcagcatgccggcgccgcggcggcgacgtcgaagccggcgtcgaaggtggagatgccgcggatctacaccacgctgtctcggaaggagaaggaggaggacttcatggccatgaagggcaccaagctgccgcagcgccccaagcggcggcccaagatcgtcgagaagaccgtcagtgcgatctgccccgggatgtggctgacggatgtgaccaggggccgatacgaggtgcgcgagaagaagtgccccaagaagcaacagaagaatcggggcctcaaggggatggagggcatggacagcgactccgactgaccaccgacggcagcctgagttgcctgcccgaggcgcggtggcggcggaagaggaagaagggttggcgacagtgacgggagacgaggagcccgagtgaacagccacgcgcggcgcgctcttgtacatcactgggttcaaggaagccaaaaaaacgaaggtggattcaggggggaaacatgaaagaaaagaacttccgaatgaatcgtagccggcgtcttccttcctttttttttttttgttggttcgacattgggtggtttgtgcatagcgtcggacaaccagtagactatctccgcaagaggaaacaaggcctttagaccacctctctctctccctctctcgctcgctctatgtggttaattagagcatgtttggaaatactaggactagttgttagtcatggctaaaaactagctaacgatatctcttgcatgtttagattcttagctaaaaaatagcttctggacaaaaaatactctttcttctaccttttctctcacccagagaatagaggattcagatgatttctgtatatttataacatttttagcctttgttagctgctttacaacaaaaaaaaaaaaa

SEQ ID NO: 9570 - protein, 152 aa, Zea mays
  misc_feature: Ceres CLONE 391771
  misc_feature (75)..(124): Pfam Name: DUF1639 Pfam Description: Protein of unknown function (DUF1639)
MMIRSAEDRAAGKFSAARAEKQRAVSPHKVGPGSVMGMGVSVPDPRQQQQQHAGAAAATSKPASKVEMPRIYTTLSRKEKEEDFMAMKGTKLPQRPKRRPKIVEKTVSAICPGMWLTDVTRGRYEVREKKCPKKQQKNRGLKGMEGMDSDSD

SEQ ID NO: 9571 - DNA, 687 bp, Zea mays
  misc_feature: Ceres CLONE 392400-R
  misc_feature: Pfam Name: SNase Pfam Description: Staphylococcal nuclease homologue
caattggtgaccgggccccccctcgaggtcgacggtatcgataagcttttttttttttttttttgcagcgcatagacgacctttattgtgttcagagaaaaaacaatgtacctttaaccttataagcttacgatgtaaaaaacggaatatccaaagtgctcaaaccgagaaagtttcgcctcactaagttctgttttctaaccgaataaataaggtaccctccaagttgaatctataactcccagcagagtctcacatttggggagctctaccgacgacctccaagcttccttgcagctgggggctgctcgtcctcatccaattcaacatcgccatactggcaaatccgcagactttccttctttgccttctccgggaactgttccaggatcaggagagccgtcttcctctccccacccccccatctattggttctttcaagaacgagcaaggccttcctcaagcatggcagcatttatgctactttctgtctccgcgtcaacaacagtaacaatgagaacatttccggttccttgtacctttgattttccccaagaagcatcacgttcttcaatgcattgcccgatattgcttgagaccacttgagcaaaacatccctctaaaggaccccgcccgcttcccttaaccaaaaactaattctgaaaaagaaaggggtcacctctttaa

SEQ ID NO: 9572 - DNA, 1335 bp, Zea mays
  misc_feature: Ceres CLONE 392543
  misc_feature: Encodes the peptide sequence at SEQ ID NO. 9573
aaaccttttttcccctctgcacgctactctctcctttctcactaccccgcccgtcaaagcgagagcgccgtatcaccggtctatccatcccttcaccgctgcctcgacccgcgccgaaagatacctttcccccccttcctctcgcgccgccgttttggtgcgaccatggcggcggagggggaggccaagaacccgtccggcggtggcgaagggggtaacccccagcaccagcaggcagtgcaggctgcgccggcggagccgccaacggcacagggggaagcggtgcaggaggctggagcgcaggcgacgggacaagagccggagggggagaaggcgaatcgagatggggagggaagcgcgggggagaaggacgacggcgcgtgcagagatctggttctggttgaggatccggaggtgctcgccgtcgaggacccggaggaagctgcagcaaccgcagcactccaggaagaaatgaaagcgctcgtggcatccgtccctgacggtgctggggcagcattcacagccatgcagcttcaggagctagagcagcactcccgggtttatcagtacatggctgcccgagtacctgtgcctactcacctcgtcttccccgtatggaagagtgtaaccggtgcatcctctgaaggcgcccagaagtaccctactttgttgggcttagcaacactctgcttggacttcgggaagaaccctgaaccagaaccagggaggtgccggcgaacggatggcaaaaaatggcgatgttggagaaacactattccaaacgagaagtactgcgaacgccacatgcatcgcggtcgcaagcgtcctgtacaggtcgtcgaggaagccgagcctgactctgcttcaggctcaaaatctgctcccggcaaggccaccgaaggcgccaagaaggttgacgacaagagcccaggtagcaagaagcttgccgtggcggcggcagctgcagctgctgtgcagtctacgtaattgatgcagcattttagtagtcgcaggaagagcatggcggcgctggcaactagcgccttcttttcattgcatgtgatctttagctataacctcatttagcacactcccagtggtgtccgtgggaggaggaagccgcaagcacttcccccgtagggtgtcgactgaaaaaattcacttgtagctgtatagtttgatctctagctttgtcgtgcctccggccttcaggtaggcgatgcggcatgatgttataaatcctctcccagaactgacaatatcgcattgtaacccaagaagccggtgcaagaacctgtgaaactgcattgatgtgccaaaaaaaaaaaaaaaaaa

SEQ ID NO: 9573 - protein, 273 aa, Zea mays
  misc_feature: Ceres CLONE 392543
  misc_feature (183)..(228): Pfam Name: WRC Pfam Description: WRC
  misc_feature (116)..(152): Pfam Name: QLQ Pfam Description: QLQ
MAAEGEAKNPSGGGEGGNPQHQQAVQAAPAEPPTAQGEAVQEAGAQATGQEPEGEKANRDGEGSAGEKDDGACRDLVLVEDPEVLAVEDPEEAAATAALQEEMKALVASVPDGAGAAFTAMQLQELEQHSRVYQYMAARVPVPTHLVFPVWKSVTGASSEGAQKYPTLLGLATLCLDFGKNPEPEPGRCRRTDGKKWRCWRNTIPNEKYCERHMHRGRKRPVQVVEEAEPDSASGSKSAPGKATEGAKKVDDKSPGSKKLAVAAAAAAAVQST

SEQ ID NO: 9574 - DNA, 705 bp, Zea mays
  misc_feature: Ceres CLONE 392927-R
  misc_feature (11)..(11): n is a, c, t, g, unknown, or other
  misc_feature (12)..(12): n is a, c, t, g, unknown, or other
  misc_feature (33)..(33): n is a, c, t, g, unknown, or other
  misc_feature (35)..(35): n is a, c, t, g, unknown, or other
  misc_feature (36)..(36): n is a, c, t, g, unknown, or other
ttaataaattnnaaagatgatagaaccaaaaananncccgcactacgcattaaaaatcaaatgggtaccgggccccccctcgaggtcgactttcccgatatgtgtattttttggtttggattttgtggcacatggacctgattttccaatcaaagaatgaatagttgtagcttacagataagcaccctccaccaatgccatccgaaatttggcttttaacatatcatcagtctgcatcatccgtgtcagttggctcagatgtatttggaaagattaagaagctacatggttcctacacccgtacacggtagtgaggtggcggcctatgtgtctttctttgacttgggaggggcctgctgcttccattccctgacgagctccttccagaggttccaaatccacaggttgctgaccgcaatggcggtgccgacaaccaggatccaggagatccgcacccaccacggaatgacgtcgacggcctggccggacaggtagaaggcggccatcttgaggaggaagagcgggccggcgacgcccctgacgagcgtgtagagcgcgtaaaaaggcggcgagagggcgcccgaaaccccgggcggcggcggggggactgggccccgccagatccccggcaaacggtccaagacgtttctgccaacagggctgggtgacctccggccgtagggacgaaggaaggaaccagggacg

SEQ ID NO: 9575 - DNA, 742 bp, Zea mays
  misc_feature: Ceres CLONE 393093
  misc_feature: Encodes the peptide sequence at SEQ ID NO. 9576
ctaatccatcgcagagcgccgccggcgggtagcgctactgctagaggagaggaagcggaaagggcggcggcggcgcttgtggtcagtcaaagatccaacctccggactcgcgatggggcggcggatcctcaacgatgctctgcgcacgatggtcaacgcagaccggcgggggaacgcgtcggcgcttctccgacccatctccggcgtcatggtctccttcctcaacatcatgaagtaccgagggtatatcaaaaaatttgaggtcattgatgagattagagttgggaaaattagagtggagcttgatggacgtcttaaagattgcaaagctctcacctacaggcaagacctcaaagctaaggagatagaacgatacagagttaggatgctcccaacacgccagtggggctatgttgtgattactactccgaatggtgttttggatcatgaggaagcaatcaggcagaacgtgggtgggcaggtccttggttatttccattgactgacaagtaacgtcgctcttagtcctgaatgaggcaacgggttgtgcccatttggtattactgtactgttgttattaccgaacccattctgtttgcatcttgggagctgttttgttgtcgttcatggccatgcaagaaatgaaataacatgccaaatgtacggctgagggctgacaacactaggaatattgttaaacaggaacactgagtttcttgtgagcaaaaaaaaaaaaaaaaaa

SEQ ID NO: 9576 - protein, 129 aa, Zea mays
  misc_feature: Ceres CLONE 393093
  misc_feature (6)..(129): Pfam Name: Ribosomal_S8 Pfam Description: Ribosomal protein S8
MGRRILNDALRTMVNADRRGNASALLRPISGVMVSFLNIMKYRGYIKKFEVIDEIRVGKIRVELDGRLKDCKALTYRQDLKAKEIERYRVRMLPTRQWGYVVITTPNGVLDHEEAIRQNVGGQVLGYFH

SEQ ID NO: 9577 - DNA, 882 bp, Zea mays
  misc_feature: Ceres CLONE 393242-R
  misc_feature: SWISSPROT Homolog: EC 2.5.1.47 Cysteine synthase
cccccaatagggtgcgggccccccctcgaggtcgacggtatcgataagcttttttttttttttttttgcaagaaacacactgtactgcttttatttcacagtctgacgcgatatacagaaatacaacgagtgtcaaaacagtagtaaaacatcgcaagtctaaaaacgacgtgttctccagcgacaacagtgggctggactggacacaatcggtagggaaatgtacgtcgaaatcaacagaaggcacccgagctttatttttctgtgatggaaatgatgaacgtctcaggaaatagtttgccagaagcccagaactgtgtgctctagggatcgaccaccatgctctccgcttccttcttgatggactggaacagcaccgaagagaggtagcgctctccgaagctcgggaacaccacaacaaatagctttccggcagttttctggcctctttaaaagcctaactgccgcagcttccgctgcaccagaagagattccaaccaacaaccctttctttcagaagcaagaagccttggcaaatccacaaataggcttcatcaacttgaaaaacttaaaaaaggatgagaaaaaggaagatcaaacatccaaaagaactccaaggtataaaaaacaaggcttccaatttccctaaaaaccttggtggaggagccaaagtttttccacccattcaaaaaaaaggcaattcttccacatgagggtacaacccaataaaagctttgacaattagaaatatttaccccatcaaaagggggtcccccccagtatccggggtaatgggtaccccacctcggtgccccaaataaccagaaaatcaaagggccattaaatattcttatacagacggaaaaacataaacaaaaataa

SEQ ID NO: 9578 - DNA, 1475 bp, Zea mays
  misc_feature: Ceres CLONE 393466
  misc_feature: Encodes the peptide sequence at SEQ ID NO. 9579
cgtcctcaatcccagttcaagtcccgcccaatggaggacccaccagcgcttcctctgcctgagccggagtccgagcccgatcccgatcccgaggcctcccctgcgcctccgcaaaggctgctgcgattgcgctgcgcggtgcagcactacgagtggggccagcgcggagccgcctccctcgtcgcgcgcctygccgaccagaaccccgacccggcccgcccctatgccgagctctggatgggcactcacccgtctgccccctccacgctcctcgacgacggtacgctcctcagtgactggctcgcgcggaaccccgacgcgctcggccccgccgtcgctgcgcgctggggagtcgacctcccattcctcttcaaggtcctgtcggtggccaaggcgctctcgatccaggcgcacccggacaagaaactcgccgaggtgctgcacgcgctgcggccttccacctacaaggacgataatcacaagccggagatggccatcgccatcacggagttccgggcgctttgcggcttcgccggtattgaggagctcaaggatgtcctgaggacatttcctgaaattgaaggactagttgggcatgaagatactggcaagctgatgaacatgaaggaagatgatggggttagtgaagtaaaatccagtttgcaatcagcttttgctaagctaatgacagcaagtaaagacatggtttctgaagcagttgcaaaactgatcagtcgcctgaatactaagagcaagattaggaccttaacagacaaagaacagctggttttgtccctggagagacaatatcaagatgatgttggtgttatagcagcacttttctttaactatgtgaagctcagtcctggtgaagccctttacattggtgcaaatgaaccgcatgcatacctctctggggaatgcattgaatgtatggccacttcagacaatgttgtacgtgctggtttgacacctaaatacagagatgtgcaaactctctgctcaatgctaacatacaagcagggtttccctgaaattttgcgaggagttcctgtgcagccacacgtaaggcgctacacacctccatttaatgagtttgaggtggattggtgcttggtgcctccaggtggactggtcgtcatatccccggtaccaggtccatccatctttctcgtaatcaccggggaaggcgagattcaattggattttatgtcagatggggagaaagcagaggaaggtgatgttttcttcgtccccgcgtacaccgaggttaagatctctgcgtgtggccccgagtctgtgcagctgtacagggctggggtaaacagcagattcttcagctaacactgtaattgtagggaatgaggatttttgcggttgtcgtaaagtggactacactgtaattgtagggaagttttcccagctaagaaatatacgtgaaatgaaatgattagttacaaaaaaaaaaaaaaaaa

SEQ ID NO: 9579 - protein, 437 aa, Zea mays
  misc_feature: Ceres CLONE 393466
  misc_feature (30)..(394): Pfam Name: PMI_typeI Pfam Description: Phosphomannose isomerase type I
  misc_feature: SWISSPROT Homolog: EC 5.3.1.8 Mannose-6-phosphate isomerase
  misc_feature (54)..(54): Xaa is any aa, unknown, or other
MEDPPALPLPEPESEPDPDPEASPAPPQRLLRLRCAVQHYEWGQRGAASLVARXADQNPDPARPYAELWMGTHPSAPSTLLDDGTLLSDWLARNPDALGPAVAARWGVDLPFLFKVLSVAKALSIQAHPDKKLAEVLHALRPSTYKDDNHKPEMAIAITEFRALCGFAGIEELKDVLRTFPEIEGLVGHEDTGKLMNMKEDDGVSEVKSSLQSAFAKLMTASKDMVSEAVAKLISRLNTKSKIRTLTDKEQLVLSLERQYQDDVGVIAALFFNYVKLSPGEALYIGANEPHAYLSGECIECMATSDNVVRAGLTPKYRDVQTLCSMLTYKQGFPEILRGVPVQPHVRRYTPPFNEFEVDWCLVPPGGLVVISPVPGPSIFLVITGEGEIQLDFMSDGEKAEEGDVFFVPAYTEVKISACGPESVQLYRAGVNSRFFS

SEQ ID NO: 9580 - DNA, 659 bp, Zea mays
  misc_feature: Ceres CLONE 393764
  misc_feature: Encodes the peptide sequence at SEQ ID NO. 9581
atcacttagactgtgctagtaggtagcggccgcgtaatggagcaggagctcagccttgagctcaccctcctccacccctcggcctcgccgccggagccaccgggctacttcgtctgcatgtactgcgaccgcaagttcttcagctcgcaggctctcggtggccaccagaacgcgcacaagtacgagcgcagcctggccaagcgccgcagggagatagccgccgccctgcgcgcgcacggggcggccgccaccgccacgggcgccccggaggacgacgccgccgccgcgatgggctctcgcgatgtccccgccaggccacagggcacgggtaccggagtcgtcgtcgttgaagatgagagtgcaaccaggatgactggtctcccaccggcgacgtctacgtcggtggaaccactgggcttctgatctgggccgtcaccctcgctgggatcctcggcggcggcgccctcctcgtctacaacaccagcgccctctccggctaaggatatccaatgcatgcgcttcttgcgattcgtcatgtaaaatcagggtgtctgtctataatctagcctccatggatgctcaaccttcgtcatgtaacaataatcagtgctactcttcattacataattttgatgctatatataaaaaaaaaaaaaaaa

SEQ ID NO: 9581 - protein, 128 aa, Zea mays
  misc_feature: Ceres CLONE 393764
MEQELSLELTLLHPSASPPEPPGYFVCMYCDRKFFSSQALGGHQNAHKYERSLAKRRREIAAALRAHGAAATATGAPEDDAAAAMGSRDVPARPQGTGTGVVVVEDESATRMTGLPPATSTSVEPLGF

SEQ ID NO: 9582 - DNA, 658 bp, Zea mays
  misc_feature: Ceres CLONE 394196-R
ccgattgggtaccgggccccccctcgaggtcgacggtatcgataagcttttttttttttttttttggtttttttttttttttttttttttttttttttttttttttaccgctgcgcacagcctcatactctacatccaccattgaccctaacttctttccctgccatattatacatttgatccatttctgcttgctacatacaagtactgccataacccgaaaaggaggggaggaaaaacaaaagtagagtaagaggaggatgaatgaacacatgcacgcacgggcacggcgatgcctaattgttgcccccccccttggccttggccttcctgaagtgcgcgatggccttcttgaacgtgggggggaacctcttcatgtccagcgacacgtcctgcttgtcgaggtaaacatccttgaaggactcccagcccttgctcttgatccccttggggtccctgaaaaaggggtggtcccgcgggtactggtcaaacaacgtgctctcctccggcgtgatccggtactccaggtagcgcaaccccatgtccctggacgggccccggaaataacccgccacaaaatccagcccgcccagcggcaccacctggatgaacaccccgcccgtcggcacgaacaccatgttggtcaacccggcgcccc

SEQ ID NO: 9583 - DNA, 659 bp, Zea mays
  misc_feature: Ceres CLONE 394309-R
  misc_feature: Pfam Name: Nep1 Pfam Description: Nep1 ribosome biogenesis protein
  misc_feature (1)..(1): n is a, c, t, g, unknown, or other
ncgattgggtaccgggccccccctcgaggtcgacggtatcgataagcttttttttttttttttttgttaagatctgacaccaatgttccgagttaacccaagtttggcatgcacaacactccgtttttgctaaaatgactactgaacaaaccagtcttaaagccatgtaattgatgtctaaaacacgtcataatgccacactgcaaacatttgagttttaactttcaaacacttgtacataaccagagggaagtacatgtcagatgcatataataaaacaagattcccatgcttgtcaaaagttcctcattggatgttccacttctgctccagggcactgcatatccaatttaaacatcacgcagcactgagagggtagtagcaaatttgtatgtaaacatctggatattccttgtccatctttacatggggcatggcaccaaccaatcttacgaggaccaacaagtagataactagtgacaggatttttaacaacgttgagaagcttctcacgctttccaactgtcgtaatgcacagtttttgcaacaattgtaacattaaaccacagacacgtttaaaggttcttggcatgcagacatgaagattgatatcatacaatacgcccttttcacttctcacataaacagcctgtaagctt

SEQ ID NO: 9584 - DNA, 732 bp, Zea mays
  misc_feature: Ceres CLONE 394456-R
  misc_feature: Pfam Name: Plant_tran Pfam Description: Plant transposon protein
  misc_feature (16)..(16): n is a, c, t, g, unknown, or other
  misc_feature (17)..(17): n is a, c, t, g, unknown, or other
  misc_feature (22)..(22): n is a, c, t, g, unknown, or other
  misc_feature (23)..(23): n is a, c, t, g, unknown, or other
ccgattgggtacgggnnccccnntcgagtcgacggtatcgataagctttcttttttttttttttgtgatcggtggagcaccttaacgtcattgtttgtcccaggcatgccaaaaaaagcatgccaaatccatagatcatacgatgcaactgcttcaagtaccatttcgcccacaaaattgaccacgccaagccgttggacagttcctccactcccagtgcatgcaatcaatggaacccaacatgccagaaaaaccccgagactcactattatgtatgatgcgtgtaatgtcatcttgagttggagtgcgtaaataccaggcactaaaacatgcaatgatcgcgcgacaaaaatgatgaaggcattccctagcggttgattccccaatttgaatatactcgtctaccgcatcagaaggtaacccataagcaagttatccgcattgccgcacaaactttttgttagggtcttaagtccgggcataccagttgcgtcaactctttgtgtaaagtaaacttccgcggtggtgaaagaccttgcaaaaatgcggaagaaaacaaagggcttacttcatgctggaaacctactgaagtcccaaaaaggggaaatgggggggcaatcccttccccgcggcagtgcataaaaggggcacctggtttttgggcgaggggtctcaaaacacggtcacccgggtttaaattacccactcccgctgatggaatgaggcccggga

SEQ ID NO: 9585 - DNA, 993 bp, Zea mays
  misc_feature: Ceres CLONE 395075-R
  misc_feature (12)..(12): n is a, c, t, g, unknown, or other
  misc_feature (13)..(13): n is a, c, t, g, unknown, or other
  misc_feature (20)..(20): n is a, c, t, g, unknown, or other
  misc_feature (68)..(68): n is a, c, t, g, unknown, or other
  misc_feature (70)..(70): n is a, c, t, g, unknown, or other
  misc_feature (73)..(73): n is a, c, t, g, unknown, or other
  misc_feature (82)..(82): n is a, c, t, g, unknown, or other
  misc_feature (83)..(83): n is a, c, t, g, unknown, or other
  misc_feature (86)..(86): n is a, c, t, g, unknown, or other
  misc_feature (105)..(105): n is a, c, t, g, unknown, or other
  misc_feature (993)..(993): n is a, c, t, g, unknown, or other
gtgttttgtggnnttttttncttcttttttcatgttggtttagtgaaaattaataaaaaggatgagtnanaanttttttttnnttnttcccaattgggtacgggnccccccctcgaggtcgacattatctattagcgtgtaactgtttttcttttcttttattttctgatgaatgttcactagtattaattaatatgtacacagatgaattaatacacacagatgcattgatatatatatactgaatcgaaatcgtgaactgaaactaattaatgtactctggattcgacatggaggtatggtatatataacacaccagtagcagacggctggctgcttgaattgatcatatcccgtatgcaaaggctactagagatacacatatgtgtttagtcgtcgatgcatgcatgcatggcatgctcatgagctaccgatgtacttgtccatgagggtggatgaccgtggactttgggaaccggggaccgatgatgcttttcctttcctcccccccacccccttgaaagaatgaaccacgggttgggggatgcttgccgtgaattgccccctaagggtgggggaaccacccaacgttttgggggggcttgttcggttcccggtggttttcaaccctttgaccaaacaaacggttgaaattctttttggcccagcggcagataaaaatcccctttgttgggccccaaaggccctttcgggtcccaaaaattccacaccgcggggcccgcccaaaattataatatgccgggggcgaaatcggagcacctcggccaccccaaacgaggattggccctcaaataaaaaatttctcccctccccgagagaaaacgacggggagggtttctctctgttcaacacgccccaattcacactcaaaaaccgccgcggttcaccccagagttttccttttccccaccgcgacgaaccagagaagtgtggaaagcgctcactacctatagtcccccttggtgttttgtn

SEQ ID NO: 9586 - DNA, 733 bp, Zea mays
  misc_feature: Ceres CLONE 395101-R
cgattgggtaccgggccccccctcgaggtcgacggtatcgataagcttttttttttttttttttgggcctgatttctcaaaattaggacaaggggagagtatctccacgggctcttcctaactccctcaaaagggacagaaaaaaaacttattaaaaaacaatgcctatacaaatcccattcacgtaaaaccgcacagaccaatcatcaataccacaaatacgcactctacaatcgcctagaacagcaatatatcgcaactcacgccccaaccagttcttgatctttcttcggcggcggcgcagagtccgtgctcccatctggggtcggagttccctgcgaactcaccgtcggcgagtctgggctgaacaacaactcctccctttcaagcttaacaagagtttctttcgactcgcctttcagcaacggcacgacttgaagcatcgtgagactcttttcaggttctgaacgtgtacacgctagaccaaccaacaccatccttctcagctcatatccagagaacttgtcgcccaggcttcgagtgcgaatctcgtcctacctgccgtgccttgcgagcgggagcacccagctactgattccacagccttgccaagaacccgacttctcgatggcctttttgacgttcgaaagcttcagggagaaagatcccaaacttaaaaacttgaaaccctgaaaattggtttggcaaaatggggggcgaacccccggagaaa

SEQ ID NO: 9587 - DNA, 880 bp, Zea mays
  misc_feature: Ceres CLONE 395743-R
  misc_feature: Encodes the peptide sequence at SEQ ID NO. 9588
caattgggtaccgggccccccctcgaggtcgatggtatcgacaccccccccccccgttttatgctagaacagaacatcctcctctttacgaaaaaaatagcaacaattttacaaacacaattttacaaagacaaggcgacggattgttcagtcgtcagaacgggcgacggcggagcaggcctcggacgccaccttggccatgccgtcctccccgacgccggtattgcagatgttggcgaagccacgcatgtgcttcatcccgtactgcccgagcggtccgcaactgcgctcgtacgcacgcaccaaggacttgaggcagtcccagtcgtcggccaggggctgtcccgccggccgcacggcaccgagcaccctgggacctccctccgagccgaacaggaggcctccgatgagctccatgatgctgtcgacgcgggaccggcgggacaccgcccgcagcagccgcgtccgggcctcggccttctcgggcgtcctctccgccgccctgcggtacctccgccagaagtagacgaggtcagcgtcgcgctggctcacggctggctgcccacggccacggcccggataagctcgcggaggaggcgtcgtcgctgcccatgaaacgtgtacaggctctgcgcgccgaggccctgaacgtcgccgtactccatggcgtgaagacccgaagctgaaggtgccgtgcgcccgaagtccggtccttcaccgccaagtactgctgcctcaaggtctcggggcggagggcccggcagcgcgaccctgtcctccatccagcgaaagctgaaaaggtccccgaagcatgtgggcaaattcgggcggcgggggcccggatccaccccgcggacaaaaaacccctccacctgccctc

SEQ ID NO: 9588 - protein, 108 aa, Zea mays
  misc_feature: Ceres CLONE 395743-R
MPSSPTPVLQMLAKPRMCFIPYCPSGPQLRSYARTKDLRQSQSSARGCPAGRTAPSTLGPPSEPNRRPPMSSMMLSTRDRRDTARSSRVRASAFSGVLSAALRYLRQK

SEQ ID NO: 9589 - DNA, 790 bp, Zea mays
  misc_feature: Ceres CLONE 395743-R2
  misc_feature: Translation starting site: 195
  misc_feature: Pfam Name: Peptidase_C13 Pfam Description: Peptidase C13 family
  misc_feature: SWISSPROT Homolog: EC 3.4.22.34 Legumain
  misc_feature (21)..(21): n is a, c, t, g, unknown, or other
  misc_feature (72)..(72): n is a, c, t, g, unknown, or other
  misc_feature (667)..(667): n is a, c, t, g, unknown, or other
  misc_feature (668)..(668): n is a, c, t, g, unknown, or other
  misc_feature (670)..(670): n is a, c, t, g, unknown, or other
gttgttgttggttttttttcncccaccccccaccgcactcaattcacacaaccgcccgccacttccccctanagtctcttctttaaaaaaaatagcaacaattttacaaagacaattttacaaagacaaggtgacgggttgttcagtcgtcagaacgggcgacggcggcgcaggcctcggacgccaccttggccatgccgtcctccccgacgccggcattgcagatgttggcgaagccacgcatgtgcttcatcccgtactgcccgagcggcccgcagctgcgctcgtacgcacgcaccaaggacttgaggcagtcccagtcgtcggccaggggctgtcccgccggccgcacgggaccgagcaccctgggacctccctccgagtcgaaaagggaggccttccgatggactccatgatgctggcgacagcggaaccggagaggataccgccccgcagcaagccgtgtcccggccccccgctcttttttcgggggttcccccccccccccccccttttctgtaacctccggccaaaatgtataaccaagtccattcgtcccccgcttggcttcccgccttggcttggcccctcgggcctccggaccgggcattaatttccggcgctgggtgggttttttcctcagaggaagttggcagcgagccatctnntntttctttcgtctacctgcccgccctctcccacctacttcgctattttagctaagtatataagtctttatatgtattgactgaacgctctcctcttcgctcctataccacaccaatactct

SEQ ID NO: 9590 - DNA, 891 bp, Zea mays
  misc_feature: Ceres CLONE 396409-R
  misc_feature (641)..(641): n is a, c, t, g, unknown, or other
tgagagttatttacaaatatgaaatattgtaacagtcttcagtcatacttcctccgtttcgttttagttgtcgctggatagtgcaaaattgaactatccagcgacaactaaaaagaaacggagggagtatcattttggaaacaatgtaaatcatcaacttattttccagatatcatttaaagttgaaaaaatagcagaatcaaactttcgtatagggcctctatatagactttcgcttagggcccccaaaatgtcaggaccggccctggccaagcccaacaccttcagcagccccttcacaaacggcaatgcggccatcaaccttgatcggaggtacctcgttgatcagttccattggtgacttcttgctcgtgtcctgcatccacttagcggtatggctgccgacgacggcgacggcggcggcgccgacagccttctcggtggagaggccgcgcgcgccggctggagctagggccttgaggagcgcggggagcagcctccgcggcgcggtcgccatggctagctggggaagggtgcgactgttgagaaacctttttcgattaggatgttctaggtaatggtctcgtgcgaattcctgcagcccgggggatccactagttctagagcggccgcccacgcgntggagctccagcttttgctccctttagtgagggttaattgcgcgcttggcgtaatcatgggcatagctgtttcctgtggtgaaatggtatccgctcacattccacacaacatacgagccggtagcatatagtgtaagcctggggtggctaatgagtgagctaactcacattaattgcgttgcgctcactgcccgctttcaagtcggaaacctgtcgtgccagctgcataatgaattcgccaagcgcgggg

SEQ ID NO: 9591 - DNA, 748 bp, Zea mays
  misc_feature: Ceres CLONE 396442-R
  misc_feature: Pfam Name: Peptidase_C1 Pfam Description: Papain family cysteine protease
  misc_feature: SWISSPROT Homolog: EC 3.4.22.31 Ananain
cgaattgggtaccgggccccccctcgaggtcgacggtatcgatatgctttttttttttttttagtcaaataatataataataaccgaatgaaatgaaagttgctggaagatcaactctcgactggtattacatgaatgcaggtgtacaatgtgcgtatgccattcagacattcacagtcggcgatgttcctgtccgagcatacatggatcaatcatagtatagctatataggctatagctagtacgtaccagtgtagtgcgcaattcagagctcgtcgagtctgtagccgtcctcgtcgacgacggcgtggaccttgatgtttgggcgagtccttgacgggctacgatcgctccctgccgatgccgcaggacccctccttggcggccacgtcccgcgccatgcggatgaaccccatctccgcccacctcggggcccacgaattcttgaccaccccgaacttgctgccgccccgggggcacccgtaacccaccgccggaaaccctggtccaatttccccccgaccctgcggaaaaaaacccccccggaaaaaactggaaaggaaaccccctgcccctcattgtaaaggaaccggacctggggccccaccccccctcctaaaagccaaattcttttttgtacggacatcccctctggacccctggtggggccaaccccgggccccgaccatttccttaaaaaaaccccctgggagttgttttaaaggaaaatacactcccccccaaaaaa

SEQ ID NO: 9592 - DNA, 621 bp, Zea mays
  misc_feature: Ceres CLONE 396632-R
  misc_feature (289)..(289): n is a, c, t, g, unknown, or other
  misc_feature (539)..(539): n is a, c, t, g, unknown, or other
  misc_feature (540)..(540): n is a, c, t, g, unknown, or other
acgattgtgtaccgggccccccctcgaagtcgacggtatcgataagcttttttttttttttttttgacatttaattggatatcatttttctttttattttttcactcagttccagttcattcacaactaggtgcaatgcatgggcactgacctatcttatataatacactactaggtcagtgtccgtacatcacagacccgaatttctcttcgatgtcatcccggacagctcgcgaatgtcatcatttatctcataactgcataacacatttgtatatataagttatcngagatattataggtcccccgtttgcaacgccaccggaccactgaccttggtggaacattttttaaaaccctaaacctttgggcgaaaaaccccaaatggagctttggcaaaattaaagggaaaactcctcaaatcaaccttggggaaaaaccccttccccccccgagggaacacccccggggggaaaaatttttttttggtgggggggaaaaaaaaattttttttttttttttttttttttttggggggnnccccgcaaaaaaaaaaaataatttttttttttttttaaaaaaagagggggaaaaaattcccccccccccccacgagggggt

SEQ ID NO: 9593 - DNA, 701 bp, Zea mays
  misc_feature: Ceres CLONE 396634-R
ccgattgggtaccgggccccccctcgaggtcgacggtatcgataagcttttttttttttttttttgcgtgaacttgctttgattctttctctcttctcaagttctcatacaatatactctttcaagtcttttttttatttgtcgcgttttaattaagaatgaactagtatgaatattcgagaatggaggtatacatgacaacaattgtcctgcagtcctgctacgtctcttctccggcggcggtgcgtcgctgacctcagccctgttgcttgccgaggaggtcgtagaacaccggcggcttcttgtaccccttggcgcacgcctgctgcgtggcgaaggccacgtggaggagtgtggcctcggcccacggcctgccgatgaactggaggccgatggggaggccgcccctgtcgtagccgaccgtgacggtgatggccggcaggccgaggaagttgccggctatggagtaccggaccagcgcggctccgtttatgtagtcgagctccccggtgctgagcgcgtcgtcttgcagcgggtacgcagtcacacttgagagaaacggaaggatgcgagctccattacaccatttttacatgtgaattgtgaagaagaaggtagtagtagtacccggtcatcggcgagacgatgacgtccgcggacttgaagatctgcttgtggaagtacatctgacggttcccgac

SEQ ID NO: 9594 - DNA, 1030 bp, Zea mays
  misc_feature: Ceres CLONE 396972-R
  misc_feature: Pfam Name: Phage_rep_O Pfam Description: Bacteriophage replication protein O
  misc_feature (1)..(1): n is a, c, t, g, unknown, or other
  misc_feature (28)..(28): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
ngcgacgggggtattttttttttttttncctcatcccccctaccaagggaaaaggggactgtcgctnnnctccttttttttcgattgggtaccgggcccccctcgatgccgctctgattgcacatccggtttcccacagaaaggtcgttttctggctggtcagaggattcgccagaattttctgacaaataatcttttcttttttcttttgtaatagtgtcttttgtgtccccctgttttgagggatagcaatcccccaatttgagggatgttttatccctcgttttaggggattttccctcgctatgagggatgcaccattctgagatgtttttatttggaccaaacatgcggccttgctgcttgataatattccttccgacgagttctaacttggcttcattgcaccggtttgacaggtaactttgttaatcctcgctaaaaactgaaaaaacggtggattgcttgtccgttaggatttatttggcgcccctttaacaccccccccccccaaaaaatgtgttaaggcaagcaacttttaaaaaaccgtggcccccttgggggtccattaatcctgacaccccccccaaaaattgaaagccctgtcaatagcaggcggccgtagtttttacaaaataagcgtgctggggggccgggcttataccctgtgttaccggtgctgtataaaaatatctggtgggcccggctaatttttaaaaccgggccttaccccatcggcgccccggggtgaaaaaaaagtgttattgcccattcgaatgggcgcccgtaatggggttcggaaagtgaaaaacggttttggggaacttcgcgcaattaatttggtcctatctcaacttcactctcatcacaccggtcatttaaaacagagaattcccctggtgtaatattgtgggccccccccgttaaaaactatcccccgttcgctgagaaagtttttgttgtcttcttaaaaaagtccatcacccaggtggggctccaaaaccggcggggggcttttgtgttgtttata

SEQ ID NO: 9595 - DNA, 730 bp, Zea mays
  misc_feature: Ceres CLONE 397001-R
  misc_feature (730)..(730): n is a, c, t, g, unknown, or other
cgattgggtaccgggccccccctcgaggtcgacggtatcgataagcttttttttttttttttttcaaccctagataaccctccttgctctccacatccaagtcggcagaaaatcctcttgtttggacagattctcgtactaacactaaacttgctccgacgcgttatgcgcgaattcccacctaatagttccctcatatatccattcatatctacattgaccgtcggtagattccgtatctgacagtggtgctactctcctcgggcttctaggggcgtgtcatcttcatgacgcatgctcatcgttgtatagaggtgatctcctgctgcctgcctggttctcatcgtctgtgaccagtgagtatggtgtgaatcgaacttcctgcggctgctcttttcttggactttgcgttgttgaagagatcctccgcaatggcctccatttgtttctgccgcttctcctcacgcatgaaatctgtcatcgtgctcccacgttcgtggtcccactctctgtatggttcccgcacggacagaatgacgctcttgaagctgttgtccgacaccatttccctcttcatgaagcgctcgaagtacacgcctccaatttctgctagcgcgacacgagctgactgagggcaggcttcttctgacgaccagattctgactaattatgacatctgaggtcccttccctgctgcagtctagttaatcagccgtgcccgctttgctan

SEQ ID NO: 9596 - DNA, 663 bp, Zea mays
  misc_feature: Ceres CLONE 397007-R
  misc_feature (1)..(1): n is a, c, t, g, unknown, or other
ncgattgggtaccgggccccccctcgaggtcgacggtatcgataagcttttttttttttttttttgaatcttaattgatctccttttttttcggagataattcaatattggtgcgagtaggtaacacagctcagctcccccaaactccctgaatcgagggggtctggggagttattcagcaggtaacacacacacacactgacaaacaatcaccaccaaccaatgcatccacgctcccccacccccatttccaatccaataccaatcctgccttcctccaatccagcacaggcaggcagagctgctcagctcagcagctggtgtcgagcatgccgtcgtggaaggcggcgacgcggtccggggtgacgcactgcgtgatgagcctcgccccgggcttgtgcgcccacggcttcaccaggatgcacgtggcgatgtagtctaggttggtgagcggcacgacgtgcgcgggcgggccccagccgtagtccacctccgcgaagccgaggcgcgtccagtcggacaccagcagcgtgcggtagtcggccgtgatctggtacgggtcgacgccggcggcgacggcctcgcccgtcgcccaccgcgcgaacttcgcgggcatccgccgcttgccgtccttgacgatccgcaacacctcccccaccgagg

SEQ ID NO: 9597 - DNA, 962 bp, Zea mays
  misc_feature: Ceres CLONE 397217-R
  misc_feature: SWISSPROT Homolog: EC 1.9.3.1 Cytochrome-c oxidase
  misc_feature (13)..(13): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (20)..(20): n is a, c, t, g, unknown, or other
  misc_feature (66)..(66): n is a, c, t, g, unknown, or other
  misc_feature (67)..(67): n is a, c, t, g, unknown, or other
  misc_feature (105)..(105): n is a, c, t, g, unknown, or other
cttttttttgttncnnnttntgtataaaaaaaaaaaaaagcgtgcattctcttttttatgtttttnnaaatagattgggtacggggcccgccctcgaggtcgacngtatcgataagcttttttttgtttttttttaaagaatcgtcaagttctattaattatttcacaacgcacaaaacatagtctaacagaattggtagctcaagcaaatgagcatcctgcgttcaaataatcgcataaactttctatctcaaaagttgtgacacaataaggtatagacaaatcaaaatcaaacttaggccacaggattttgaaaggccagagtgtatgctaaacaatgtctctccatctttccagaatttattccagatttaattgaaggatgcaatcaatggtgatcatcatcaccatgtccatcgggtggtccaccaggtcctaccacttcaagaacaaaatactgtgcgcacactggacattcatggggcttgtctttctccagccaaaaccagacaacatcatgctcatcctcaccttcacctcctgggcatccgactatccttttatcatagtaagattttgacaacagcaagtgcttcctttgtgccgaatggacctttcgggatggtctatttcaagaaatatttccttccctcgagctcagcctgaaagctcctcgcgctcgtgggccagtaccgaattggcattaatgtccctcaaccttcttttttgatcgccagtaacatccctccggattggggtttgagaaaataaaaggcagggacccaaaaaaaaatccggccaaatcttggccggaagccgggaaagcatattcgtgggtaaattgggcggtgggcagcccgcccgtccgccataaaagaaggctatagggttttttttaagggggaaaaaaaaaaaagaaaaacctctcccccaaaaacattttttgtattctcccgagggcc

SEQ ID NO: 9598 - DNA, 733 bp, Zea mays
  misc_feature: Ceres CLONE 397247-R
caattgggtaccgggccccccctcgaggtcgacggtatcgatattttttttttttttttttgaagccgtaaaataaatgtcatgtttatcatgagaataagcctcagctattctggtttacatggcaatgttaagtaagcaaaaaatgaaatacataaggttatctttgtattgtccagtcaaggggaatcaatgtatattgcctccacactattgactggtgcgtggtaataaaacaacacgcgataacaaaaagggcaggaataaattccttgggacggatcatatcgatcttacggtggtgagtggtcatcatcctctataactccttgctcgctgaaccatatccaaaatctgagccaccccccgatgatttactccctccagaagcacctgcagcatcactgccacttcctccggcgccaccaccaaatttgacgcctccggagacaccagcacctatggtagctccaataccaccatcgacgccaccggatcctccaccagaaacacccgcatcggcaccggttccagtatagacgttgccacttcctcctgcatttcctcctacgccaccaccaactttggcacctccggagacaccagcacccacggtagcactggtacctgcactggcgccaccggatcctccacctgaaaacactgtacctgcatcagctacagtatatgcatttccactccctcccgcttttcctccatgttgccgaacact

SEQ ID NO: 9599 - DNA, 868 bp, Zea mays
  misc_feature: Ceres CLONE 397530-R
  misc_feature (497)..(497): n is a, c, t, g, unknown, or other
  misc_feature (868)..(868): n is a, c, t, g, unknown, or other
tcgaggtcgacggtatcgataagcttttttttttttttttttgggttcagaaccaactgattttcagatccagaattaattgatattcgggttcagagctactgtaacagatattcagatccagaactaactgcaattcagatgtacgacggcagatctggcaaatgtaactgcagatctccaatccaatgtggcaacaagagacggaaccgaatcgaaacatctgattccgagcttgtactctaattacagtacaaaagcaaaacaagaccggggagcatcgcggtggccggagacgacgggaagggacaaaccctaaaactagatcccctccttcatctcctctgaccactcctccctccatggctagaagaacatcaaggactccccacaacagccacggggagatccagagaggaaacgctatgtacagcggcttcgcgtcggcgagttggtttgttggtgggccggatctcctaagaagaacgggccaagcnggaggccatggcggattggtacatggcgtcgtggaagctcctccgtctccgaactcccgggcccgcagctgccgcgcccttctcttccgtaagggcgcccaaaaaaggaaactccccggggcttctccccccccggaacaccacccggcacccccgggcttcaatgttaatccggccttccccggaacaaaccaaacagcgggccccccaccaatttgccccaccgggggggcccccccgagggaacccgcccctggttcccggccaaaaacccaaagtcgtaagcgcgcgccctgtgcccggacacctcccaagggaaccgcgcgggaaaaaaaaaaaagcgcggaaccccttcctgtttcacacggccn

SEQ ID NO: 9600 - DNA, 1055 bp, Zea mays
  misc_feature: Ceres CLONE 397552
  misc_feature: Encodes the peptide sequence at SEQ ID NO. 9601
atatcctctcatccacttggccacccgcgcgccgtctccactctccaccaccacaccacccgctcctcttagctagctgcatgctcgcgccccctcttccattccattccattccattccagtactcgctcatcttgctccgccttctgcttctgcgcatcctccaaggatcgtgatggccatggccacgcaagcctccgcggccacgcgccacctggtggccgccgccgcttccgcctgggcgccgtcggcgaagccgcggcagctaagctcacagctcgcgctgccgccgtcgtcctcccgcgcgccggccccgctccgcgcgaccgccggggaggcggtgaccgaggaggcgcccaaggggttcgtggccccgcagctggaccccagcacgccgtccccgatcttcggcggcagcacgggcgggctgctccgcaaggcgcaggtggaggagttctacgtcatcacgtgggtgtcccccaaggagcaggtgttcgagatgcccaccggcggcgccgccatcatgcgggaggggcccaacctcctgaagctggcgcgcaaggagcagtgcctcgcgctcggcaccaggctgcgctccaagtacaagatcacctaccagttctaccgcgtcttccccaacggcgaggtgcagtacctccaccccaaggacggcgtctacccggagaaggtcaaccccggcagggagggcgtcggccagaacttccgcagcatcggcaagaacgtcaaccccatcgacgtcaagttcaccggcaagagcaccttcgactaatcacacatcacgccgcccgcccgcccggccggtgatccaaatcaaaggacttcttcttcttcttatattaataattaagctagctgctggtggtgcgccatatacatgcatggtttgatctaaatatatgtggacatggatgtgtaatttgttttagtaatttcttggtgaccgtggaggcgcagcgtgggactctatgtacatgtgcatctgctcctcatgtctatgcatatgacaacgttgccacaaaaaaaaaaaaaaaaaa

SEQ ID NO: 9601 - protein, 204 aa, Zea mays
  misc_feature: Ceres CLONE 397552
  misc_feature (67)..(204): Pfam Name: PsaD Pfam Description: PsaD
MAMATQASAATRHLVAAAASAWAPSAKPRQLSSQLALPPSSSRAPAPLRATAGEAVTEEAPKGFVAPQLDPSTPSPIFGGSTGGLLRKAQVEEFYVITWVSPKEQVFEMPTGGAAIMREGPNLLKLARKEQCLALGTRLRSKYKITYQFYRVFPNGEVQYLHPKDGVYPEKVNPGREGVGQNFRSIGKNVNPIDVKFTGKSTFD

SEQ ID NO: 9602 - DNA, 859 bp, Zea mays
  misc_feature: Ceres CLONE 397814-R
  misc_feature: Pfam Name: Phi_1 Pfam Description: Phosphate-induced protein 1 conserved region
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
ttttttgctcccttgcccctccttcaatttaattttnnnnnntcacgaattgggtaccgggccccccctcgaggtcgacggtatcgataagcttttttttttttttttttattttttatatcgtattatgatgcagatatcaacactaaccacagtacactccttatcaaactctcatactatatacacagcgttactacacagttgacaggactgtttccttgggcgttaaaccaaagtcgaacacgtaaaggttgcagggtcgaatagagcgggaagcaggtacttcctcccgttggcaccattggcattgtagctcgcccccgtcgtgccgtccaccgccaggttgcctgcgaaaccggggtaggcgccgctgccgtagaccccagtgcaggaggtggcggcctctagcgccgcgtccttgtcgccctggtaaaaccccgtcccggaaacgggttggtgaaccgccgccgggaaccatgctgggcgattgttgaaccccccattggccatcccatggccgaagttccccccttcggggggcacaaaacgcgcccggccccctgggggggccccgaaacagggggttggggggaaaagggccaaccccccacttgccccggggggcctgtggcgtttttgggggttttcccaaacccccaacgtaaggggggccccccggccccccggggttcgaaaacctgtacacggcccaacagaggcctccggcaaaaaactctgcccccggggcaaccccctggggggcggggagacacaaacgcgaaaagccccccctttttgggccccggcccagggccccggccccccaaatttcggggccgtctgagaaacacggccg

SEQ ID NO: 9603 - DNA, 1117 bp, Zea mays
  misc_feature: Ceres CLONE 397959
  misc_feature: Encodes the peptide sequence at SEQ ID NO. 9604
aattttattttggccatgtcgtcgtcttcgccttccctcctctcatcgcggctactctccccagccatcctcttcacaaagaagccggcttccctgcgctccatttcctctgcgacagcgagacacggggttcgggtggtggtagccgcggcgtcagcggccgcagcgtcaccagtgtccgcggcgcgggtgcgaccgtcggcggcggaggtagcgcggactgtcgtggagcttgcctcgtccgggactctctccatggtgggcccagacggctggcctctcggcgtcggcgcgcacttcgtcgcggattctgccggtgcacccgcgctctgcctgtctgccgctcgggtcgccgcgcccgatgcgccggccagcttccacgtcgagtttcgacagagtggggctaggacaccacagtgcactatgcttggtgccttaactaagcctagtgatgaatctgtgttgaagaagctttctactaggtggcaaaagaaatttggggaagagattgatcaagatcttttgtatttaatatctgttgaccggatcttgcacatggaagatttcaatgaggatggcatgtgggtagttccatcagactacaccagtgcagaacctgatcctctacgcaattttgctgaaaacatcgtggaggaatttaacaacaaaaatgctgaagacgtccgtaggatatacaacatatatgtcgaatcagatttacaggtggcagacgtgaagatgatatgggttgacaggctaggtttcgatctccacgctcattttgcggaaggcgttttggctgttcgggtcccttttcctagggaggtctccgacgagaagggggtgaaatcgtcgttcaacatgatgtctcatcatgcgtgggaggtggagaagagctacgcgagcccagagtttgagaaggtgcagttcttgaagaaggtcagatagcattgcgaattctgtttccgtggtggacgatctttcgttattgagaggagtgatagtttgaagttttgtttcctttatcatgaactgtttgtcttgtatattggtcatatttttttgtgcctaatacattggatgcaattggcatcttgaattaaaaaaaaaaaaaaaa

SEQ ID NO: 9604 - protein, 310 aa, Zea mays
  misc_feature: Ceres CLONE 397959
MSSSSPSLLSSRLLSPAILFTKKPASLRSISSATARHGVRVVVAAASAAAASPVSAARVRPSAAEVARTVVELASSGTLSMVGPDGWPLGVGAHFVADSAGAPALCLSAARVAAPDAPASFHVEFRQSGARTPQCTMLGALTKPSDESVLKKLSTRWQKKFGEEIDQDLLYLISVDRILHMEDFNEDGMWVVPSDYTSAEPDPLRNFAENIVEEFNNKNAEDVRRIYNIYVESDLQVADVKMIWVDRLGFDLHAHFAEGVLAVRVPFPREVSDEKGVKSSFNMMSHHAWEVEKSYASPEFEKVQFLKKVR

SEQ ID NO: 9605 - DNA, 790 bp, Zea mays
  misc_feature: Ceres CLONE 398035-R
  misc_feature (127)..(127): n is a, c, t, g, unknown, or other
  misc_feature (128)..(128): n is a, c, t, g, unknown, or other
  misc_feature (268)..(268): n is a, c, t, g, unknown, or other
  misc_feature (655)..(655): n is a, c, t, g, unknown, or other
  misc_feature (765)..(765): n is a, c, t, g, unknown, or other
cgggccccccctcgaagtcgacggtatcgataagcttttttttttttttttttaaagaatcgtcaagttctattaattatttcacaacgcacaaaacatagtctaacagaaaattggtagctcaagnncaaatgagcatcctgcgttcaaataatcgcataaactttctatctcaaaagttgtgacacaataaggtatagacaaatcaaaaatcaaacttaggccacaggattttgaaaagccagagtgtatgctaaacaatgtctcntcatctttccagattttattccagatttaaattgaaagaatgcatcaatgggggaatcctcattcaccatggtccatcgggtgggtccaccaaggccctacccctttcaaaaaaaaaaaaacttgggcgcccacctgggaaatttcccggggcctttgttttttttcccgcccaaaaccaaaaaaaaatttttgggttattccctccccctttccccccccgggggaattccaaaaaataccctttttttcccaaaaggaaaaattttttgccaaaccccccgggggggtctctccctttttgtgccccaaaaaaaaaccccttcccgagagaggggcccttttttttcaaaaaaaaaattttttttttcccccccccggaggtctncacaccgaaaaaaaaccccccccccccctccccttgtggggcaacaaaaaaaaaaagtgggcgttttttttttccccccccccccccctttttttttttttttataaaancacacaccaaaaaaacaaaacaaaa

SEQ ID NO: 9606 - DNA, 929 bp, Zea mays
  misc_feature: Ceres CLONE 398130-R
  misc_feature: SWISSPROT Homolog: EC 3.1.3.16 Phosphoprotein phosphatase
  misc_feature (79)..(79): n is a, c, t, g, unknown, or other
  misc_feature (80)..(80): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (112)..(112): n is a, c, t, g, unknown, or other
ttgggggtggaggggtggtgtggatgataggtgtgaattatttcacttgttttataaataatatgtgttgcgtgggttnnttnnnnttctattgtgtacggggcccccctcnagcacggcctctggcaaaatcgcagaatcaaagctaagttcggactgaaaggagcaagtgtatgacgggcaaagaggcaattattcattacctggggacgcataatagcttctgtgcgccggacgttgccgcgctaacaggcgcaacagtaaccagcataaatcaggccgcggctaaaatggcacgggcaggtcttctggttatcgaaggtaaggtctggcgaacggtgtattaccggtttgctaccagggaagaacgggaaggaaagatgagcacgaacctgatgaacaaactggatacgattggattcgacaacaaaaaagacctgcttatctcaggtgggcgaatttggttgatcgtgggtgcaatagaacgtttgaatgccctggaaattaaatccacacttcccccctgggtttcaggaagcttgtaaccgtgggaaaacccatcggagccacaattggaatgaatctggaatcgggcctctatttccaatataccgttcggggaaaaccagatttagatttcaacattggaggcctggccttttataatgaggcccgggtcggcgcccaggggtttctcttttttaaaactcctcccggaatttgaccggaaacacaaaagaaaaaattttccccctgaccatagccccccggggtggggctatctcccccctataaggttaccttaaagaaggcaggcgcccgaccccacctcggccggggaggaagataaccatccccaaggccttcttttggttttacccccttctttaagggagaaagagaattcataaattctttccgatagcctc

SEQ ID NO: 9607 - DNA, 1090 bp, Zea mays
  misc_feature: Ceres CLONE 398188-R
  misc_feature (14)..(14): n is a, c, t, g, unknown, or other
  misc_feature (713)..(713): n is a, c, t, g, unknown, or other
tccttttggttttngatattataaattttattagtgggtaattggtgaaataagaaagagtggcgaaatttattattttttttcaattgggtacggggccccccctccaggcgacagggtcgataagctttttcttgctgttttttgcgctgagatctctctaaatagcggcaacatgagtatgagtggtagtgtcagacgcgaactgtcacccggttaattcggcgattggaggagaccggtcattacaccgcgggcatgcttttactcagtatctgcaaagaatataggaatgcgcctccacgggaaactagcggaaccactgtggcttgtccgtccaaggaggctactctgatttcgtataagtcgctagggcagggtgtaatatacatcccgactccagcatctgtacaacgcctgtgaattcgtcagccgtttcctccggcaaagacgcttacacaccctgcttttggcgaagaataaatataatgggctttcccatagaggtctaaagttgtagactcctgcctttccccatatattaataatctccagaaaaattttttcccaattcttaggccggtttttcctcctcccccggggcgcaggaaaagaatttttttttaaaccccagtgtcgcgcgaaccatatttggtgttatcagagaaatcaccctcactctttatccacagttgcggcttgatgtcctcgtnaaatatgattatacaagtggggtgcaaggtattccaccgtgaagtgatagggggaaaaatccgcaacgtcttatattggatattattcttaaaataaagttccggtgacctgccggcccccttacgcgcgaagtggttcccgttgggaaaagctatcttcctctaatgcgcttctttttttgagttcgctcccccgctgatatacaaggaatggcgaaggcgagtcaagtaaatactgtcgcagcagaagatacattttcggagcgcgcgactacactttcaacatgagaatcacacttatacataccgccgagtctctgcgtcaatggtttcggttatataataaaacatttgagtctcactcacacgcgataata

SEQ ID NO: 9608 - DNA, 634 bp, Zea mays
  misc_feature: Ceres CLONE 398275-R
cgattgggtaccgggccccccctcgaggtcgacggtatcgataagcttttttttttttttttttcttttttttttttttttttttttttttttttttttttacaaagggaatatttttgccctccgggccagggtttggcagtaaaaaaaatgacctgaacaatgtatcaccccacatatgtaccaaaatatacctagaggcagctgcaaccggctcaaacttgacgatagcagcgtgcttaccagtgcgcctatacacataatcagacagcttggcctcctcgaacacacccttcacagtgacttgagaagccttgaggtctgcctctacagattgcacgcctttcatcttgaggattctcttcttgatcacttgggtgcaagcctcacaatgcatatgcaccttgagcaccacagcgagcaccgttgcctcctctttcttctcggtttttggtggctcaggttcttcctttttctcctcttccttcttctcttctttcggtggtggcattggtgagagaagctctaccttgcggcctgtcttcttctgcacccgttccaccaccttcattgggtcagcagctgcctttttccccttaacgaccaccttgtgtgccttcgtatctgcaataac

SEQ ID NO: 9609 - DNA, 902 bp, Zea mays
  misc_feature: Ceres CLONE 398392-R
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (658)..(658): n is a, c, t, g, unknown, or other
  misc_feature (659)..(659): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (668)..(668): n is a, c, t, g, unknown, or other
  misc_feature (671)..(671): n is a, c, t, g, unknown, or other
  misc_feature (672)..(672): n is a, c, t, g, unknown, or other
  misc_feature (694)..(694): n is a, c, t, g, unknown, or other
  misc_feature (696)..(696): n is a, c, t, g, unknown, or other
  misc_feature (697)..(697): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (709)..(709): n is a, c, t, g, unknown, or other
  misc_feature (713)..(713): n is a, c, t, g, unknown, or other
  misc_feature (714)..(714): n is a, c, t, g, unknown, or other
  misc_feature (743)..(743): n is a, c, t, g, unknown, or other
  misc_feature (780)..(780): n is a, c, t, g, unknown, or other
  misc_feature (783)..(783): n is a, c, t, g, unknown, or other
  misc_feature (810)..(810): n is a, c, t, g, unknown, or other
attgggtaccgggccccccctcgaggtcgacggtatcgataagcttatttttttttttttttctttttttttttttttttttttttttttttttttttgcaagaaacatcctccatgctgccttatacgggtatacaaataccatggataaagtgcaagcgtgcataaatattatacagaccggaaatccaccgaacaagggaaatattacatcaacgagggcattaacaaatcaatcgacttaaatttcgttctccccacatggatggcgaacatctccaaaagattcaagcgtggtcacatttcattttagatgggactaagctactgcagattatctagatatacccccccccattgaaaaggccttgcctaaaaaaaaagggggccctttcccctttccccctttgggccggggggggggccaaaaaaaaaggaaattttttttcccccccccaaagaggggggagccccttcttccgaaaaaaaccctagggggcgcccttttgtgggggggccccccccgataaaagaagacccccccccccggaaaaaaaaaaaaaaaaaaaattttatttttttttttnnnnnnnntccccnnnnnaaggggagtaggggggcccccccctctaaagaaaagaaaagggaggggaggggnnggnnnnggntgnncccccctccccccccccccccncnnccnnnnnnnnanaggnnaaaaaaaaaaaaacaaaccaccccccccncgccggggggggggagggagagaaagatttttttttnctntaccccacccaaaagcccgcggggggngcggccgcgtcccccccccaacaagatggtgttggttggccccccccccccccccccccccccgatatatttttattttttttattataata

SEQ ID NO: 9610 - DNA, 677 bp, Zea mays
  misc_feature: Ceres CLONE 399614-R
tcgaggtcgacgtcatcgataagcttttttttttttttttttgacaaatccaaacaattcttaatttgcaatacatcactatcagcaaattcaacgaattccacaaaaaattggtaagatacagcatgatgttgctaattgtttcaaaaaaaaacactgctttctcatccgcacgttcatgccgatgtgaattttaaggggcgggggggggcgtctgactccttccgtcccgaggcgcggtgaggggagcgagatgggttacataggtcaccacggtgtcaccactctgcggcgctacaagtacatcggcgacgaccacccgcgcgtcgccaagtatcatattccagccctttttggtcccgattcatcaacatcttccccgctctggttcccacccgcacgtgcattgacacttgactgggtgctatgttccttactgcacctcaccatttccccggtcttttctagcacttcacccccgtctaagatgcatctcccccccccacaagggatttcaccctttgcttcctggaattggcttcctcgtgtcctcaatcagcaacttttcgaatgcctaatttagtgcgcaaaactattgcaagggtggttccccaatctctccttcacgtcccccatttcggtgtattttgttttttagcccaccgcaatgatacatt

SEQ ID NO: 9611 - DNA, 837 bp, Zea mays
  misc_feature: Ceres CLONE 399725-R
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (164)..(164): n is a, c, t, g, unknown, or other
  misc_feature (408)..(408): n is a, c, t, g, unknown, or other
nnnnnnnnnnnnnnnnnnnnnnnnnnnnnnnnnnnnnnnnnnnnnnnnnaaaannnnnnnnnnnnnnnnnnnnnnnnnnnnnnnnnnnnnnnnnnnnnnnnnnnnnnnnnnnnnnnnnnnnnnnnnnnnnnnntttttttttttttttccgattgggtacgggnccccccctcaaggtcgacggtatcgatattttttttttttttttttgttctgcacacaaagcagtaccattatggtgaccagagtgattcataaaatgcaatatagattatgaagatggattgacgtcgtacactccaagaatgagttgaatcaagaagaaagcctgtgagtgcaacgcctacaattcttggcaccacgcctacagtgtttgtgattcccagtagagtagcagtaaggagaggntactcccagcgatgggtgttcacaccctcaagtggcctttgttgcgccctgattgcaccctgatttcctaatccccgtttccacttcccccaggaaacttttacaaaaacgcccgaaggaaagggatccaccgccctgggttggttgggttattattttaagggggttttttttatgtggggccccccccttttgttttttttggggaaaggatattttcccctttttatgggggggggggttttttttcccccccccaatttgggtttttagggggggggaatacccccccgggggttcaccagtgtgggccccccgggcggcttttttttgggggtaaagggggggaatacaaccccccccttttaaaaaatttttgggaaaaaagggggcggggggtatttttttttttgggccccccccagaaat

SEQ ID NO: 9612 - DNA, 779 bp, Zea mays
  misc_feature: Ceres CLONE 399827-R
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
tttttttttttccccccacccggggggactacatacaatttccctctttactttannnnnnacaaatgaggtaccgggccccccctcgaggtcgacggtatcgataatctttttttttttttttcaagattaaactccattcttattatggaacaaagatcattaaacaaaaaattgatagaatcaagttacatatatgcgtaacaattaatgaccaatgtatagttgtatggattcctacacttcagcatttgtatgtccaaccactcactcaacacgtcactcatcctcttattgtccaccattacggttcagtaaactcgtcgacaatttggtgaatgttatggcattcatgaagttgccattctctgcctgcatttccctcccctctaacctatataagccaaataattcctattgggtgtcctggtcagggaccaaaaccagcaacccccgatgtagtgggcacctcacagttaggcaccccgagagcagaagcgagcaaccctgctgttagaagctacctggttgtagctaattagtgctggtgggctgaaaaaatctacaaatgccagcctccttcaacatgattgttgccgccgccattcgccacacgtcatgctaggagctgctggtaggtaggtcactcaactgagattggccagcggagcaggcgatggcgttcccttaagcccgtccgcccgaaacccgaatgcacgcacaccgccattccggcgtggcgttctctgggtataaaaccacccattcgtgaagaacga

SEQ ID NO: 9613 - DNA, 738 bp, Zea mays
  misc_feature: Ceres CLONE 400077-R
  misc_feature: Encodes the peptide sequence at SEQ ID NO. 9614
  misc_feature (738)..(738): n is a, c, t, g, unknown, or other
ccgattgggtaccgggccccccctcgaggtcgacggtatcgataagttttttttttttttttttggtttgattcataatgatgatcatatagcagtaattaatggcagcaccagtggcgacatcaccagtaaaacaagcacctagaacgacacatcagcactctctctaatcctgtccgcccgcatttcctcctccatcgtgcaagctgccgacgacaaatcgcctccgcggtacgactgcaacgaagcgacgaactctcctccgctagccgcccggatttcctcctcgatcgcagattgatccatcagccgtatgaacaaaggcaccctcccatacttgtagtctagtggtatatacagaaacgcctgaagtctgcccctttgaaattagggcatcgaaacctccacagaccacagagtacctatttacgactttcaagactgaagataggacgacattcgtgtacagtagagaggctcccaaccagagtgccatgcaacaactgatactttgaagcgtacccatacgaggagtcaagttttagaaccatcaggaaaatgtatttagagctgaaccttatttctccgttttagttcagttgataaggacaccatcagcccaaacttcaatccagctttccatgaataaggtcatccctccacgttacatggaatacctcaacgatactgtgaaatagagcccccaaacagatctcttaccgtatctccggagaacan

SEQ ID NO: 9614 - protein, 47 aa, Zea mays
  misc_feature: Ceres CLONE 400077-R
RLGTGPPLEVDGIDKFFFFFFGLIHNDDHIAVINGSTSGDITSKTST

SEQ ID NO: 9615 - DNA, 2073 bp, Zea mays
  misc_feature: Ceres CLONE 400176
  misc_feature: Encodes the peptide sequence at SEQ ID NO. 9616
gtcgttctttctagaacctccgctccgcctaatcccttgaccgggtcaagcccgaacgagactagggaggttccagcgccgccggtgggggagatggcgctggagctgagcctggcctcggcttcgccgccggcgggcggcggcttggcgcagccgccgcccctcgccccacccgggaaggagcagcaagtggccggcgtggggattctactgcagatctccatgctcgtgctctcgttcgtcctcggccacgtcctgcgccgccaccgcttctactacctccccgaggccagcgcctcgcttctaattggcttagttgttggtggcctcgctaatatttcaaatacagagaccaacacaaggacgtggttcaacttccatgaagagttcttcttcttgttcttattacctccgataatattccagtcgggtttcagcttatctccgaaaccattctttgcaaactttggggctatcgtaacttttgcaattcttgggacattcattgcttctgttgtaacaggagttcttgtctatcttggtgggctgacatttctaatgtacaaacttccactggttgaatgccttatgtttggtgctcttatatctgcaactgatcctgtcacagtgctatcaatattccaggaactgggttctgatgttaacttgtatgctttggtgtttggagaatctgttttgaatgatgcgatggcaatttctctttacaggacaatgtcatcagtcagaagtcatgcagcaggcggcgagaacttttttatgatgattctccaatttctcgaaacctttgttggttcaatgtcatcaggtgtgggagttggatttatctctgctcttctattcaaatatgctggattggacgttgataatctgcagaacttggagtgctgcctttttgttctctttccttacttttcgtacatgttagcagaaggacttggcttgtcagggattgtttctatattattcacagggatggttatgaagcattacacatattccaatctttcagacaactcacagcgctttgtttctgccttttttcatttactatcatctttagctgaaacatttgtgttcatctatatgggtttcgatattgccatggaagagcatagctggtcacatgttggcttcatcttcttctcaattatattcatagttgttgcaagggctgcaaatgtcttttcttgtgcatacttggttaacatgtctcggccagaacatcgccgtatacctgtaaaacatcaaaaagcactttggttcagtggtcttagaggggccatggcttttgcacttgctctccaatctgtgcatgaacttcctgaaggacatggaaaaacgatattcaccaccaccactgccattgttgttttgacggtacttctcattggagggtcgacaggaactatgcttgaatctttggatgttgttggagatgaaaacacatcaagagaaaattacgaggacaacaatggttacatgcctccaagttatgaagaaggaacatcctctggaggaggattgagaatgaaactcaaacagtttcacaaaagcacaacatcattcactgcccttgacaagaactatctcactccattttttaccagtcagacagatgatgataacgatgacgacttcagtcagcaaccccaaaaccgaagactagctttttatgatcaatagcggaatttgatcctctacatatcaagctaaatacacggagcagaactgacgtgcatgactatgtctatgtgtgattgggtcgaacaaaatatagcaggagcatacttagttgagtagcatatggcagagcatatctgtataccgtaggacaaaaatcataagggttcgaatcagttgttcccatgggggatgaggatgatgatagccaggcagcatgtatatatttctaggcttccttaagaacttagtggggctccagatgaaaagcagtgtgttgttggaattttatagaccctacctcgtgttaggttaattttaataaacccgaccgtttgtccgctaagtcggctattaaaaaaaaaaaaaaaa

SEQ ID NO: 9616 - protein, 536 aa, Zea mays
  misc_feature: Ceres CLONE 400176
  misc_feature (42)..(449): Pfam Name: Na_H_Exchanger Pfam Description: Sodium/hydrogen exchanger family
MALELSLASASPPAGGGLAQPPPLAPPGKEQQVAGVGILLQISMLVLSFVLGHVLRRHRFYYLPEASASLLIGLVVGGLANISNTETNTRTWFNFHEEFFFLFLLPPIIFQSGFSLSPKPFFANFGAIVTFAILGTFIASVVTGVLVYLGGLTFLMYKLPLVECLMFGALISATDPVTVLSIFQELGSDVNLYALVFGESVLNDAMAISLYRTMSSVRSHAAGGENFFMMILQFLETFVGSMSSGVGVGFISALLFKYAGLDVDNLQNLECCLFVLFPYFSYMLAEGLGLSGIVSILFTGMVMKHYTYSNLSDNSQRFVSAFFHLLSSLAETFVFIYMGFDIAMEEHSWSHVGFIFFSIIFIVVARAANVFSCAYLVNMSRPEHRRIPVKHQKALWFSGLRGAMAFALALQSVHELPEGHGKTIFTTTTAIVVLTVLLIGGSTGTMLESLDVVGDENTSRENYEDNNGYMPPSYEEGTSSGGGLRMKLKQFHKSTTSFTALDKNYLTPFFTSQTDDDNDDDFSQQPQNRRLAFYDQ

SEQ ID NO: 9617 - DNA, 657 bp, Zea mays
  misc_feature: Ceres CLONE 400268-R
  misc_feature: Encodes the peptide sequence at SEQ ID NO. 9618
cgaattgggtaccgggccccccctcgaggtcgacggtatcgataagcttttttttttttttttttgcaggaaggatctatatttatatgcataaagaaaaacatattgcagcacctagctatacgtcttgctgagcgcaaatctacagcaccgtaacttgcacggttgcgtgaactttgaggtgttgaagcataaagacagcaaccatctacccaaatggtacaaatgtacaatttctcagtacgagccttcttgtccgctggtacaaccacaaccactacccaacccagtttctgaaaaagccctctgcagcgatctactttgctcttctcggcacgaacaatacaaccagctagctagtcactagttttcagtcaccaaaggtgcgtgtgcgtgcttgtacagcaactaatttaattagcctcttgtcctcacgatggttatcgtgcctctgccagcggtgcggagcctggtgaagccggccaccgtcctgcccgacggccccggccggttggcagccgacacgcgtggggcgcacgcgaactcccccacggggtgccggacggggcgagccggcggcgtgaggatccaccggttgatgtcggcgagcgtcaccccgccgtcccgcgccgccgggcttcaccacggcgaacggat

SEQ ID NO: 9618 - protein, 73 aa, Zea mays
  misc_feature: Ceres CLONE 400268-R
MVIVPLPAVRSLVKPATVLPDGPGRLAADTRGAHANSPTGCRTGRAGGVRIHRLMSASVTPPSRAAGLHHGER

SEQ ID NO: 9619 - DNA, 817 bp, Zea mays
  misc_feature: Ceres CLONE 400384
  misc_feature: Encodes the peptide sequence at SEQ ID NO. 9620
accagtcaccacaatggcgtctgaatccgaggcctgcagctgggagccgcacctgctccaccccaacggcactgagccgctgcaccggatcgccgtggactactgcccggaggcgtgcctccacgagcgccacgcgggggagatccacgtcacctacgacgaccgcggcggcgcgcgctggcgctcctgctgccggttcctgcccggcagcgccgtggccaccacgatccgcgcgccggcgggggacacgtcgggactcaactacaatatctacttgtcctccctggagggttccgccgaccaggacgagatcgacttcgagttcctcggccacgacaagcgcgctgtccagaccaactactacgtcggcggcaacggcgggcgggagccgtggccggagaagcccatgtacctgtacgcctccgtctgggacgccagccacatcgccgatggggcgtggaccggcacgtaccacggccgcgacgcgccctacgtctgcagctacaaggacgtcagggtgcccactgctgagcattcagtggaagacgccgctcatgcgcccgctggcgatcctgtcgccgctgacgctgccgcggcggcggaagaagagaaggacgccggagcaggtgaagtttagatcttggtggtgcaatggaatgtcttttgagtgtctctgcaattaaaaagatctatgaataatggatgcggcctcatcggtgaaaaaaaacatttcagctgctgtatttatgttgttcgttgctcaatggtcaatgtgctctgtttactgttttgcactaaaataaaaaaaaaaaaaaaa

SEQ ID NO: 9620 - protein, 207 aa, Zea mays
  misc_feature: Ceres CLONE 400384
  misc_feature (22)..(151): Pfam Name: Glyco_hydro_16 Pfam Description: Glycosyl hydrolases family 16
  misc_feature: SWISSPROT Homolog: EC 2.4.1.207 Xyloglucan:xyloglucosyl transferase
MASESEACSWEPHLLHPNGTEPLHRIAVDYCPEACLHERHAGEIHVTYDDRGGARWRSCCRFLPGSAVATTIRAPAGDTSGLNYNIYLSSLEGSADQDEIDFEFLGHDKRAVQTNYYVGGNGGREPWPEKPMYLYASVWDASHIADGAWTGTYHGRDAPYVCSYKDVRVPTAEHSVEDAAHAPAGDPVAADAAAAAEEEKDAGAGEV

SEQ ID NO: 9621 - DNA, 2409 bp, Zea mays
  misc_feature: Ceres CLONE 400469
  misc_feature: Encodes the peptide sequence at SEQ ID NO. 9622
aaacagcgtcggctcgccgtctccctccctccctccagatctcggcgcgagttcacccttcagatttccatttccaacacgacggcgaagaagaagagctgcgatccggaggagtaaaccctacccgccggttgcccggtgcgcgggcgagatccgggcggagatctagggcgcggcgccggccatggcgagctccggactcgcttaccccgaccgcttctacgctgccgcggcttacgctgggttcggagccggcggggccacctcctccgcagctatctcccgcttccagaacgacgtcgccctcctcctctacggcctgcaccagcaggccacggttgggccattcaatgtgcccaagccaagggcgtggaaccccgtggagcagagcaaatggactagctggcatgggcttggaagcatgccttcagcggaggcgatgcgtctttttgtcaaaatcctagaggaagaagatcctggatggtactctagggtccctgagttcaaccctgagcctgttgtagatattcagatgcataaaccaaaagacgagccacaaagtgtaccggcttcaacaaatggaacatcaatttcagaaccaaaaatcatttctgaaaatggaagttctgtggagactcaggacaaagatgttattctggaaggccttagtactgttatttctcatgatgagtggactccattatctgtcagtggtctccgtccgaagcctcgttatgagcatggagcaactgtgttgcaaaataagatgtatatatttggtggaaaccataatggacgttacctcagtgaccttcaggctttggatctgaagagtttgatctggtccaaggttgataccaaatttcaagcagaacctgctgactccactaaaaccacacaaattcctccatgtgctggtcattctttgatttcttggggtaacaaatttttatctattgctgggcatacaaaagatccatctgaaggcattacagtgaaggaatttgatccgcatacttgtacctggtcaattgccaagacttatgggaaaccaccggtgtctcgtggaggtcaaacagtgactcttgttggaacgacactagttttgtttggtggtgaagatgcaaaacggtgtctcttgaatgacttgcacatccttgatcttgaaaccatgacatgggatgatgtggatgcaataggcaaccctccttctccaaggtcagatcatgctgctgcttgccatgctgaccgctatcttttaatttttggtggggggtctcatgcaacatgtttcaatgacctacatgtccttgatttgcagacgatggaatggtcaagacccaaacaacaaggcctgactccaagcccaagagctggacatgcaggtgcaactgtcggtgagaactggtacatagttgggggtggcaataataaaagtggtgtttctgaaacactagtgctcaatatgtcaactctgacatggtcagttgttagcactgtggaaggacgtgttcctcttgccagtgagggcatgactttagtgcatagcaattacaatggttatgattatctcgtctcttttggaggatacaatggacgatacagcaacgaggtttacactcttaaactcagcctcaaatcagattcacagccaattgtagaagaagaaactgtctcagatactatatctagggtcagagaacctgagaccgaaatttctcaagatgggaggatacgcgagattgccatggacagtgccgattcagacctgaataacagaaatgatgaagcaagtgaacagcttgtagcagatcttaaagctcagaaagaggaactagaagcaacaattaacagggaacagctgcaaactgtgcaacttaaagaagacattgctcaagcagagaccagaaatgcagagctgacaaaggaacttcaagctgtccgtggccaacttgcttctgagcaatcaagatgtttcaaacttgaggttgacgttgcggaacttcgacaaaagcttcagagtatggacgccctggaaaaggaggtcgaactgcttcggcgacagaaacctgcttcggagcaagcggcgctggacgcaaagcagaggcaaggttcgggtggtatgtggggttggctcgctggaagtccgccaccatcacagtagttcgtacaggccgtggttcatatattttacttgtaacattacttatcatttgacatttgtctacattttttttgtcacatggcattcgtgtttcgttttgaccacacaaagaacaacgtgctctggcgagcgttatattgtgctcatagagaatcgttaggttgccccctcacaatcactcaaatgtatcattaggttttaacaatgtactgatcatgtatgaacttccaaaaaaaaaaaaaaaa

SEQ ID NO: 9622 - protein, 659 aa, Zea mays
  misc_feature: Ceres CLONE 400469
  misc_feature (182)..(227): Pfam Name: Kelch_2 Pfam Description: Kelch motif
  misc_feature (293)..(339): Pfam Name: Kelch_2 Pfam Description: Kelch motif
  misc_feature (344)..(390): Pfam Name: Kelch_2 Pfam Description: Kelch motif
  misc_feature (395)..(440): Pfam Name: Kelch_1 Pfam Description: Kelch motif
  misc_feature (8)..(97): Pfam Name: ACBP Pfam Description: Acyl CoA binding protein
  misc_feature (320)..(491): SWISSPROT Homolog: EC 3.1.3.16 Phosphoprotein phosphatase
  misc_feature (37)..(98): SWISSPROT Homolog: EC 5.3.3.8 Dodecenoyl-CoA isomerase
  misc_feature (479)..(658): SWISSPROT Homolog: EC 5.2.1.8 Peptidylprolyl isomerase
MASSGLAYPDRFYAAAAYAGFGAGGATSSAAISRFQNDVALLLYGLHQQATVGPFNVPKPRAWNPVEQSKWTSWHGLGSMPSAEAMRLFVKILEEEDPGWYSRVPEFNPEPVVDIQMHKPKDEPQSVPASTNGTSISEPKIISENGSSVETQDKDVILEGLSTVISHDEWTPLSVSGLRPKPRYEHGATVLQNKMYIFGGNHNGRYLSDLQALDLKSLIWSKVDTKFQAEPADSTKTTQIPPCAGHSLISWGNKFLSIAGHTKDPSEGITVKEFDPHTCTWSIAKTYGKPPVSRGGQTVTLVGTTLVLFGGEDAKRCLLNDLHILDLETMTWDDVDAIGNPPSPRSDHAAACHADRYLLIFGGGSHATCFNDLHVLDLQTMEWSRPKQQGLTPSPRAGHAGATVGENWYIVGGGNNKSGVSETLVLNMSTLTWSVVSTVEGRVPLASEGMTLVHSNYNGYDYLVSFGGYNGRYSNEVYTLKLSLKSDSQPIVEEETVSDTISRVREPETEISQDGRIREIAMDSADSDLNNRNDEASEQLVADLKAQKEELEATINREQLQTVQLKEDIAQAETRNAELTKELQAVRGQLASEQSRCFKLEVDVAELRQKLQSMDALEKEVELLRRQKPASEQAALDAKQRQGSGGMWGWLAGSPPPSQ

SEQ ID NO: 9623 - DNA, 1077 bp, Zea mays
  misc_feature: Ceres CLONE 400559-R
  misc_feature (1)..(1): n is a, c, t, g, unknown, or other
  misc_feature (160)..(160): n is a, c, t, g, unknown, or other
  misc_feature (334)..(334): n is a, c, t, g, unknown, or other
  misc_feature (856)..(856): n is a, c, t, g, unknown, or other
ntttggtgttttttttttaattaaactattataaaatagataaaaaagaagataattatacaaaatatctattgggttccgggccccccctcgaggtcgacggtatcgataagcttttttttttttttttttgacaagtaaaaggttttgttgtcccttngaaatatagtagcacaaaaagcgggaacaaaggggcgccccttcaaatttcatgttgaaatatcaaggctgcaaagatgtcgatttattcggtggtctgcatcggcgtcgtaccctgtgcatggtacttctccaactcagcatcaagttcttcagcagaccttggctgactacnctctttcccacgacgaccgccagatccactgcctccgccaccgccacggcgacccctcccaccccttgcacggagtctgttctgtggcaaactagctgagacaccccttggtgcactcttagcaacattcctagcataaaatgcgccccccccccccccaattgcggctgggagcaataaggaagtgttagtcccaaagaatcccctatttttcatagggtttggccatcaaattgggaacattgttgtaatttccctcagcggcgttcaaacagcattcaaccaacgcccttggcagaatataaaaccctccagcttggtttcccctttaaaaacctcccccactctttcggggccatatagaaggaaaatcaaagggcaattcggcttttcagcaattccaacccccaaacgttcggtaaaaaaaaaaaaactccccatttgaaagagtctcctctcccggctaggaaaaaacccccccaaaaattcccaaaattttgtggtggtaaagaaaaagaaccntttgggatgcgcgcggttactcccaattaatcccaataaaaaccttttctcgtaccagtctagacaggcattttttaggactaaaaggggttcgcacaaatataaatgattataggggttaaccaactccacaaatttcctggggggctcttttcgtaggtatgggataagaggaaccccacccttttttccccccacacgccttttagagcggcgccccg

SEQ ID NO: 9624 - DNA, 911 bp, Zea mays
  misc_feature: Ceres CLONE 400816
  misc_feature: Encodes the peptide sequence at SEQ ID NO. 9625
aaaaaataggttgggttcgtaaactctgaatccctcatttttttctttttcatcatgaacatgagattgtttggtctatggctaattggtggctcactgcagcaaagtatatataactggattctaatggttgtggcaatccatagttcaaggggagctatgcgacaacagttgaatagagacagggaaaaatatttggccatcgtttgaacattgagaccaactatggttatatctgaaagtatgtaaggatataatgtagggaaaaaataacaacatataatatggaatccattctgtactatgacttagagcagataaattctctttcttttatttccattttgtcattacaatttgctagagatgcacggtcatcttatgagctgcatattttacctggatttccatagtcagctacatattttacctggatttttcatgagctgcacggtcatcttatgaaacaccagcatcctttcgcagtatttatcatacaacaaattgagcaggatgtttgtcgtcgctgatgcccgcctcgagccaagcctacaactgcatgtcaggagctacaaccaagcatataagagaacatccatattccatagtaaacataatcgactgacatcgaagaaagaaaggtactccattgtagtcagcgacatcccgtccaagggcaatggggcctacactggcatcactggcggtgtttgcaccagcagcgtgggtttcccatcttcagggattttcgtcaagaataccggatccgatgggatgatctgcgttggcgtcattggctgaccttgttgtgcccgaggactataggagatgtttgcaatgccgccaatggcgctcctgtcgagcaactccaagtatacagtggcaggcattccgcaaaaaaaaaaaaaaaa

SEQ ID NO: 9625 - protein, 95 aa, Zea mays
  misc_feature: Ceres CLONE 400816
MFVVADARLEPSLQLHVRSYNQAYKRTSIFHSKHNRLTSKKERYSIVVSDIPSKGNGAYTGITGGVCTSSVGFPSSGIFVKNTGSDGMICVGVIG

SEQ ID NO: 9626 - DNA, 693 bp, Zea mays
  misc_feature: Ceres CLONE 402442-R
  misc_feature (147)..(147): n is a, c, t, g, unknown, or other
  misc_feature (337)..(337): n is a, c, t, g, unknown, or other
  misc_feature (376)..(376): n is a, c, t, g, unknown, or other
  misc_feature (392)..(392): n is a, c, t, g, unknown, or other
  misc_feature (438)..(438): n is a, c, t, g, unknown, or other
  misc_feature (440)..(440): n is a, c, t, g, unknown, or other
  misc_feature (441)..(441): n is a, c, t, g, unknown, or other
  misc_feature (493)..(493): n is a, c, t, g, unknown, or other
cgattgggtaccgggccccccctcgaggtcgacggtatcgataagcttttttttttttttttttgtaagctaaaaagtcacactggcgtggtattgttattacatcttcatatttacacagtacagccatgagaattagcacagacnagagacaacgcagcagaggatctcgagctgaagcggagcccagatccagaaactgcgcgagacgaacaccaaagcaaactgcatcgattcaagaaagggaactctttttttcgtgcctatttttcccccctgtgcaagatgtgacactgactgagcagcccgtcgtggatgaacggatctggtccttcancgcggctgctggatggggcgggggctcaccctggcgcgngggcacccctcgcggngccttctccgcgtacctcggggtctcgggggccaccatgcgccctncnnacactgtcgatgccccaggccgccactcaagccctcggcccgccctctgccnggggggtcctcccggtcgctccgtagggcggggccggaggcaaaaaaatcctcggggaggaaactggcaactcctcctcccagtctccccggggtaagataagcaaggggcccaaatccccaaaccaggtttcgaaaaggccgggaaggggaaccccaggccccccccggggggaaaagccccccccccggggcccgggc

SEQ ID NO: 9627 - DNA, 826 bp, Zea mays
  misc_feature: Ceres CLONE 402623-R
  misc_feature: SWISSPROT Homolog: EC 4.1.2.13 Fructose-bisphosphate aldolase
  misc_feature (82)..(82): n is a, c, t, g, unknown, or other
  misc_feature (83)..(83): n is a, c, t, g, unknown, or other
  misc_feature (87)..(87): n is a, c, t, g, unknown, or other
  misc_feature (89)..(89): n is a, c, t, g, unknown, or other
  misc_feature (123)..(123): n is a, c, t, g, unknown, or other
tttgttttgggtgtgttgttttttatacagacaaaaaattgtggatacacatatttggtttataaggcaattttattgtttnntttngntttttttgcaattgggtacccgggccccccctcnagtttttcttttgcttctttcgcacttgatatgcgaatgtaatgattaccttcatccacatcggaagcgtgtgtttttcatgacctagtataaaagctctttccagcaaacaacactctgcaaccttactctggggcagtgagttccaaaacaacgggatcgccacagacaagcaactaaatacttgtagtccttaacatcaaggctctcgatgtccgcggccacctcgcccttgtttgtgccgagggtatcctcctagtcggccttgcacctgaaaaggaagggcgctatatccttgtccacgttctccaccttgccaaaccacgccttgagggtgctcccctgtacggcacggacgaagaaaaatgacaggggccatgggttcctcgtgctcaggttgttcatggctttgaaatgatcggtgaggctcctccttctttctgtccggccgaagaagaaaacaacgcctggcacagacagcaagagacagttcctcttggagggtactgtacggcgatacttggggccgaacctccctcgacgtgggtcaccctttttcttggaagtcccgaaggcccaggaagctcccccctttgttttgggggcccttccagggtaagggggttatctcccttactcccccgagagggaacaatttggaatgggccgtcccgttttgagaagtgaagaccccctttgggta

SEQ ID NO: 9628 - DNA, 675 bp, Zea mays
  misc_feature: Ceres CLONE 402752-R
  misc_feature (1)..(1): n is a, c, t, g, unknown, or other
ncaattgggtaccgggccccccctcgaggtcgacggtatcgataagcttttttttttttttttttacgagtgaactcggaactacccccagacaattgtgtttctgtacaagtcattcccagattcccttttgtgttccatttcttgcagagagaaagccattccaagattccctttcttctgtgtcccattccatgcaaagaacggcttcgatgatcttaagtttcaaaaaaaaaaagcaaaggttttctgttagattttacccagcttctttggataaggttcttaacaggccttttttggtagctctactcttcagccttctcagacttctgtagtggaagagatctaccacgtcccagtatgaagccccttgttccatctggcatcctcggtccagaaataggcttgtttaatgactcggaaccacaactgccttgtttgtttgcattttgctgctacataagtaaccagaaaactaggtacaccccacttctgtttacttatgtagcaacaaatacaaatacaagtaaaaagaaaaagaaaagaaaaggagttcctgtggtttcagagtcaccagctagctgtgaggtttgcatccaccagcagcaatccctaagccaacaacgaccgctactctctggacattccagtcccagctacttattccaaaga

SEQ ID NO: 9629 - DNA, 854 bp, Zea mays
  misc_feature: Ceres CLONE 403559
  misc_feature: Encodes the peptide sequence at SEQ ID NO. 9630
attgcgattaccgtttcctcactgccctttcctttttcggtcggcagcaatcaccggggcaagcgaaccctcgatttgcgtccccgctctctgctagcgcccctaaaagaggagcgaagcgatgtctatgccggagacgggtcaggccgcggagagggatgagcagcagcagtcccgagggatagcactgatgcagggcatctgcgccgtggtgtaccgcaaggccgataacacgccctgccccatcaagcagggtctctacttgggatctgttggagcagcattcaataaggacgctctcaagagcttgaacatcacccatatcttgatcgttgcaaagtcactggatccagtatttccagctgaatttaattacaagaagatcgaagatgaagctataagctctggaggcaatgttttggtccattgctttgctgggcggtcaaggagtgtgacaatcgttgttgcatatctcatgaagaagcatcaaatgagcctcgaaagtgccttgtcactagttagaagtaaacgacctcaagtggctcctaatggggggtttatttcccagctggagaagtttcagaaatccttgcaagtggagcaggaacggagaatgcaacctgtgcagcactgataattatactagtgttataataggtgcagaaggcctcatatgttgtgaaggcgtatgcgttgtaagagcgtcttgaccgcgtattatggcatctggataacaagcgaggccttggcaaactttatgatgtaaacagcaagcaacgttgttcatccattgggatgcagtttacatgttgaataaaaaaaaaaaaaaaaaaaaaacaaaaaaaaaaaaaaaa

SEQ ID NO: 9630 - protein, 170 aa, Zea mays
  misc_feature: Ceres CLONE 403559
  misc_feature (38)..(155): Pfam Name: DSPc Pfam Description: Dual specificity phosphatase, catalytic domain
  misc_feature: SWISSPROT Homolog: EC 3.1.3.48 Protein-tyrosine-phosphatase
MSMPETGQAAERDEQQQSRGIALMQGICAVVYRKADNTPCPIKQGLYLGSVGAAFNKDALKSLNITHILIVAKSLDPVFPAEFNYKKIEDEAISSGGNVLVHCFAGRSRSVTIVVAYLMKKHQMSLESALSLVRSKRPQVAPNGGFISQLEKFQKSLQVEQERRMQPVQH

SEQ ID NO: 9631 - DNA, 2972 bp, Zea mays
  misc_feature: Ceres CLONE 403648
  misc_feature: Encodes the peptide sequence at SEQ ID NO. 9632
gtcgaacactccacgccgctctagcactctctgcgctctcccatcctcctcgctagccgtactcttcaccgccgaagcttctggttcctcatcgccgccgctacgcgtgagatcgacccgccgccgtcggtctttttccctgactggtaatctagtgttcattctcttaattcaaatggtttcctcccacggagcaagatgaggaaatattcaaactgctcttagccgtgtagcacgacaagtttgttgcagagctggtctacgacaggtggacagctgggatttcttggcactttgtcaagtccacgagtagaagtgtggtggaagattgtcttcgttcaagatgatgcagaggccactgctccgtccggaggagtactccttgaaggagacctcacctcaccttggtggtgcagctgctggtgacaagctcaccaccacctatgacctggttgagcagatgcagtacctttatgtaagagttgtaaaagcaaaggaacttccaaacatggacatcactgggagctgtgacccgtatgttgaggtgaagctaggaaattataaggggcaaactcagcatttcgagaagaagaacaacccagagtggaatcaggtctttgccttctcaaaggagcgtattcagtcatcagttgtggagattgtagtcaaggacaaggatcttgtcaaggatgacttcattggccgtgttatatttgatctgaatgaggtcccaaagagagtgccacctgatagcccgttggctccacagtggtatcggttggaagaccgaaatgggcacaaggtgaagggggagttgatgttggctgtttggatgggcactcaagctgatgaagcaytccctgaagcatggcattctgacgcagcctcggtccctggtgatggccttgcaagcattagatcgaaagtgtatcttactccaaagctttggtatctccgtgtcaatctcattgaagcccaggatcttataccaaatgacagggccaggttccctgaagtttatgtcaaagcaatgctaggcaatcaagtcctcagaaccagggcaccgagccggaccttgaatccaatgtggaatgaagacttgatgtttgtcgcagctgagccatttgaagaacacctaattttgagtgtagaggacagggtggccccaggaaaggatgaagtaattggaaggacaatgatttcactgcaccatgtaccccggaggctggatcacaggttgctaaccagccagtggtataaccttgagaagcatgtgattattgatggtgagcagaagaaagagaccaagttttcaagtcgsattcacttgagaatatgcctcgaaggtggatatcatgtcttggatgagtcaacacattacagtagtgatttaaggccaactgcgaagcctctgtggaaacctagcataggcatgcttgagcttggtatcttgacagcacaaggcctgttgccaatgaagaccaaggatgggcgtggcacaactgatgcgtactgtgttgcaaagtatggacagaaatgggtgcgtactaggactataatcgacagcttcactcccaaatggaatgaacagtacacctgggaggtgtatgatccatgcactgtggtcacaattggtgtatttgacaactgccacctgaacggcggggaaaaggtcaatggtgccagggataccagaatcgggagggtccgcatccgtctctcgacgcttgaaactgatcgggtgtatacccactcataccctcttattgtcctgacacctggtggcgttaagaagatgggcgaggtgcagcttgctgtccgtttcacgtgttcgtcactgctcaacatgatgcatctgtacacacagscccttgctgcccaagatgcactacgtgcacccgctgtccgtgatgcaggtggacaacctcaggcgccagccacgaacattgtctcgacaaggctgggccgcscagagccaccgctgcgaaaggaaatcgtggagtacatgctcgacgtggactcgcacatgtggagcatgaggaagagcaaggcgaatttcttccgcatcatgagcgtcttgagccccttggtcgcggtgacaaagwggttcgatcagatctgccgctggaggaacccactgaccaccatactgatccatgtcctcttcatgatactggttctttacccasagctgatactgcccacagtcttcctctacctgttcctgataggggtgtggtactaccggyggcgtctgaggcagccgccacacatggacacccgcctctyccacgcggagactgcccaccccgacgagctggacgaggagtttgacaccttccccacttcccgcccgccagacgtcgtgcggatgckgyackacaggctgckcagcgtcgcggggaggatccasaccsyggtcggcgaccttgcgacgcagggcgagcggttgcagtcgctgctgagctggagggacccgagggccaccgccctgttcgttgtcttctgcttcgttgccgccatcgtgctgtacgtcacaccgttccgggtcgtggtcttcctcgcgggcctgtacatgctgaggcaccccaggttccgccacaagatgccgtccgtcccgctcaacttcttcaggcgtctgccggcgaggactgacagcatgctgtaggttgtgggcttgtggcagatgcctggctccattgctggttcagtggtttcacccgtcagttgcagctcacagatggtcactctcctaaggtagtgtatccgaaaacaatgaactgccagctatcttcgtgacttttgtagcttctctctgtcgcatggttggttatgtattcagatggttgtgaaccattcctgtagctaggtatgcgtgatgcatgatgcttgaaaactccgggcgttggttaagttattgctttacctaaaaaaaaaaaaaaaaaaaaaaaaaaacaaaaaaaaaaaaaaaa

SEQ ID NO: 9632 - protein, 774 aa, Zea mays
  misc_feature: Ceres CLONE 403648
  misc_feature (619)..(774): Pfam Name: PRT_C Pfam Description: Plant phosphoribosyltransferase C-terminal
  misc_feature (43)..(123): Pfam Name: C2 Pfam Description: C2 domain
  misc_feature (204)..(285): Pfam Name: C2 Pfam Description: C2 domain
  misc_feature (365)..(456): Pfam Name: C2 Pfam Description: C2 domain
  misc_feature (172)..(172): Xaa is any aa, unknown, or other
  misc_feature (326)..(326): Xaa is any aa, unknown, or other
  misc_feature (509)..(509): Xaa is any aa, unknown, or other
  misc_feature (543)..(543): Xaa is any aa, unknown, or other
  misc_feature (588)..(588): Xaa is any aa, unknown, or other
  misc_feature (616)..(616): Xaa is any aa, unknown, or other
  misc_feature (636)..(636): Xaa is any aa, unknown, or other
  misc_feature (649)..(649): Xaa is any aa, unknown, or other
  misc_feature (678)..(678): Xaa is any aa, unknown, or other
  misc_feature (679)..(679): Xaa is any aa, unknown, or other
  misc_feature (680)..(680): Xaa is any aa, unknown, or other
  misc_feature (683)..(683): Xaa is any aa, unknown, or other
  misc_feature (690)..(690): Xaa is any aa, unknown, or other
  misc_feature (692)..(692): Xaa is any aa, unknown, or other
MMQRPLLRPEEYSLKETSPHLGGAAAGDKLTTTYDLVEQMQYLYVRVVKAKELPNMDITGSCDPYVEVKLGNYKGQTQHFEKKNNPEWNQVFAFSKERIQSSVVEIVVKDKDLVKDDFIGRVIFDLNEVPKRVPPDSPLAPQWYRLEDRNGHKVKGELMLAVWMGTQADEAXPEAWHSDAASVPGDGLASIRSKVYLTPKLWYLRVNLIEAQDLIPNDRARFPEVYVKAMLGNQVLRTRAPSRTLNPMWNEDLMFVAAEPFEEHLILSVEDRVAPGKDEVIGRTMISLHHVPRRLDHRLLTSQWYNLEKHVIIDGEQKKETKFSSXIHLRICLEGGYHVLDESTHYSSDLRPTAKPLWKPSIGMLELGILTAQGLLPMKTKDGRGTTDAYCVAKYGQKWVRTRTIIDSFTPKWNEQYTWEVYDPCTVVTIGVFDNCHLNGGEKVNGARDTRIGRVRIRLSTLETDRVYTHSYPLIVLTPGGVKKMGEVQLAVRFTCSSLLNMMHLYTQXLAAQDALRAPAVRDAGGQPQAPATNIVSTRLGRXEPPLRKEIVEYMLDVDSHMWSMRKSKANFFRIMSVLSPLVAVTKXFDQICRWRNPLTTILIHVLFMILVLYPXLILPTVFLYLFLIGVWYYRXRLRQPPHMDTRLXHAETAHPDELDEEFDTFPTSRPPDVVRMXXXRLXSVAGRIXTXVGDLATQGERLQSLLSWRDPRATALFVVFCFVAAIVLYVTPFRVVVFLAGLYMLRHPRFRHKMPSVPLNFFRRLPARTDSML

SEQ ID NO: 9633 - DNA, 774 bp, Zea mays
  misc_feature: Ceres CLONE 403971-R
  misc_feature: Pfam Name: PP2C Pfam Description: Protein phosphatase 2C
  misc_feature: SWISSPROT Homolog: EC 3.1.3.16 Phosphoprotein phosphatase
  misc_feature (774)..(774): n is a, c, t, g, unknown, or other
cgattgggtaccgggccccccctcgaggtcgacggtatcgataagcttttttccttttttgcttgaacatcgctcgagccactccagcatgcattttctctgaaaaagaaaattgtgtaggtacacgctgctgcatctacagtacgtacgggcacaagcacaaccaccatctttacaatcacaaacccaagaaactacaaggtcgactgaagcttcaccgtctctcaggggctgcccagttcttgctatcctagctctttccgtcgcgctagttacccggtgatcttcagtcatatcgatcgtcttgccgttgacactcatgacgcatgcagagtcaccaagaatagcgcactgggcaaacaaaactttattctggtcaaaccaaataagaaagggtgtgccctgaacatccctcgaactgaagatcaatgggggcctccggccaaagaaaaagcttatctaaaaaactccaaacgctccgaaatatgttggcccccctccttttgttccggagtggaaaaaagggttccccaaaggtccgggaaaattctggggtgaaggttttaaagattccctccccccccgggggcctttaaaaatttccaaaggcgcccaaaggggtccacccccccgaaaagaacccgtggcaaaaactttatggcccccctggggaaagtttttttttcccctcttaaggggggcaccccttggggggcgggtggcgcccacccccccacccggggggaaacccctggtatttgtcgggaaaaaaan

SEQ ID NO: 9634 - DNA, 856 bp, Zea mays
  misc_feature: Ceres CLONE 404081-R
  misc_feature: Pfam Name: Ribosomal_L36e Pfam Description: Ribosomal protein L36e
ccaattgtgtaccgggccccccctcgaggtcgacggtatcgataagcttttttttttttttttttagtaataaaacaaaggcaccaaactaaaaatcttaaaaagattggtcttctcagaatagaaaccacgggcttaagagcgtcaaatttaatagttccaaaatccaacacaatggccatagctctataggtacggactggtaatacaggaccgagttttcggataaaattcaccaactagccacgctctatttcttcttgtcaccagcaccaccaccaccagcagacctcatcttcctaaggacacttgacatctcctctctcttcttctttgctctcttgtgagtaccaagctttctcttggcgaccttgagtgcacgcttgtcctttccaacccttagaagctcagtgatacgtttctcatagggagcgaatccagcaacctccctaatcaagttcctgaccaaatgcacccctcttggtacctttcccccttgcggtcggaacgggcgtggcggcagctccccgcttggtgacaacctgggccctggttaatgcccacaaagaagcctgaatttgggcggcaaaggggccattgggccggattcccactttgctcccggttaacctggaaagggacgccccccaagggtttcctaccaaccgattctgaaacaaaaaatcccccaaatttttccaaaaaaaaagtgttcaaggggaaaggggccccggggcgaaatattccggcaccccccgggggaaccccccaatttttttaaaaggggccccccccacccgcgggggggaaaccccccacctttttttttccccctttataagagaaggaaaaaaaa

SEQ ID NO: 9635 - DNA, 597 bp, Zea mays
  misc_feature: Ceres CLONE 406945-R
  misc_feature: Pfam Name: DUF89 Pfam Description: Protein of unknown function DUF89
  misc_feature: SWISSPROT Homolog: EC 2.7.1.33 Pantothenate kinase
tcgaggtcgacggtatcgatattttttttttttttttttcgctggctcaaacttttcccttcaatatttctggaaagagcctttagagcctttattatatcgtttcagaaaacactgttattgttttattgaaagggcgtttcttgtaccccgtacatggaaggatcggttatgccgtacgctgtatgattgtttctgtctcaccggctacaccaatcaagctgcttctgctagttgctgcaagatgacacaacctccgcagtcgctaccatgttgttaaggaactggttcaaatttacagatgcagtcgtatagactcccattgaagagtttttctgccaatcgctgattcttgaccatagcaagctttagagcatcacacttaaaacgggcattgaggttggtatgcagtgatcgccccatgccttctaaaattaacaaatctgcatcctttgcagcagcagcaagctctgagctaacctgccggaaatcaatacatggactgccgcatccattctcaacaaccattagtggcactgacactgtctcatccttgagatcatcttggatgccagccattgcatcgactatcaatcc

SEQ ID NO: 9636 - DNA, 872 bp, Zea mays
  misc_feature: Ceres CLONE 407091
  misc_feature: Encodes the peptide sequence at SEQ ID NO. 9637
ctcagctaaaaacgaaacagggaagtgccaaccaaactagccaaacaagtggtaataccacggccctttggcgacaggcgacagcaacagtgaaacgccccgctcccaagccggcaaacaccagcccccgcgacggcgccgcgccgtcctctcccgaccgacggcaacggaaaccctggtgacttctgatacaggaagattacttttatctatactccaccttcttttgtggctatggcactagcagctatctataaccttttcatcattaacaaatccggcggccttatatactacaaggactatggttcagcagggaggatggataccaatgacagtttaagattagcaagcctctggcattcgatgcatgctatctcgcagcaactgtcccctaccactggctgtactggcattgatctcttacaagctcataactttgatctccattgctttcaatccctcacagggacgaaatttttcgtcgtatgcgaaactggagctccaaatgtggaaatgctgctgaaagcgatttacgagctgtacacagacttcgttctgaagaatccgttctatgagatggagatgccgattcggtgcgagctgtttgaccacaacctggctcaggtgatccagaaggaccgcgttgcgctcctgggtcggtgaaattggaaagcttttggtcctaaccataccatgtatcttgtactttcccccctttttctacattatgctcggacttcctgtgcaattgtctcggccgaagacagctggtgaccaacaactgtttggtcctgactattagcaccgtatttggaacagatctatggacgatccgccgtgtgttcttctctaaaaaaaaaaaaaaaaaa

SEQ ID NO: 9637 - protein, 143 aa, Zea mays
  misc_feature: Ceres CLONE 407091
  misc_feature (6)..(136): Pfam Name: Sybindin Pfam Description: Sybindin-like family
MALAAIYNLFIINKSGGLIYYKDYGSAGRMDTNDSLRLASLWHSMHAISQQLSPTTGCTGIDLLQAHNFDLHCFQSLTGTKFFVVCETGAPNVEMLLKAIYELYTDFVLKNPFYEMEMPIRCELFDHNLAQVIQKDRVALLGR

SEQ ID NO: 9638 - DNA, 1482 bp, Zea mays
  misc_feature: Ceres CLONE 407236
  misc_feature: Encodes the peptide sequence at SEQ ID NO. 9639
aactgccggagcccagctgcagatgcaaggaaacaccgcgcagataccaaaattagaccttgagaaagcaacagtacagcaacacaaggaggtgaggtgggtgagtgcgctcgcctggaagctggaggagtgcttaaccgtgtcgagggggtgcacggcgacggcggaggcgctgatcgctgccgcaccgaaagccgcgtggcccgcgtgacgctgtcctccatcggtttgccgcctcccacggtcccaccatctcggcggcctgcaaggcaggaactggaacacacgctccccgagaaatagcgaaaagcggcgagcgacgtttaggggaagacaagaagagagaagccgcgggagaatttggggcccattgagaaacctgcccacctcgggtattggtgttcggcccacagagttccgtggccaagcgaagatcggatggctggcacctggcactggcaggcaggctgggagccggggacgcgccggaccgccggtgctagtcgaactcgggtcgaagtttccttccgaggttggtcgctgcctcgactccagcgttgagccaactccgccgccctgtcgttttcgcctctccctagcatttaccggaagaaacgagcgtgaccgccgccttctcccgctcccgctcccgctctgcatctctccatgggccagatcgagagccaggtcactcctccagcggaggagccttctccacccaccgtggagccgtcgccgtcgtctcctgccccgcctccgtcttcccttgaggcgattgctgcagaagccatgtcatttgatgaggatgacactgaggagtcaatcgatgtgaaggtacagaaagctctggactgtccatgtgttgctgatttgaaaaatggtccttgtggaggtcaattcgtcgatgcattttcctgctttctcaggagcagagaagaagagaagggatcagattgcgtgaaacccttcatcacattgcaggactgcatcaaagcaaatccagaggcattctctaaggagattctggaggaagaggaaaatgatgaggaggcagataagtccaacctgaaagttagagctccatcatggtccagagaatccaaacctaaggtttgagattgcttggtattaactgatagtgatattcatccagtgtgcagactcaccttattcaactataagggcttgttcgctttcctctcaatccatgtgatctcaatccatgtggattgggtgggattggatgagtttaaatcctgaacaagtcaaaatccttcatattttttctaatctcatccaatccacatgggacaggaataaccgaacaagccctaagtttgccagtagtagactgatttcagagagcgaggtatcataaattgattaacagaaatacccatattttgtgtataagaaatgcttcatggtatccacaattttagaatgtacatgtcatttcaagtagcaaaaaaaaaaaaaaaa

SEQ ID NO: 9639 - protein, 149 aa, Zea mays
  misc_feature: Ceres CLONE 407236
  misc_feature (67)..(110): Pfam Name: CHCH Pfam Description: CHCH domain
MGQIESQVTPPAEEPSPPTVEPSPSSPAPPPSSLEAIAAEAMSFDEDDTEESIDVKVQKALDCPCVADLKNGPCGGQFVDAFSCFLRSREEEKGSDCVKPFITLQDCIKANPEAFSKEILEEEENDEEADKSNLKVRAPSWSRESKPKV

SEQ ID NO: 9640 - DNA, 791 bp, Zea mays
  misc_feature: Ceres CLONE 407643-R
acatacctccccccccgccccctcttcctttcgcccccattaccctactatcaacaacgattgggtccgggccccccctcgaggtcgacggtatcgataagcttttttttttttttttttccactatatgctgtttatcctgccatgaggcgatttatcgagccggccataaagttttccaggattcagtttgtgcgacggaatgccttcaattaacatcgatgcgaggcaatctataaccagatgccaaaatttcaaaaaaaaaaaactttttggaactatgtttcgagaggatcagaaaaccctgcttctagtctggagctgctcgaacattatatcgagttgcggaacctcggttggacctaaatctacaagtgccgaaatggggattcagattattcaaccccaataatgccattattggctagaatcccacttgcaagggagatcagctgagctattgaccccccccacggttgtgcaatggccgcaccttctttccccatactcccccctgaccccaattttaatgaaaccccccggctggtcatacccttaaatcactggaggaatgtcccccttttttttacccctaagacaatgacaatcggctcttcccccaaacgagcctacctacgggactaccggaattattgcaccatttggggccttttaatttaccggtgaacgccctggtccttcacacatggtcacccaaacattttcctttccccccttggcgccaaacgttcatgggtgcacattccgaaataaaacggtagctttatcac

SEQ ID NO: 9641 - DNA, 1806 bp, Zea mays
  misc_feature: Ceres CLONE 407651
  misc_feature: Encodes the peptide sequence at SEQ ID NO. 9642
accaccaagaaaaataaattcagagaaaggaggaagggagactgggagaaacagacaggaaggagcccatccgcgtctgcctccacccctcggctcccagagtccccgctagccaagcccccacatggcaccaccgcccgcgggcctcgtgctcgtggctctgctcgcgctggtcctggcgctggcgccggcgccggcgcgcggggacaagccggcgaggggcggggcgtccagctccatcgccgccggggcggagacggagccgtcctccgccgtcttcccgctctacggcgacgtctacccgcacgggttgtactacgtggctatgaacatcggcaacccacccaagccatacttcctggacgtggactccggcagcgacctcacctggctgcagtgcgacgcgccctgcaggagctgcaacgaggtgccgcacccgctgtaccggccaacaaagagcaagctggtgccatgcgtgcaccggctgtgcgcttccctgcacaacgcgctgaccggcgggaagcacagatgcgagtcgccgcacgagcaatgcgactacgtgatcaagtacgcagaccaggggtcgtccaccggcgtgctcgtcaacgacagcttcgcgctccgcctcaccaacggctctgtcgctcgccccagcgtcgccttcgggtgtggttacgaccagcaggtccgcagcggcgacctgagttcgcctaccgacggcgtgctggggctcgggaccggctcagtcagcttgctctcgcagctcaaacagcgtggcgtcaccaagaacgtggtcggccactgcctcagcctgaggggcggcgggttcctcttcttcggtgacgatctcgtgccttaccaacgcgcgacatggactcccatggctcgcagcgcgttccggaactactactcccctggctctgcaagcctgtacttcggcgaccggtcactgggcgtgagactggcgaaagtggtcttcgacagtggaagctcgttcacctacttcgctgcaaagccataccaagcacttgtcaccgctcttaaggatggcctgagcaggacgctggaagaggaacccgacacttcgctgcctctctgctggaaagggcaggaaccattcaagtctgtgcttgatgtgaggaaggagttcaagtctttggtgctcaactttgccagtggcaagaagacgctcatggagatccctcctgagaactacctcattgtcacagaaaacgggaatgcctgtctgggcatcctcaacggatccgaaatcggtctcaaggacctgagcattattggagacattacgatgcaggatcacatggtgatatatgacaatgagaaagggaaaattggatggattcgtgcaccctgtgacagagcccccaagttcggatcctcctcctcctccgcccttctgtgatcatttcacacacatcccctgtacagtgtgtacatacacccccaaccccacttaattccaatttctatttctccgaacagcgacaatacggttcatgggtttgaggaaggttactgttggcctcaattcctcccggggatcattggtcttcccaacgaagattgcccagcctattaccgttcaaacaaagagtgatttgccgaggcccaagggggagaggccgctagaatgtcacaagaaggatggtcacggaggctggacactgtgttaggatcgtgtgtgttctttaggaaaggagagaaactagcccatgtaaacatcataatgttcatatcaaatataatgatgatcaccctgttacgagtacaaaaagaaaaaaaaaa

SEQ ID NO: 9642 - protein, 432 aa, Zea mays
  misc_feature: Ceres CLONE 407651
  misc_feature (63)..(415): Pfam Name: Asp Pfam Description: Eukaryotic aspartyl protease
  misc_feature (47)..(187): SWISSPROT Homolog: EC 3.4.23.12 Nepenthesin
  misc_feature (347)..(406): SWISSPROT Homolog: EC 3.4.23.21 Rhizopuspepsin
MAPPPAGLVLVALLALVLALAPAPARGDKPARGGASSSIAAGAETEPSSAVFPLYGDVYPHGLYYVAMNIGNPPKPYFLDVDSGSDLTWLQCDAPCRSCNEVPHPLYRPTKSKLVPCVHRLCASLHNALTGGKHRCESPHEQCDYVIKYADQGSSTGVLVNDSFALRLTNGSVARPSVAFGCGYDQQVRSGDLSSPTDGVLGLGTGSVSLLSQLKQRGVTKNVVGHCLSLRGGGFLFFGDDLVPYQRATWTPMARSAFRNYYSPGSASLYFGDRSLGVRLAKVVFDSGSSFTYFAAKPYQALVTALKDGLSRTLEEEPDTSLPLCWKGQEPFKSVLDVRKEFKSLVLNFASGKKTLMEIPPENYLIVTENGNACLGILNGSEIGLKDLSIIGDITMQDHMVIYDNEKGKIGWIRAPCDRAPKFGSSSSSALL

SEQ ID NO: 9643 - DNA, 689 bp, Zea mays
  misc_feature: Ceres CLONE 407826-R
caaattgggaccgggccccccctcgaggtcgacggtatcgataagcttttttttttttttttttgatttttttttttttttttttttttttttttttttttttttttttttttttttttttttttttttttagcttccaaggggggcccaattgctacccatttgtttccctgattcatgacaaaaggcaagggggaatcagtacaaaactacagcttatgaaatccttccccccctggggtattgtatgctggagccccttacaagttccaacaaattgtttaaaatgaaccgattgggtttacccgcttttttaacggaaaaccgtgcggatggacaatggcctttacttaaacagcaaatctgctgaaaaaacaaatgttatgttgcccaacaacaacttccaaaattcccaaaaccaacctaatgcccctatcaaactacctaaatggaaaaacctgcaggttttcggaacttaaggaaccaaggcacccctccccggttaaactttccaccttccctaaatcaaagaccggtttcccgggggctttgaaaacggtgcaccgctcaaaagaaggcagccgccaagtcaggactccgtacaacgatttctctccaacgccaaataaatgctgattgcccctccagggcatttttggcaacttccacattcaaaactcacttccgct

SEQ ID NO: 9644 - DNA, 703 bp, Zea mays
  misc_feature: Ceres CLONE 408037-R
  misc_feature: SWISSPROT Homolog: EC 4.2.1.92 Hydroperoxide dehydratase
  misc_feature (687)..(687): n is a, c, t, g, unknown, or other
ccgattgggtaccgggccccccctcgaggtcgacggtatcgataagcttttttttttttttttttgaggtcattttaggttctgatcattttcatcccaattcatacattctatatagattaaaggagatcgataggtttaaatccgttgaaaaccttttacaaattttctcaatcccatctcctacaggaataaccgaacagtacctaagcaacatgaacagtatgtgcatgtctccctcagttcgctatcaaatttgcctgaaaaaaaaacggtctctcgttttactaagaataggcattgttatacctgatgatcacatcaaagcgctagaaaaatattgagagggatgggggcagacaagtacgatgcagtatattctacggtgaaaaaaaagtgcacgtgccagcctccggcgactttgacgggcggtccatcagagctcagaaggtggctttcttgagcgaggtgatggtcaccgacgaccccagcgcggaggcgccgacctggacgtcaaaggagtcgtagcggaggaagagctcggcgacgaggaggcgagcgatgagcacgacgaagtccttgccagcgcactgcttgtcttgcagcgtgggcgacgccgtctcggggccgttggaccagacgacgtggcggagcagctgcgcgccgtcctcgccgaggaacctgtcnggcacgtactcctcgg

SEQ ID NO: 9645 - DNA, 783 bp, Zea mays
  misc_feature: Ceres CLONE 409539-R
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (44)..(44): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (344)..(344): n is a, c, t, g, unknown, or other
  misc_feature (687)..(687): n is a, c, t, g, unknown, or other
acggagggcatcccactcacacaaacaaaagaaannnccccccncaccaccccaccacaacctnnnnnnnncnnnnnnnnnncccaattgggtacgggccccccctcgaggtcgacggtatcgataagcttttttttttttttttttgatttcaagttttcaacctgtattgaaattattatgtatgcaaggcatgctatccgcaccgccttctgtctgtacaaaattcttgagtacaaagaacgtgatatacacactaccggttgcgctcatcctgtactcaacccactagcctggcaccatcagtctccgtgtatctcaggacatgtcagacgattaccacnctggtgtccgaaataaatcttcactcaaagttgtgtgtagaaaatggtcgtgtatgttgaaatggtaacgatagccccattggggacgtgtgtttcatggcacgttttaaggttcttttgcttgtaccttttttcagggtatttttttggtgaaattttcaatggccccccccccccccacccttttcttaaaaaatttaaaaatttccccatttttacaatccggttacaaaaatccccgggaaaaaaaaatcattcccaggcccctcctggggtttttctttggaaaaaaaggactttttccccccccctttctcccctttgaagggaaaacctttggggnaaacccctttgaaaaaaaacccggaaaaaatctgggaaaacccggggaaaccactttttttctaaagccaggtgccctctcaagaggcccccactt

SEQ ID NO: 9646 - DNA, 848 bp, Zea mays
  misc_feature: Ceres CLONE 410884-R
  misc_feature (39)..(39): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (435)..(435): n is a, c, t, g, unknown, or other
  misc_feature (453)..(453): n is a, c, t, g, unknown, or other
  misc_feature (454)..(454): n is a, c, t, g, unknown, or other
  misc_feature (461)..(461): n is a, c, t, g, unknown, or other
attcgtgtttccccacaatctttttaacaaacaacaacnaaaaacnnnnaaaaaatgctgtccgggcccgccctcgaggtcgagagtatcgataaccttttttttgtggtttgttggcatttgcacgagacatttattttgtttttttttttttaaaagggctagaggacctgtttgtgtcccataaatcagaaccgatagctgaaaatccaaacaaacagggctctcgcaggtacatctcaaaaaaatccccatttctgaaataaatgacacatcgcctgtcttaacaaaccacaaaggctcggacacccagtcttaacaaacctcaaaacatcaaacgaattcttggacccgtctgtggctcaaaaaaacacattttcaataaaagaaacctagaaccttgacaccaacattctttccgcgggggggggaaanggaccaaaaatcccccannaaatgtnaccacggtcccccccaactggcaatatagaaaaagcctcgccgctcatccctcgaacctttcaattataaagtccccaagcaatggcccccgcgggatttccaactttgcaagttctaggcaagggtttaggtgcgaattcctgacaccccgggggatcccataattacatagcggccgcccaccccctttcacccccccctttttgtctcctctaaagcgaaggttaaacttgccccccgtgggcgtaatcatgggtcataaacgcttccccgggtgaaaaaagggaattccctccaatagtccccacccaatatctggtccggaaacccaaatgttctaaagcccggggggggcctaaattgtggtacgtctcatctccccatta

SEQ ID NO: 9647 - DNA, 612 bp, Zea mays
  misc_feature: Ceres CLONE 411387-R
  misc_feature (1)..(1): n is a, c, t, g, unknown, or other
  misc_feature (570)..(570): n is a, c, t, g, unknown, or other
ncgattgggtaccgggccccccctcgaggtcgacggtatcgataagcttttttttttttttttttgttgttattgtttttttctttgtttactgttaattctgtttatgttttataattcccaataaaaacattcctatgctaaattcatggctccaactacaaccaatcacaccaatgtgaaccattataccacaattccgacgctgaataacagtaaacagcaaacaattgcacgttataactgcaaattccccaaaatcgcaatgcccacaggacaccctctctaactcccaggaagccccgatcacgaagtcctacttatcaccaaaccactatcttagatcgaaaggaattcagctccggagcaagttggatcgccccacccccgtaatcgaagggacgagcagttccaaccaaccatacgtctttgaactggaggaggccgaggtctcctaggtaggagacggtgaggtgcgctgactcagcgtttatgatgacctgcaccagctgcatcgcctccgatcgcatcagatccattggagggcagcagccgcctccgccaccacgngccatgactggctgcgcgcgtgcccgccgtgtcagcagccgg

SEQ ID NO: 9648 - DNA, 628 bp, Zea mays
  misc_feature: Ceres CLONE 415800-R
  misc_feature: SWISSPROT Homolog: EC 2.1.1.76 Quercetin 3-O-methyltransferase
  misc_feature (628)..(628): n is a, c, t, g, unknown, or other
cgaattgggtaccgggccccccctcgaggtcgacggtatcgatattttttttttttttttttgtccaaggctttcgtatagaatataatgcttgaataatgagctcaaaattatgattttgtcatcaaaagcttggaaatgcttgaaagagatatcctggttacagaagctaacgttgagtacagtaggcagagattcggattccaacgtgaatggaatagctttatttatctgttcgttattctgctattcaactcgcaaggagatttgggcggatggagtggagatcacttggtatactcgaggacagcatagaaggggtcgagatagatggctcggaaggcggtgaagcctgcggcgtcgacgccgaggtggcggaactcctcctcggagcgctccctcccctgcgtccggtaggtggtcatgacgaagatgtcgttctccagcagcgccctcgtcctggtgctgctgtccgtctcctccggcaccaccggctcgcaggccacgagcttgccgccgtccggcagagcggcgtggcagttcctcaggatggccgtgcactcgtcgtcggtccacgtcgtcagaacccacttcatgaagatggcatcaccggaggggatggacttgn

SEQ ID NO: 9649 - DNA, 629 bp, Zea mays
  misc_feature: Ceres CLONE 417262-R
  misc_feature (171)..(171): n is a, c, t, g, unknown, or other
  misc_feature (209)..(209): n is a, c, t, g, unknown, or other
cgaattgggtaccgggccccccctcgaggtcgacggtatcgataagcttttttttttttttttttgtaagtacaaacataggcggcatgtattagggatagataaacgagtgatgacagaacaaagtaccaaaccataccactaaataaaggctaaggatgtccctcagcnaatggcacaagggagccaagagcatcacaagttccttnaaaagactttttcccttttgtttagtactacgcagggcggagagcaaaacgaagctccgcagctgctgctttttaggtggtgctaggaacgctgcctccggtctggtgaagcatggcgtccatattcgttgcgttctccattttccattcattaggggtttggttgcccccaaacctggggcacttaaaaaggaatgcaagggctttctgttcccaaaatggcgggccccaaaagggttttataactcttcttcccctgggggggaacctctttttgccaaaaaaaaccccatatggccccccggcccccttaacctaaaaggggaaaaggggggccccacccccccgggggtttttttattcctccccccccgggccccaaaaaaattggggaaaagggaaatttcccgggggaaaaaa

SEQ ID NO: 9650 - DNA, 592 bp, Zea mays
  misc_feature: Ceres CLONE 417679-R
  misc_feature (62)..(62): n is a, c, t, g, unknown, or other
  misc_feature (73)..(73): n is a, c, t, g, unknown, or other
  misc_feature (80)..(80): n is a, c, t, g, unknown, or other
  misc_feature (82)..(82): n is a, c, t, g, unknown, or other
  misc_feature (83)..(83): n is a, c, t, g, unknown, or other
  misc_feature (89)..(89): n is a, c, t, g, unknown, or other
  misc_feature (90)..(90): n is a, c, t, g, unknown, or other
  misc_feature (276)..(276): n is a, c, t, g, unknown, or other
cgattgggtacgggcccccctcgaggtcgacggtatcgataagctttttttttttttttttntggaatcgctnagacttncnntgtaanncatgtagttatttatgaaggacgagtgaaatgtttccgatgtgtcggctaaactatcgaatcaccatccggttcgccatatggatggatggcttttgtcgccatcattcatctactgaaataagataggtctaaggagagagagatgtcaatcagccagctgaaaaggtttcaagcagggattacnattctcctgggtccaaagagcaatgacatgatacccgaacagcaggaaagaccactccccctttgtaaaattccaacccaatttttttccgggaaattctgggaaggttaggctcttttcccccaagaaaaaaacccccttatgccaaaatggtttccctttttattccccccgggaaaaaaccccaaaggggtttttttttttccccccccaccccaaaaaaaaacaaattggggttttttttccccccccccccccccaaaaagtgttaaaaaaaaagccctcttttttaaaaaaatttgtggaaaaaaaaaag

SEQ ID NO: 9651 - DNA, 806 bp, Zea mays
  misc_feature: Ceres CLONE 417793-R
taattgggtactgggccccccctcgaggtcgacggtatcgataagcttttttttttttttttttggtccgcaacagaacatttccctcgaaatatcttctgatctttgttacacgcgaaagcgtaaacgcccaccagcagttctagtggccacagttgccaacattcgcaccatggaggaatgagacccacaacacatattcctagaagtatattcacaatatttattttacaaaattcatcatcatcgccatcaacagacaaacccagcagaaatcttgcttcctaacatcccatcaagagatcagtgcaagatattcgcatttggacatggatgcttacaaggatcatccatggatacactttgatccagagcttagagggagccttccttggacgagagccgcttcaagaactcatagacggtgaccatgctggccgatgcagcgacatggacgccaccgcggccagagccccggtagaaacagcccaactccctccctatttacggaccccctcggcccaagcgtagcccttggcccagggtacatacttgcaccggggcttaaggggtccaggggaatcttccagggggggtccgctttccggggggggaccccctttaacccgtgagggggttttcgcgcccccgggtatataataccccgggggggaaaagccccccccaaaaaaaaaccccttcggggttctttttttaagggcccccacccccccgccccctgtggggggggcccctatttttcttccacccacggaagtctcccaacaacgcgggggggatatacg

SEQ ID NO: 9652 - DNA, 810 bp, Zea mays
  misc_feature: Ceres CLONE 417793-R2
  misc_feature (1)..(1): n is a, c, t, g, unknown, or other
  misc_feature (11)..(11): n is a, c, t, g, unknown, or other
naaaagacatntcgtcgaaatgtctgctgatctttgttacacgcgaaagcgtgaacgcccaccagcagttctagtggccacagttgccaacattcgcaccatggaggaatgagacccacaacaatattcctagaagtatattcacaatatttattttacaaaattcatcatcatcgccatcaacagacaaacccagcagaaatcttgcttcctaacatcccatcaagagatcagtgcaggatattcgcatttggacatggatgcttacaaggatcatccatggatacactttgatccagagcttagagggagccttccttggacgagagccgcttcaagaactcatagacggtgaccatggtggccgaagacagcgacatggacgcccaccgcggcccgagcccgcggtagcaaccagcccaacctccctcccgaactagcgcgcgcgcctcggccgcgagcgtaggcgcctgcgacccagagtacataacttgcagccgcgtcttcacggtgtccagcggaatcgtcaccagcgcggccgcgcttaccgccgcggacgcgctcgcaccctgcagggctatcgcggcgcctcggctgtcatgcgccgcggggccaacggctcgccagaggagccgctgcgcggtcacgtaggaggcccaccacgcggcactggagggcgcgtaggtcagcaccgagatgccgaagccgcgatacaggccgcgcacgccgtccgcgagtaggatcttccggaacgcgtcggtaccgccgcggtagcgggcggcagcgaggaagcgctgtctgaagcatgac

SEQ ID NO: 9653 - DNA, 644 bp, Zea mays
  misc_feature: Ceres CLONE 417921-R
cgaattgggtaccgggccccccctcgaggtcgacggtatcgataagcttttttttttttttttttggttataatgcaaatgggactaaacctcttagggcagcagacgaagtgctttcatggtaataagttaataaccgaccattgaccaacataagtcttacgcgagacattcgcaagcaaagtgactcccaaaatacttacaaccattaggacaacataaagtagacatagtagtagacaccaccaaacttaggcatcaatagatccagcacctccttactcgaaggcccactggttctccctgcggatctcctcttcctcctcaggggtgaagtcattcttgatgttgaaggtcttgcgaatctcttctggtgtcttgcccttgatcatgtcagcaacagtctgacaggtcaggtcgagcagacccttgatgttcagatagtttgcagccaagatgaggtcgaaaagcgtggcctggtcgaccttgacgaagtccgcatcccagttcttgaggtcctcacccgaagcggcggtgctgttggcggaggcggcacccacgtcctccgaaccggcctttccaggcggcggccgcggccgccgccgcatgtacctggcctgttgcaaactcgattaccttggaag

SEQ ID NO: 9654 - DNA, 674 bp, Zea mays
  misc_feature: Ceres CLONE 418179-R
cgaattgggtaccgggccccccctcgaggtcgacggtatcgatattttttttttttttttttggcttatagcctttaatttatacggatacacgcaaacgcatcgtcaagcaagcagctagtcctgtatgtttcattgcgcgttacattcatataacaaaatcacagacatgtttttcgacacattgacacacagactagatcatatatgtgactgaaacacagctgtcactcttagcttgcatagagtatgatgctgccaccgcatctttatttatttcctttgcctcaagatccatcttcagggtagccatgttggcatgaagttattcatatgctcaggagcgaacccgatctgcagggttggctctgctgcaggtgcgaggggatgaaagaacaaaccattgcccacatgtgacggggcctgctgttgaagagagtgcctctcgtagcccagtaagttggcaccgtgctcccacacttggccatgcacctggttgctgggtctcctccagctttcttctaagggacttatttgctttccaaacacatttggcctccccccccgaaaaaacaaggaactgaatcaagcaaatgttttggtccctggggaaacttaattggccctaaaggaaaaaaaaaaattgcttccccaagcgtgctccaaagtctttg

SEQ ID NO: 9655 - DNA, 834 bp, Zea mays
  misc_feature: Ceres CLONE 421911-R
cgaattgggtaccgggccccccctcgaggtcgacggtatcgataagcttttttttttttttttttgtcaactgggtttttatggagttttggaacatatgcatctcgcggcattgggccaagggggagtgttaagaaacctttcttgggccaggaaggcccatgtggcccatatgcctgaaaccctagttttgtctataaatagagaggagatccccatatcatgtaacctttgagagcagcaccatatagtaacaaagaatcagttcctctctacactcttgtctccttgtgttctactattattcagttaagcagcccttggactacactcggtagcaatgggttcttaacaatctcaatacagttttgcgtggagcgcgtgactgcgggcagccttaagcacggcagggctcgctgtccacccaaacctccgccggactcgcgggcccgacgcccaagaagcggtgccgatgctgactgaggaccaccctgcagcctctcgtagacgtagctcgcgcgttcaccagcgagcctcccaacgacaggccgccgccgccgcacctccgcggcgcaacgccgagctgtgcgcacctgaggaactcggcggcaccgccggccagccgctcgaacctctggacggcggcgcgtgcgcgggagtgctcgtcgtcgccgccgccgcgggcgagcagcaggagcgccgacgcgaggcacaggagcgcgcgcgcgactcggcgcgtgagcggcgcccgcgccagcttcgcccgggcgtctcctcctgcagctcgcgcagcttcaacgggcgcagcgcggcgtccacttctgtcgcggggcg

SEQ ID NO: 9656 - DNA, 843 bp, Zea mays
  misc_feature: Ceres CLONE 421997-R
ccaattgggtaccgggccccccctcgaggtcgacggtatcgataagctttttttttttttttgctgctttctaatcgcacagaataaaccccgtataaataggcgtaatcacgttacatatgagaactatagcagtgactgattaagggcttatttgaaaccatctaatttttaagaaactgatttatagaaaggttccaaatatatcagtttatgtcttaatttataaaaattggattcacagtttcattaaaaactaagaagctggtctctcttagctaaggaaaaataaaaactgattttttaaaaactaagttttcttctaaacatgtcctgagattcaattacacggtcaagtgaactgcacttgggagcggtagtcggtgttgggcctccagtttgccggaataatattgttggccaccagcgtcccgccggactctctgcggacgctcatggagaacgggcccttgagcgggcgggcagagtccagccgccaaacggacccccaagagcggagcatatgcatccagtggcccgagctggactccatcgcgtccatctgaggcacagtgcggccttgttggcttactccaccaacacctccaggtagctagggttggagcccgccgccatgtggcaaatgagggtcaccctgcgggtggttacaggacactctcgtgcactggatgtcgatgatgccggtcgtgacagaacctgtcattgagacgagactcgtcatggagcctagcacgtgccgctgaggtcaacatgtacttgggcaccgggtagagctattgtcaaataaaacccccccctgacctgtccgaaacaggcggtttg

SEQ ID NO: 9657 - DNA, 1139 bp, Zea mays
  misc_feature: Ceres CLONE 422731-R
  misc_feature (700)..(700): n is a, c, t, g, unknown, or other
ctcctcccccctccccctccccccccccttttattcgttttttatcgaattgtgtacgggccccccctcgaggtcgacggtatcgataagcttttttttttttttttttgctctgcaaaaaaaaatggcatagctgctgatacatcacggcgtgcaacatggtataaataacatcggtcataatttatctgagctgccgacttggcaatgtatttgataagataacacgacgctcagaagacatcggcaaaagctaccagtctattgacatttcaccatcaactcgtgctcgggcttgctgacttttgatgtttggccttctcgaccagaggttttagatgctgcttctctgcaagcatcttcagcaagttgaaaaagaaagggatgtaactatgtttccctccaaagtgtctcccttcttcccactcctggaacttcaccttcttccaatgaatgaaccttcccccttgaacagtttcccaattggccaataatcccctccggaaaggcgaacctgctccaagggattctggcggcacggaaaacaattatttcaatcctcctggcaaaatatttggtctcccttcttctttctaccaagtttctcctaaaccctccagggatcggttcaaacccctctttttcccgggcgtcccttatacgagagcggccccttcgaatatatttgaaacccccggcntacctcccatattttctgggagaaaaaaccgcccctcaaatatctccttctcatcttgaaaaataaaccggcgggtgggcaccccactctccccatgctccccaacttacaaagatacacttctgcggttacaccctttagaccattcggccccaaataattcaaaagggggcgccttccctcccttaaactcgctcctcggagtttttataacagggaaacacttttataagaggtgaaacaacatcttattcaaaaaggtctcacaaccacccatccccctcctaaattgggtcgcccccctggcgatcaacaaaaaaataaaaggggccccgcgcctttccgacatatgtctattactacccctccgcaataaaattctcttgttgtaaaaaaccatacctcctataatatgtggcgcaaaacccgtcggggacct

SEQ ID NO: 9658 - DNA, 1098 bp, Zea mays
  misc_feature: Ceres CLONE 423269-R
  misc_feature (13)..(13): n is a, c, t, g, unknown, or other
  misc_feature (18)..(18): n is a, c, t, g, unknown, or other
cccctccccctcntctanccaacccccaaccaaaaacccctcccctcgattgggtacgggccccccctcgaggacgacggcatcgataagcttttctttttttttttttaggcacacaaggtttttcaatcacataacaaagcacacactaatacggagtactcatcaccatcatcgctaagatagttcataagaagttcagactgaaaatcttttacttcagataatttttcatcatcatcatcggcggcggcggcgccgccgccaccacgggcataaaaccagcaaaacctggcatcctaaaaccccatccaccttctagtgcttgttcttcgccatccacccctctatagcaccagatcgaggaacccaaacgagaaatgaagcaaaagatcttgagcatatgtacaagaaacctaactatttgagaccggccgggtagtattttcaagcaccgatctcacttcgaggctaccttgatctcggatcccctggacggacggacgacggctaatggtactcggcggacaaggatcggatctaccccccggggaggccctcctttggacggaaaatccggattcagggagagtcgtcaaggtgggcgaacacatgggtggtcggcctgcaaaccgaacattgggaggcccctacatttggaatcccaggcaccgccgggaagaaaacactgagcccacccccgagtcattcccttggaaaaaaggactcccatcaaaagcggggttcccccaaataggttggggcccggccgcccacacgagcacctaaaacccgactctttactttcaccctggcggaaggcggcggccgatacatgccgcgcgtctcttattcaatactgtggttccacaccatgagtcgcgaccaccatcaccatcagtgtataaagatgaatgacacaattgggaccccaacctgaccagcagccatatactggagctgagagaaaaaggctttaaccgaacaggggcggcggggcgcacccgcgcaacgcgcgcacacagcaataaacgctgttccatgacgcgtgatccataagcaaatacacaacaaatcaacaacgttcgttccgcattg

SEQ ID NO: 9659 - DNA, 1120 bp, Zea mays
  misc_feature: Ceres CLONE 423320
  misc_feature: Encodes the peptide sequence at SEQ ID NO. 9660
tttccatttctccaaccaaggtgggaaatctaggcctgcctctcgtggagctccggaggggactgcaattctgctaatttgtgacagatcatgcaggaataggaggccaagagagtttctgcaaccccaatgaagatggcaccaggacgatgaaaccctgtcgaccggattttgtagctcctaggcaagatcaagaggcgggggacgcaaatactaagtggtggattcctctcggggcaccgcgggcgggcagccgcctgtggaacctgctaagatgaagggccttctcaagggcctccgatacatctcgcagatttttgatgcgaaggagccggagatgcagatcgggaagccgacggacgtgaagcacgtcgcgcacatcggctgggacaacgcctccgtcaccgcgcccagctggatgaacgaattcaaggcttctccgggggtggcgaggggcggcgatcctgagccctcgcagcctgggggttcgggcggatgcggagacgagcaaaccggaggagaagacgctggcggcaaggcggagcggccgcggcggacgagggggaacaaagtgtcgggtggcaacgagctggcgaagcggcgggactgcgcggccgaggggtcgcggcgcgaccggagggttgcgaaggcggcggacgtggcggagggcgccgagggggacgccgccgcggcgccgaggcagcggcggaggaagccccgggcagcgtcggggggcaggtccaagtcgtcgtcgggaggcgccgccgcgtcggacgcggaggcggcgcggcccgaggccgaggccgaggacgatcgcgacggctgctgaggcgaaggaaacggtggccgcgcgccgttgcgcgttggggttcgactggtatacacggaggcgggaggccggatgccggaaggtgggggagatcttcaaatttgaatttggttttgcttggctgtccggaaatcggagagaatttgggtgtgtgtgtctctctcttgtttatgttggttttcgactggttatttccatgcacggattattggtgtttaggatagtcgtgcggcgtagagtggcacgacaagtgtatgcataaacaattgtacaccaaaaaaaaaaaaaaaa

SEQ ID NO: 9660 - protein, 184 aa, Zea mays
  misc_feature: Ceres CLONE 423320
  misc_feature (23)..(126): Pfam Name: PBD Pfam Description: P21-Rho-binding domain
MKGLLKGLRYISQIFDAKEPEMQIGKPTDVKHVAHIGWDNASVTAPSWMNEFKASPGVARGGDPEPSQPGGSGGCGDEQTGGEDAGGKAERPRRTRGNKVSGGNELAKRRDCAAEGSRRDRRVAKAADVAEGAEGDAAAAPRQRRRKPRAASGGRSKSSSGGAAASDAEAARPEAEAEDDRDGC

SEQ ID NO: 9661 - DNA, 994 bp, Zea mays
  misc_feature: Ceres CLONE 423559-R
aaatgggaattttttgctacacagaatcattgcttaacctcaaatccacaccggataggagctggagttgcatcaatgaatcaattgtttgggcagatggatacatgatatcaatcagccgctgatgcgtccggatctcaaaatggaaccctcgaatccttgtgcacgtgaggagagttgagcacacatttgactctccgctcagtggggaaaggaacaggacccatggtatttgaatatagataaaaaagaaaaaatcaaatatcatccatagcaaaagtccgcccaatttctggaccgatgtgggaaccgccagcttgaaatcctgaatatttcgcggtttgagatgcaaacctgcacaattaatatttttagtgaggtgttgtcatgggaaagagggggaggaaaaaacccccccccccccaaagtaaaagtggcagagtcgcacaaacagttacggcggtgttgtccaaacataaatgtcagcccaatctgtctaatgggcgctctttcactatgataatattccacatacaacaaaaaaagagatggtctcgggggagaaacagtgacgccaccgcctgtggttagtgggggggccacattatataaatgttgtgtatttttacattctatattatatatttttccatataatagacatcaggacagcagggcgcgcccagtatcccacacccccaatacgcgactcgattgagatagtggtatgggaagattgtgattagatatattaataattctccactctccttccacagattcacacctagagagtttcgatgtagtcagctgcgatcgtagcacatccaggtaggggccggacaggccgagacttagagtcttcttataggacgaatcaaataataattgtgtacgaaaacactaacaatacgagactacgagggtacacgatcggtaatgttggggatgtgtgtggcaggactagcatcgtgaatctttgagtagtttgtgt

SEQ ID NO: 9662 - DNA, 859 bp, Zea mays
  misc_feature: Ceres CLONE 423581
  misc_feature: Encodes the peptide sequence at SEQ ID NO. 9663
tcctttggaggatacggttggacttcggaaaatactctaaccgctccggctccgatttcctcgcgtccaaggaagctgcagcgagccagccatggacggcccagcccggtcgacctcgagccacgcccgcatcctcgccagcttgcctataagcgccgccacggcgcctggtagcgctcccaaaacgcccaccacgccgccagtcgcaaccgcacaccagccctcgcaacccaccaccacgtccgagacgtccgagatggaggagttcctcgccgcgtacctgctgccgtgcctgggcgccgacgccgccactggacagagggttgacgtgctcccgggcccggccaccgcgctcccgaccaaggacgacgtgcgtcgcatcctgagatccgtcagcgccgaggtggaggaggatcgcctcgacctggtcttcgccctcctcgaggttaagggcatcgccgagctgatctacacgggcggggagcagctggcctacgcgccgtcaggagccgctgctgccgtggttgccgctcctgccgctgccgaggtcgaggaggaggccacgaaggaggaggatgaggacgtcgccctcttcaacctcttcgactgatcgtgcaccctacgtggaccgatcgatgccatcctcgcccgcccgcccttgctgctctgattgtagtaccgtattactgtagtaataaaaccatggtgcccttgctgtctagatccgagatagagcctgtgtttgatgccgatcgaaaggttttggccggatatcttgctgatcggagattgatctgaggctgttctaatcaattccagtagttaatacatgattttaattgtagaaaaaaaaaaaaaa

SEQ ID NO: 9663 - protein, 172 aa, Zea mays
  misc_feature: Ceres CLONE 423581
  misc_feature (88)..(168): Pfam Name: Ribosomal_60s Pfam Description: 60s Acidic ribosomal protein
MDGPARSTSSHARILASLPISAATAPGSAPKTPTTPPVATAHQPSQPTTTSETSEMEEFLAAYLLPCLGADAATGQRVDVLPGPATALPTKDDVRRILRSVSAEVEEDRLDLVFALLEVKGIAELIYTGGEQLAYAPSGAAAAVVAAPAAAEVEEEATKEEDEDVALFNLFD

SEQ ID NO: 9664 - DNA, 798 bp, Zea mays
  misc_feature: Ceres CLONE 423599-R
  misc_feature (462)..(462): n is a, c, t, g, unknown, or other
gggaattaacatctatgctataattggtgtacaatacatatcaatattcataaagtaaagaaaaactatacaaaatataaatcctccttaagcttcccaagttcttttcgtgcagtaattcagcgtgagtatgatttaatatatagatcatccagattcagacttcagtcaatcatcctcggcctcctttaatatggtaaattccaaatctgctcctattctaatgtagcatcaggcattggttcgttgtacaagtagcttgagcgcttcatattgtacaaatcacaaaaacttttagaataagttcctgaaacaaaaatggagtctaaatagatagcaagaagtgaaatttataacaaaagtgcgccctttttgttcaaggaaaaaacaacacattcggggtgggatgcacggtagggcagacccatccatccatgtacacgaagtgaggaagagcggagncataccaaagataaatcctccttaagcttccaaagtctttttcggtcagtaattcggtgtgagtatgcttttatggagagatcatctagtttccaaagtttagtgcattcaggggctaatagcagaaactaagactccgggaaaatatgcctaaaacgggaggtctccaaattagctggggaacaaccctgaggtgggtttccccaatccaaagggaaaatggggggttattccgggtaaaaacttgggcccaaatggaaaccaccctttagggggggccggggaaatggcattaacacaacccccggaaggaaaactttggcccgttccacagga

SEQ ID NO: 9665 - DNA, 637 bp, Zea mays
  misc_feature: Ceres CLONE 423622-R
  misc_feature: Pfam Name: NAF Pfam Description: NAF domain
  misc_feature: SWISSPROT Homolog: EC 2.7.11.1 Non-specific serine/threonine protein kinase
cgattgggtaccgggccccccctcgaggtcgacggtatcgatattttttttttttttttttaagaaaacaacttaacacctcataatataaaattctccaacatttacataaatcatggtatagactagaaactacaaaaattatggtattaactagaaactacaaaaatcatggtcaagacttttgttcgactacgatctcttctggtcaatgctgtctctagcctcatgcggctccgaaagtccgaatgtcaatcctgtcggaatgtcattcctgttatcaatagttccgtgcatgttaagttcaaagcccatttgatctacttggcatcatcagtaagcatacgttgagatcggaccatacggtggacaaggtgctgcatccctggcttcaggtccttgttgcagaagtcctcgtactcttggttatcccctgccttcttttttacctccaccattacaaggggaggtgtgagttcaaatatctctgcggcaattgttaatggtcccttaactccttcccttgtaatctcgaggcagatgcgccagtccttcctccgcatcttgaagctcttcagcttcgctatgtcctccaatgtcgttgtgatatctgacatgggctcaaccgagatgaacc

SEQ ID NO: 9666 - DNA, 620 bp, Zea mays
  misc_feature: Ceres CLONE 423667-R
  misc_feature (13)..(13): n is a, c, t, g, unknown, or other
  misc_feature (14)..(14): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
aaaaaaaaaaaannannnnaaaaaaaaaaaannnannnnnnnnnnnnggggctnnnnnnnatcgattgggtaccgggccccccctcgaggtcgacggtatcgataagcttttttttttttttttttgaagaataacttaagcatttatgcattttggctaaccaacgttaacccaactttgcctttttacaaacttcattccaacaaggaaccaaagtataaccttcacgagaatcaaaatctctctaggtctctccagtcgcatttagctcccagaaaccaaatgcctaggggtctatcccttctccgccacatatcagttctcagactaaagaaaactaaaacctactagcggcgtttctcaggggcactcatgtttcagaacaacagatagaaaacaggacttcaaacacttgagcaaagctcactgcttgcaattgcccccttgcagggagaaggtctggttacaatctgcttcctcaatgattggcgccgtcttgctcccctcagaagatggagcaggactgggctctcctgattccttcaggtcttctatccgggggggggtctttactgcctggctgcggaaatgcacttgctcataaggcttcattgcctgg

SEQ ID NO: 9667 - DNA, 1951 bp, Zea mays
  misc_feature: Ceres CLONE 424664
  misc_feature: Encodes the peptide sequence at SEQ ID NO. 9668
tcccccacactttttcctggcaaaccctgcacgcctccgcaaccgcaaccgcgtcgtcggcgtgcgcgatcccgagaggcccagccatcagcttccttggcggggtgtgtatgcgcgtacgtcggccgtgaccagatcggctgagccaaggccatggcggaaccggccctcctcgcgccggaccccttcgcggacctccccttccccgaatttcaggcgcccatcgacggcgacagcttcgcgctcgaggacttcgatctggaggatctggacctggacgtggacttcgacctcgacctcttcgcctcggacgggcaaccctcgcaaccgcccccgctcgcgacctcgtcctcctcggccgggtctccggttggaggctcgtcctcttccggtgccgtcggggacggcggagggctgaggaatgaggagtcttcggagtcgtcttcgaggagcgcgagcggcacggatggcagcggcaaggggaagggggaggaggacgaagccaagcggcgcgcgcggcaggtacgcaaccgcgagagcgcgcacctgtcgcggcagaggaagaagcagtacgtggaggagttagagggtaaggtgaaggccatgcaggccaccatcgccgacctctccgccaggatctcctgcgtcaccgccgagaacgccgctctcaaacagcagctgggtggcgctgctggggccgcgccgccgccgatgccgatgtaccccacgatgtattctttgccgatgccgtggatgcacccatcgtatcccatgcgtggatcgcaggtgccgctcgtgccaattcctcggctgaaacccccgcagcctgcacctgctgtagcagagccaccggccaagaaggctaggaagaccaagaaggttgcaagtgttagtctcctggggttgatttgcgttgcaatgctttgtgggtgtttgattcctgcagtaaatcggatgtatgactctgttgatgctggagaaggtgctgcatacggtccatctcatcgtgggagggtgctggctgttgaggggcctcatgataatgtttcagatggtgtcgatccaaagccgccacagcgtgccagtgagacgcttccagcactgttgtatctaccaaagaatgggaagcatgtcaagattaatgggaatcttgttattaagtcgattgttgctagtgagaaagcttcattgcagatgtctggcaatgatgggaagcgtcctcaaaaccaagaggaggagactagactggcaattcctggctatgtgactccattgaaagctggagaggttatggaatcaaccgaaggaatgatgaacaatgaactgttggcgttagctcctgcagatggaagcatgtatagggaggaggatggattgctgccacagtggtttagtgaagcaatgtctggccccctgctgagctcaggaatgtgcactgaagttttccagttcgatgtgtccccatcatctgctcatccaaatggcatcattcctgtctattccaatgccatgtcaaactcgtcacagaacttcactcaagatcttccccctgctcgtgttcgcacggtcaagaacagaaggatttcgtactccgaggccattcctgtgagaggttcaacatccaacgacactgagcacctcaagagctttggcagtacgaagcctgtttcgtcagtggtcgtctctgtgctggctgatcccagagaggctggcgatggggatggtgagggaaggatctcttcgaaatcattgtcccgcatcttagttgtcgttcttatagatagtgttaagtatgttacgtactcttgtgtcctgccgttcaaaagtcatagccctcacctttaggtctgggttttggacgtgagttgatagagctgacctatacattttatagcagaagaggtgtaagacagctgcatttgttcatttattcaaaaaacaaaaaaaaaaa

SEQ ID NO: 9668 - protein, 563 aa, Zea mays
  misc_feature: Ceres CLONE 424664
  misc_feature (114)..(177): Pfam Name: bZIP_1 Pfam Description: bZIP transcription factor
MAEPALLAPDPFADLPFPEFQAPIDGDSFALEDFDLEDLDLDVDFDLDLFASDGQPSQPPPLATSSSSAGSPVGGSSSSGAVGDGGGLRNEESSESSSRSASGTDGSGKGKGEEDEAKRRARQVRNRESAHLSRQRKKQYVEELEGKVKAMQATIADLSARISCVTAENAALKQQLGGAAGAAPPPMPMYPTMYSLPMPWMHPSYPMRGSQVPLVPIPRLKPPQPAPAVAEPPAKKARKTKKVASVSLLGLICVAMLCGCLIPAVNRMYDSVDAGEGAAYGPSHRGRVLAVEGPHDNVSDGVDPKPPQRASETLPALLYLPKNGKHVKINGNLVIKSIVASEKASLQMSGNDGKRPQNQEEETRLAIPGYVTPLKAGEVMESTEGMMNNELLALAPADGSMYREEDGLLPQWFSEAMSGPLLSSGMCTEVFQFDVSPSSAHPNGIIPVYSNAMSNSSQNFTQDLPPARVRTVKNRRISYSEAIPVRGSTSNDTEHLKSFGSTKPVSSVVVSVLADPREAGDGDGEGRISSKSLSRILVVVLIDSVKYVTYSCVLPFKSHSPHL

SEQ ID NO: 9669 - DNA, 1144 bp, Zea mays
  misc_feature: Ceres CLONE 424847
  misc_feature: Encodes the peptide sequence at SEQ ID NO. 9670
aagccagcagaaatcgtacgtagagaggcgtagagctagcaagctgtagctagctaggagctagcgatcgagctcaattcgttttcagtcgagctcgtcggcaatcgacgatcagtagtccgttaggacaacaatccatggcgaacgcgggcatgaggccggtggccggcctcctcctggtgctcaacttctgcatgtacatcatcgtggcggcggtgggcggctgggccatcaaccacgccatcaactacggcttcttcatcggcgccggcctgcagctcccggctcacttctccccgatctacttccccgtcggaaacgcggcgaccgggttcttcgtcatcttcgccgtgatcgccggggtcgtcggcgcggcctcggcgctcgcggggttccaccacgtccgcgcctggaacgccgagagcctgccggcggcggcctccgccgggttcattgcctggacgctcaccctgctcgccatggggttggcggtgaaggagattgaactgcacggcaggaatgccaggctgatatgcatggagtccttcaccatcatcctgtcagcgacgcagctcttctacctgctcgccatatacggaggcttgagatgaaatcatcatactggatggaggaagagactgcattggaatgaagatttgtcgtttccgtacgtatcgaattgagctggtgtgcatcggtttcacgggacagagtgtggctttcctcgtgttttcgttgtgggtttcttccaagctgctgaggcagtacgtatatgtgtatctgtttgtgtgtatttctgtgtgttaattacgtacggagctaaatgcatcggtgaagtctaaacttgtaaggttttatttggatactttagtatttgtcctaatacatatcctaatccacctcaatccatgtgtattaggatatatactataatatccaaacaagccttagaggataccacttagacttaccgtctttgtaaatatatttctgttctctaaatttattttatggtgcgccacacatatctaaactagtaaaatggtgtgtcctagttccatttccgaaccataacgaccattgtggtacaccacttcatgattttagggacattggaatatttttcaaaaaaaaaaaaaaaaaa

SEQ ID NO: 9670 - protein, 157 aa, Zea mays
  misc_feature: Ceres CLONE 424847
  misc_feature (15)..(156): Pfam Name: AWPM-19 Pfam Description: AWPM-19-like family
MANAGMRPVAGLLLVLNFCMYIIVAAVGGWAINHAINYGFFIGAGLQLPAHFSPIYFPVGNAATGFFVIFAVIAGVVGAASALAGFHHVRAWNAESLPAAASAGFIAWTLTLLAMGLAVKEIELHGRNARLICMESFTIILSATQLFYLLAIYGGLR

SEQ ID NO: 9671 - DNA, 894 bp, Zea mays
  misc_feature: Ceres CLONE 425117-R
  misc_feature (12)..(12): n is a, c, t, g, unknown, or other
  misc_feature (13)..(13): n is a, c, t, g, unknown, or other
  misc_feature (22)..(22): n is a, c, t, g, unknown, or other
  misc_feature (25)..(25): n is a, c, t, g, unknown, or other
  misc_feature (28)..(28): n is a, c, t, g, unknown, or other
  misc_feature (29)..(29): n is a, c, t, g, unknown, or other
  misc_feature (57)..(57): n is a, c, t, g, unknown, or other
ttttttgtggcnnccccgcccnccnaanntaaaactaaattagaaggcacccccccnccgattgggtacgggccccccctcgaggtcgacgccatcgatattctttttttttttttttcgcccagataaatcaaatggtacagtatagtatagtacatgcaaattacataattctcgcaaagcaacaagtggcaagtagtagtaacaacacaagacatcacacgcttagtgtaagagaggctatggaaggagtttaattgaatattactactatgcctgggaaggttgtgacagaagaattcttccacttgaagtgctgttcttgaggctggttccatggtgggagctgctcagtaagagtcatgagctgggctgcccgagtgcatgtccatggacgaatcattcgaaggcgtgtggttcacatcgcggacttgcaccgttcgcgaagtacccctgctccccgtactgctctagatggtaaagggtgcaggttccccccccatgtgggctggataatgcgcttgaaaagaccagggaattcttggggtgtggtaaccccaggctttcctgaaacaaaaaaactttgggtactggttgctggcccgcttgaggtcgggaaaggtgccattgtccggtgcaggcgcttttgggctaggagcattgtggacctttggaaaaggctgaaagtattcgtcaccctccataaccggaaatcctcggggtttaaccctctggattgattacctaaagttggggtaacaccacttcttttgggcctggaaataatggccccaaaagggaaagaaaaaaatggcgggaaaaaatggtattggccaaaacttgctctatggaccttggcatacttgcgaaaaaagggcctcccgaaaaatcact

SEQ ID NO: 9672 - DNA, 762 bp, Zea mays
  misc_feature: Ceres CLONE 425230-R
  misc_feature: Pfam Name: SapB_2 Pfam Description: Saposin-like type B, region 2
aaaaaaagaaatgatgccgtgggttgctcgaattactcgcgggacaaataaagacaaatgggtaacgggccccccctcgaggtcgacggtttccataagcttttttttttttttttttattgaattatgatacaaatatattttaaccttcacccactgtggatgtccataaaaatctactcaagacaacgtgtttatgaattatgatacaagatggaaacaatgcagggcacaagacacgtcttcatgcattcatatgacaattatatgtacaaacacggcacttgggcacactatttccaaccactgctaaaccctttgcgtgttcttcctccaaccttcaagcgttactcagcaacaaggcctccttcaaggctaagctgaaagtcttcttatgggtggctggacaagcctgaacaaatgtgcaaacatcattcttcaagaagaaattctcgccattcaccaggataaggggcatgtattgcaggaccagtcgcttgcactgctgggacagtgacctttcaaacttatcgcaatccttgattaagaatgtgaattatcctcaaacgcccgggtccgggacttttcagctttggacataatctccatccaagcaaggggggggggcagaaacacaacaggaggccttggacacttggtcgcaacccagaaaaaaaaaaagccccagcccccccatacacaatgcccaacaaaggtgttggcccgaaaaacgcctcctggggtcttggaacccccccacgg

SEQ ID NO: 9673 - DNA, 709 bp, Zea mays
  misc_feature: Ceres CLONE 425334-R
ccaattgggtaccgggccccccctcgaggtcgacggtatcgatattttttttttttttttttgatcgagctcatttactaatatataataaaaaatctacgaagtagaggccgatatgtttacatttccacacgtgactattattggttattcggttttcaagcttctgcctgaatcgacacagaatgaacctaccacgtacactctgcctaattccacactacaaatatatttacaatagattttcgctgctctgcctagttccacagttctgacatgttacatatgccctagtttgtgccaacaaatatatttacaaatgaaagaatattgtacaagtccaccgtccctcaacctggacaagatttgagggcgcatggcagcagtcaatgcctctggctctgcatctgacagagcctggtgttgagagcgtcaatgtatgtgcgcagtcgattccgatcggatctcgttagagtcaaaggggggttgagggcgagtgatggtgcctcgaccaggagaaaccgcagcatggataccgccctcatatacccagtcatggcatccgcggctttcccaaacatttcatcaacaccgcctcgccttcctatgagtaaagccgactgaaatatcatttcaattgcatctggcatctctgtaccatcagctatctgtcccacaatgctggctagttcttcagcatattcaactt

SEQ ID NO: 9674 - DNA, 661 bp, Zea mays
  misc_feature: Ceres CLONE 425645-R
  misc_feature (382)..(382): n is a, c, t, g, unknown, or other
cgattgggtaccgggccccccctcgaggtcgacggtatcgataagcttttttttttttttttttgacatcaaacacatacccgagttctgatattgcattgtttgtccaaacagcgcacgacagcagccaaggtaaattgtcaggatggcagcatcagcatacaacaaacttacatgaaacaaccactggagcataaagcaaactagtaagtgatctagcaacctcaaactattgccctataattccctcaaaccataaactggtcgaccactcaaggtactagtttctggatctaatgcagtagcctaaacttaaattattattacagaattattctacgtattattgaaagaacaggtctctttggtcctgctactcagngagatcttcgaaacttataatcacaaatgttgcactcatgtccattaccaataatttcattgcaaagcatacaactaaaagcaaaagcagtttcacttgggaatccatgtggtgcatgcctgattacctgaaacaaatgcaaattgcacgcagaaagccagaaacatcatgttaaagctgtaaagccacagtttcaaaatgatccaccaaattctgttttcatgctcactacactgtccagtaacagagtaactgctacccagaattcagcacatcctt

SEQ ID NO: 9675 - DNA, 732 bp, Zea mays
  misc_feature: Ceres CLONE 425695
  misc_feature: Encodes the peptide sequence at SEQ ID NO. 9676
atacaattgtctcgtcctcgtaaccctagacaacccataaggccataccctccaaccgctggatcgggtatcggcattactgggcgcacgagactagggatttcccccttgcaatcacgaatccatggcggatgctgaacctgttgatcagaagaattaccttgaggaacgttgcaagccgcaatgtgtaaaaacattgtatgattatgagaaatgcgtcaagagagactgagagaggatgtcgtgctgcggaggcaactgcgggtgcggctccggctgcaagtgcggcaacggctgcggagggtgcagcaagatgtacccggacatggccgagcaggtgaccaccaccaccacccaggctctcatcatgggtgtcgcaccatccaaggggcacgccgagggcgggttcgaggcggccgccggagttgagaacggcgggtgcaagtgcggcggcaactgccagtgcgacccctgcaactgcggcaagtgagctaggtgctccaccctgcaggccggccggaggaagctagctaattataaagcttaataaagtatagcggcgtcgctgtgtgtgtttcgagtcagtcagtcagtcagttgcgtgccatggcatgctccgagtctgagatgatgatgatgcctgatggcggcgtcgtgtcctcccctggccccctggggcgcttctggcgagcagtgtgttgtgttgtctctgtgggcgacgcacgataggac

SEQ ID NO: 9676 - protein, 83 aa, Zea mays
  misc_feature: Ceres CLONE 425695
  misc_feature (1)..(81): Pfam Name: Metallothio_2 Pfam Description: Metallothionein
MSCCGGNCGCGSGCKCGNGCGGCSKMYPDMAEQVTTTTTQALIMGVAPSKGHAEGGFEAAAGVENGGCKCGGNCQCDPCNCGK

SEQ ID NO: 9677 - DNA, 1025 bp, Zea mays
  misc_feature: Ceres CLONE 425766
  misc_feature: Encodes the peptide sequence at SEQ ID NO. 9678
ataaactcaaccacctccggagtccggacctcccccgttggccttctccatccggccatccccttcgcccttcctcactctctgtctcagtctctctccggcctccctcgcccacagagtcagagcggaagccgccgatctcggagcccagcacgccgccgccagccatgtcggtggatacggagcggagctccaccgagtcgtccgcggcctccgggctcggctacgaggacaccgcgctcgccctcaccctccgcctcccgggctccgaccccgggcgttcctccccgctcgccgcgccctccgacgctgcgccgtctcccaaggcgcgggtggtggggtggccgccggtgaggtcgtacctcaagaacgcgctcgccgactccagcaaggccagccgggcagccaatttcgtgaaggtggccgtcgacggcgcgccctacctgcggaaggtggacctccaggcgtacggcggctacgaccagctcctccgcgcgctccaggacaagttcttctcccacttcaccatcaggaagttcgccgacgacgagaggaagctggtggacgcggtgaacgggacggagtacgtgcccacgtacgaggacaaggatggcgactggatgctcgtcggcgacgtcccctggaagatgttcgtggagacctgccggcgccttcgcctgatgaaagattcagaggccgttaacttggcaccaagagccgcccgatgaggcgcaagcgcaactccaccgtcaccagtatgcactggcttttagtggcttggcttgttggaggaacgagggaacgtacttcgtcgctgttttgaggatcttcacttgacatatatatagcaatgtgtacagctgtcacctgctgcttttgcctgaggaaagtttgtagttccattactttacttatctgtagtgtctatctatctatctatagatccgaagctttgatatacacatggcggctacaatgtatttttgatgaataagaccagaccagagtaccagacacaccgaacc

SEQ ID NO: 9678 - protein, 186 aa, Zea mays
  misc_feature: Ceres CLONE 425766
  misc_feature (18)..(184): Pfam Name: AUX_IAA Pfam Description: AUX/IAA family
  misc_feature: The sequence is a functional homolog of SEQ ID NO 648 in the 11/479,226 US patent application
  misc_feature: The sequence is a functional homolog of SEQ ID NO 636 in the 11/479,226 US patent application
  misc_feature: The sequence is a functional homolog of SEQ ID NO 737 in the 10/374,780 US patent application
MSVDTERSSTESSAASGLGYEDTALALTLRLPGSDPGRSSPLAAPSDAAPSPKARVVGWPPVRSYLKNALADSSKASRAANFVKVAVDGAPYLRKVDLQAYGGYDQLLRALQDKFFSHFTIRKFADDERKLVDAVNGTEYVPTYEDKDGDWMLVGDVPWKMFVETCRRLRLMKDSEAVNLAPRAAR

SEQ ID NO: 9679 - DNA, 1503 bp, Zea mays
  misc_feature: Ceres CLONE 426239
  misc_feature: Encodes the peptide sequence at SEQ ID NO. 9680
attttgttcagtgatcatcaaccagtgcaccatggcgtctctgattcctccctgcctctccgtccccaccgccccgggacgcgcgcgccttgctgctccgggggcgccgcggcggaggaggatggcggtggtaagggcgaagattcgggagatattcatgccggcgctgagctcaacgatgatggagggcaagatcgtctcctggacggccgccgagggggaccgcgtgggcaagggcgacccagtggtggtcgtggagtccgacaaggccgatatggatgtggagacgttccactatggcatagtcgcagtcgtcctcgtcccggccggtgggaccgcccccgtaggcgcccctatcgccctcctcgctgaatcagaggaggaggtcgcgctggcgcgggcgcgcgctcaggccctctcgcagggacaaagccaggcaccctctcctccccatgccgccgccgccctggggccacctcctccagcgcctgtggcgcctccagcgacaaagggcatcgcgacaccttacgccaagaaactcgcgaagcagcacagggtggacatcgccggggttgtcggcaccgggccacacggccgcgtcacggcggctgacgtcgaggcagctgctggcatcaagcacaagcgaccccctccacctccaccccctgcttctgttgacgctgcgccactagtgcccgcaagtgcggtgctgccaccagtacccggtggcacggtggtgccgttcacgacaatgcaggcggcggtgagcaagaacatggtggagagcttgagggtaccgacattccgggttagctactccatgatcactgacaagcttgacgcactctatgagaaggttaagtcaaagggggttacaaagacagtgctgctggtgaaggcggcagctgtggcgctcacccaacaccctgtagtaaatgctagctgcagagatggaaagagcttctcctacaacaatgatgtcaacattggagtggctgttgcactcgagggtggccttcttactccagtattagaggatgctgataagatggatatatatctgcttgcacgaaagtggagagtgctgctcaagaaggcacgcatgaagcagctgcaaccaaatgaatacaactctgggacgtttacactatccaatttgggtatgtttggggtggataaattcgacgcaatccttcctgctggtcagggggctatcatggctgttggagcgtcaagacctactgtagtggctgataaggatggtttctttagtatcaagagtgaaatgctggtgaatgttactgctgatcacaggattatctatggtgctgatttggcagcattcctgcaaacatttgcaaagattgttgaggatcctgaatgcctcacattgtaagggaagcttcatacaagttctcaatttttttttattcacaattggaagacaatgccaatatagataataaaaagacacttttcaatgttacaaaaaaaaaaaaaaaa

SEQ ID NO: 9680 - protein, 454 aa, Zea mays
  misc_feature: Ceres CLONE 426239
  misc_feature (230)..(454): Pfam Name: 2-oxoacid_dh Pfam Description: 2-oxoacid dehydrogenases acyltransferase (catalytic domain)
  misc_feature (159)..(197): Pfam Name: E3_binding Pfam Description: e3 binding domain
  misc_feature (39)..(112): Pfam Name: Biotin_lipoyl Pfam Description: Biotin-requiring enzyme
  misc_feature (245)..(449): SWISSPROT Homolog: EC 2.3.1.12 Dihydrolipoyllysine-residue acetyltransferase
  misc_feature (40)..(109): SWISSPROT Homolog: EC 1.2.4.1 Pyruvate dehydrogenase (acetyl-transferring)
MASLIPPCLSVPTAPGRARLAAPGAPRRRRMAVVRAKIREIFMPALSSTMMEGKIVSWTAAEGDRVGKGDPVVVVESDKADMDVETFHYGIVAVVLVPAGGTAPVGAPIALLAESEEEVALARARAQALSQGQSQAPSPPHAAAALGPPPPAPVAPPATKGIATPYAKKLAKQHRVDIAGVVGTGPHGRVTAADVEAAAGIKHKRPPPPPPPASVDAAPLVPASAVLPPVPGGTVVPFTTMQAAVSKNMVESLRVPTFRVSYSMITDKLDALYEKVKSKGVTKTVLLVKAAAVALTQHPVVNASCRDGKSFSYNNDVNIGVAVALEGGLLTPVLEDADKMDIYLLARKWRVLLKKARMKQLQPNEYNSGTFTLSNLGMFGVDKFDAILPAGQGAIMAVGASRPTVVADKDGFFSIKSEMLVNVTADHRIIYGADLAAFLQTFAKIVEDPECLTL

SEQ ID NO: 9681 - DNA, 640 bp, Zea mays
  misc_feature: Ceres CLONE 426512-R
  misc_feature (506)..(506): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (515)..(515): n is a, c, t, g, unknown, or other
  misc_feature (519)..(519): n is a, c, t, g, unknown, or other
  misc_feature (520)..(520): n is a, c, t, g, unknown, or other
cgattgggtaccgggccccccctcgaggtcgacggtatcgataagcttttttttttttttttttgcagtagaaatgaccacgcgcacatggcttacattcaaacaagcgagccaaactgccacatacaaacacacgagatttcgtcccactctcacacacaagaagaacaagtcgcagcaaacagagatttaactgcagggacgaactttatcaaaaagaagggaagagtcggagagagacagagagagttgaaaaaaaaaaaactcgacagctagacaaactgggccaattaactgtggcggcagcagaaccgcactccaggccaggccggcaggcaggcacaggcacgcagccaccacacatggcgcaatcgactctgcaaactatactggtactacgtactagctactgatggctagccggacggcgctggcagacgcccggcgcgacgacgccctgcgttcaaatgtcgacggcgatgtcagcgaaggccggcgggtgccgncgnnnnccntccnngggagggcgcgtccgcgcccggcgccggcgcccggcccccgcggaggcccgagcagcatgtggccggaggcccccccgcgtaactccaagaagggggtccccccgccggggaatgtcccg

SEQ ID NO: 9682 - DNA, 957 bp, Zea mays
  misc_feature: Ceres CLONE 426809-R
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
nnnaacaaattgggtactctagcgtctcgtttttttttttttttttcacggagatctaagaacatgcgtatgatgtcttggagagcccaaacatggattcatcatttcatacgatgggttcagggtctacatgactgacaggactcatgaaaacagatacgatcacatacagatgaaatttgtcacaccatcatcaaatcttcacacaactgtctctgggttacacccaagttagatagagtcaccaagctttggctcatcaggcttcttgaccggcgtctcattgcccatctcacctttgagatccttgatgctctactccagctcatcaatcttggttcccactttcatctatcattgacacaacattctgcacaaaaacactccaaccgtgttggcttctgtccagggaccccccccgacaaaggcaggaatatctgatgaggtcccgcgatgatggattccgaagtccctgatagccagtggaaccccgatgtcgttggaggagagaaggggctcctccggacggtcccgcgggattcagcatgggaagtccggttttagccgcgaggttggctatttttctataggggtggagaacaaaattgtccttgcaacccccagggggggattccaactcttattccttggaagccgggcccgacccaaccatggggaggagaaacccttcccgacatttttgtggtttccccctatgtaggtggagggggttcaaatttggccacggccttggaggcgcaaaaacatggggtgaatatagactgtgtattacccagcggatggaaaacttggaggaattgcaccctccccgcaatattcccagccggtacaattactccttagaccccggtaaaaactaaaaaagaggctaaaaagcccccggagagggagcccctaaaaactaaaattggagccccaacttccaaagtcacaatt

SEQ ID NO: 9683 - DNA, 883 bp, Zea mays
  misc_feature: Ceres CLONE 426811-R
  misc_feature (442)..(442): n is a, c, t, g, unknown, or other
aattgcgtacctcgagcgtctcgtttttttttttttttttgttttttttttttttttttttttttttttttttttttttttttttttttttttgacatttgaatacgtttatttttgcattacttaattagggaaaattcacacatccattattcggcatgcccccgttatttcatccaatatatatttatttcaagttctggggcaaggaaaagaaatagcggctagcttatatattatcacccaatttggggcgtctgggcgacaatttccacaaaaatgcggacacggttagggcgataatccccggtcaccacggagcccacgggcagcaccacgatgtcggcgtccggcttgtccttgaggatcaccttcttggggtcctccaagctcagcccgaccacctcaggccacgaagtcttggcgccgccgccgccgccgncgaaattcgtggagctcatggtgtccgcgaactgccggaccagttgacaatttgatcgatgggcaggtaaaaacctgctgtttgcaccgctggtttgttgaatttttccaaggggggaaacaaattcctgcaccccggggggatcccctttttctaaaaggggccccccccccgggggaaacccccaccttttttttccctttaaggaagggttatatgccccccttgggggaaaaacaggggcaaaaacaggttttccccggggggaaaaatttttacccccctcacaatttcccccaaaaattttggaaccgggaaaactttaaatggttaaaacccccgggggcgcgccctttgggggggggcccacactccccccttttttttgggttgtggcgcgctcccaggcgcccccccttttttccgggggggggaaaaaac

SEQ ID NO: 9684 - DNA, 795 bp, Zea mays
  misc_feature: Ceres CLONE 426833-R
  misc_feature (1)..(1): n is a, c, t, g, unknown, or other
  misc_feature (40)..(40): n is a, c, t, g, unknown, or other
  misc_feature (49)..(49): n is a, c, t, g, unknown, or other
nccctttatttgctattcaagttgtatgtgacaaaaagtntttgtaaancccaaatgggtacggggccccccctcgaggtggagtgtatcgataagcccagtgatcgggtcttgagaaaggcgcctaacactttcctgtcttaacgaggcagacactctattcaattcagacggaaaacgaaaacaaaaactcggccgacccaccttttaatagaagaaactcggacgaccctttaattaatgaaagaaaggaaggactttgcctccgacgttcttgcgtcgggcctcctcgtgatccataattcccgcagaggttgtaagcacgatatagccaaactggcgagacggaagcagcctcgcagtccagccttcgatttcctttaccccaacatgaaacggggggctaattacaccggatttgtttagtctgccgttcagttccgccacaatcttccgggttctgtggtcatccacgtactccaactcccgaatgtatccgtgacgctgcatgaccgtcaggaacttgatgatcaccttggacgacagcctgatgatgacctgcctgttgtcccgcttctctgcgttgcacggggacttgagcgcatcgttgagcgacctgaccctcaccatgatgacctctacggaccgctggacccaagatgagggcgggcggcctacggcaggtcgctgggataggagactccggttagtaaaggtttttatggggggggggggggggcgacaacaacattacgaggccgggaaagcttaaaagggtaaaaagtcctggcgggg

SEQ ID NO: 9685 - DNA, 823 bp, Zea mays
  misc_feature: Ceres CLONE 426855-R
  misc_feature: SWISSPROT Homolog: EC 6.3.2.19 Ubiquitin--protein ligase
tttacaattgggtacctcgagcgtctcgtttttttttttttttttctttgcaatgcaacagaatatttttgttccatgaacaaggagcacatttattccagcagagaagcaacagtatgccctcagatttgggaccttacttcaattcgaaatattctctataactagcagggtggggggggagggggctacacaatcctctgcatttaagcactaatgccgaatatggagtttcgacttcatttcattttcagcccaagaaccactctctagatcaagctgcgggctgatgcctcgtacttaagaaaaatcgtcttgtccatctgagcaatctcccggacaagaagatcctctggcccgggatcagtaaacagccagcccatagaaaacaaaaccttccacattgtacaacccggcctccactggtccttaagaatggcgagacctacgcgtccattactattcatgtttgagatggccccccttcggctcacaagatacattagggtccctagaaccctcgtcctgggcggtaatgaatgttaccgtaagaaaacaccttcagcatatgtactatcagtaggacccatgatggctgccttcaagaaaaacatatcctcaccaacatgacctgcactgaataactttggaagggccttttgcagatcccttaattcctttatgaaaccctgtgattccatgttacaccctttgatctcgatcggggcgcggtcctttttctaagggagggacacaaagcaccctgcccgaggtggaacaggaatttttagtggcctctccccccccgtgtttatttctaatt

SEQ ID NO: 9686 - DNA, 1293 bp, Zea mays
  misc_feature: Ceres CLONE 437837
  misc_feature: Encodes the peptide sequence at SEQ ID NO. 9687
agacgtactcatacaacgacgcacgaacttcgtcgacccttctccccggtgcacatcacagtctccgcagcaacaccgatggcaacggccaatgtccagcagcagccacagccgcaggtggtagcggcggttggccgaaaggtggtggacgaggtttccggctggctgcgcgtgctggaggacggcagcgtggaccgcacgtggaccggcccgcgcgaggccctcccgctgatggagccggtggcgccgtacgcggtgccgcgagacgggcacacgctccacgacctgcccggggagccgaacctacgcgtgtacctccccgaggcgaacgtggaggccggcggcgcgcgcctgcccgtcatcctgcagttccacggcgggggcttctgcatctcccacccgtcctggctcatgtaccaccacttctacgcgcgcctcgcgtgcgccgtccccgccgtggtggtcgccgtcgagctgccgctcgcgcccgagcggcgcctgcccgcgcacatcgacgccggcgtcgccgcgctccgcaggctccgctccgtcgcgctggccgaggacgacggcgccctcgacgacccggcggccgcgctcctccgcgaggccgccgacgtgtcccgggtgttcctcgtcggggacagctcgggcggcaacctcgtccacctcgtggcggcccgcgtggcgagggaggcggacgcgggcagctgggcccccctccgcgtcgccggcggcgtccccattcacccggggttcgtgcgcgccacccggagccggtcggagctggagacgaaggcggactcggtgttcttcacgctggacatgctggacaagttccttgccttggcgctgccggagggcgccaccaaggaccaccccttcacctgccccatgggcccgcaggcgccgccgctggagtccgtgcacctgccgccgctgcttgtgtccgtggccgagaacgacctcatccgcgacactaacctcgagtactgcaacgcgctgcgcgccgctggcaaggaggtggaggtgctcatcaaccacggcatgagccactccttctaccttaacaagtacgccgtcgacatggactcaaccaccggggaacgagcccgagagctcatcgatgccatcaagagcttcatctcacgccattgaataaggacgtattattccgcacgtacgtgcgggatactgatcatatgtgctacgtgatacgtgagctgcttggaatcaccaaatttgttccggtatataaatgctatcaacttcagttgaaaaaaaaaaaaaaaa

SEQ ID NO: 9687 - protein, 359 aa, Zea mays
  misc_feature: Ceres CLONE 437837
  misc_feature (95)..(330): Pfam Name: Abhydrolase_3 Pfam Description: alpha/beta hydrolase fold
  misc_feature: SWISSPROT Homolog: EC 3.1.1.3 Triacylglycerol lipase
MATANVQQQPQPQVVAAVGRKVVDEVSGWLRVLEDGSVDRTWTGPREALPLMEPVAPYAVPRDGHTLHDLPGEPNLRVYLPEANVEAGGARLPVILQFHGGGFCISHPSWLMYHHFYARLACAVPAVVVAVELPLAPERRLPAHIDAGVAALRRLRSVALAEDDGALDDPAAALLREAADVSRVFLVGDSSGGNLVHLVAARVAREADAGSWAPLRVAGGVPIHPGFVRATRSRSELETKADSVFFTLDMLDKFLALALPEGATKDHPFTCPMGPQAPPLESVHLPPLLVSVAENDLIRDTNLEYCNALRAAGKEVEVLINHGMSHSFYLNKYAVDMDSTTGERARELIDAIKSFISRH

SEQ ID NO: 9688 - DNA, 1274 bp, Zea mays
  misc_feature: Ceres CLONE 438118
  misc_feature: Encodes the peptide sequence at SEQ ID NO. 9689
agctatcgcttctggcttctcctccctcctggtcctggccccggcctcctttccaagcttcaaggaaacatccaagcacttccctgttccaagtcaggagactaaacgctgttagcagtagcgaatcatacaccagcagcctagttagagttggatctgagcaatgggggaggagcgggcggcgccaaagccgggtccggctgccgccacggcggtggagctgacggggttcgtcatgggcgcggaggaggccgagcgcgcggcggcggccgccggcgtcgcgaccgtgcaagacctgctgccgctcctggtcccgtccgcgatggagcgggcgcgcgccccgatctcgcggttccgcgtgggcgccgtggggctgggcgccagcggccgcgtctacgccggcgtcaacctcgagttccgcggcctcccgctgtgccactccgtccacgcggagcagttcctcgtggccaacgccgccgccgcgggggagcccgcgctgcgcgccgtcgccgtctcccacatgccctgcggccactgccgccagttcctgcaggagatgcgcggcgcggcggccgtccagatcctcgtcaccagcgacgccgcggagggccgcgccccggagtggcgcgcgctggcgtccctcctcccgcgccccttcgggccccgcgatctcctccccgaggacgtggccctcgtcctcgagccgcacggcaacgaccttggcggtccggtcgccaatggcttcgcccgcggtgacctggacgcgcgcctgagggaggccgcggaggcggccgcgcgggcggcgcacgcgccctacagcaagtgcccctcggggttcgcggtggcggacggcgacgggaggatctacgccgggggctgtctcgagtccgctgcctacaacccgacgctgggccccgtccaggcggccatcattgggatggtggcggcaggaggcgggcccgccggggacgtggtcgcggcggcgctggtggagaaggagcgggcggaggtggcccaggaggcgacggccaggatcttcctcgaggccgtggccccacgcgccaccttccacgtctacaactacaggccgtccgatgcttgatgagcttctgtggcggtgggtctgttggggtgggatgggcaggacctgatcgcgataatgttcataaaagaataattttaagaataagatggtaaaatcatgtgcaggattgtgatgtggggcccacttattcagcgtgtttattgttcttctaacaaaaaaaaaaaaaaaa

SEQ ID NO: 9689 - protein, 312 aa, Zea mays
  misc_feature: Ceres CLONE 438118
  misc_feature (157)..(292): Pfam Name: dCMP_cyt_deam_2 Pfam Description: Cytidine and deoxycytidylate deaminase zinc-binding region
  misc_feature (40)..(142): Pfam Name: dCMP_cyt_deam_1 Pfam Description: Cytidine and deoxycytidylate deaminase zinc-binding region
  misc_feature: SWISSPROT Homolog: EC 3.5.4.5 Cytidine deaminase
MGEERAAPKPGPAAATAVELTGFVMGAEEAERAAAAAGVATVQDLLPLLVPSAMERARAPISRFRVGAVGLGASGRVYAGVNLEFRGLPLCHSVHAEQFLVANAAAAGEPALRAVAVSHMPCGHCRQFLQEMRGAAAVQILVTSDAAEGRAPEWRALASLLPRPFGPRDLLPEDVALVLEPHGNDLGGPVANGFARGDLDARLREAAEAAARAAHAPYSKCPSGFAVADGDGRIYAGGCLESAAYNPTLGPVQAAIIGMVAAGGGPAGDVVAAALVEKERAEVAQEATARIFLEAVAPRATFHVYNYRPSDA

SEQ ID NO: 9690 - DNA, 543 bp, Zea mays
  misc_feature: Ceres CLONE 438340-R
  misc_feature (115)..(115): n is a, c, t, g, unknown, or other
  misc_feature (215)..(215): n is a, c, t, g, unknown, or other
  misc_feature (291)..(291): n is a, c, t, g, unknown, or other
ccgattgggtaccgggccccccctcgaggtcgacggtatcgataagcttttttttttttttttttgaagagattggaagtccccattttgaccgtgtcatacattacaaaatttntgctgtgatgaacaccagagctgttcattcagatcctcacattctcctctatctatcatggttggtacatgcatcaagcattcaagctcagctctcaacnttattcagcgccatcaagactgaacagtgcttttatacatctcttactcgtactaattactgattctaaatctacntacactatatagagagagagagagagagagtcgcttgattaataaggaagtgtagtaaactagctacttccatgtttgcatgcatcctccgcttcacatgacggggcaagaattgcgtttcccgtccgtgaaaatgtccgccgaagccctcccgcggcgggcaaaaagggctccctttgcgggggggcgcctttaaaaaataaacccccgaaacaaaaaaccgctgggacacgggcccggggaaccataagg

SEQ ID NO: 9691 - DNA, 629 bp, Zea mays
  misc_feature: Ceres CLONE 438975-R
ccgattgggtaccgggccccccctcgaggtcgacggtatcgataagcttttttttttttttttttcttttttttttttttttttttttttttttttttttttttgcggagaacaagctccaaatccactattaccaagatagtacttaatatgaaagcaggggataataatgacgtttcccgacaacctgaatacttggcaatctgcagcacgaatttacatcctctagcttaacccaaaggaaagcaggggtttactatctatttgggctggaactaaattctacagcatggatatttaccaactggggcaaaaaaaaagctaacccaaaaccgtatgaacaaaagtaaggctaccccgggacgggacgcttgcggaatccccagttgagggaaatggatcagctcgggcacgttttcttctgggcactgctgaggggggaaaacgggcgctgaaacaagccccggagcccgctgtggcttgatccccccagggcgcatgtactggaggaactgaccgggcaattcctccaaaaaggattgcccgacggaaatctcccccccttggacttccctcctgggaacaaactggaccatgccccgggtcgcgatcctacccgaaaaagtttt

SEQ ID NO: 9692 - DNA, 1700 bp, Zea mays
  misc_feature: Ceres CLONE 439210
  misc_feature: Encodes the peptide sequence at SEQ ID NO. 9693
gacgtgcccttatcctcttatcccagcagccggcgcccgccgcgcgctcgacaaactgccgcgaactctcccggcctcacactccttgcgcccgccgcggcagatgccgctcaccggcattgccctcacgcctctcctcgtctcacctctcgcgccttccccgcgccgtagccgtgtagccacttccgccgcgagaaggccaagggctctccagcgagctcggtgctcggctacagccgcttccggtgaagccggtgagctgtcgcgcgcgacactgctatggagggcggcgaagctacccatctactccgtagcgctaataccactcacagtagggagcgcttctgcttattatcatgcaggcttattctttaccaagcgctattttgttctcctgacagcagcagtcctcgtgatcacttggctcaatctcagcaatgatgtttatgactcggatacaggggctgatagggacaagaaagaatctgttgtcagcattactggcagccgagcaatgacacaaaatgcggcgaacttttcccttttcctcggctttgcagggctactttgggcctttgcagaagccaaggatatcagattcattttattggtgatctctgcaatcttctgtggttatgtttaccagtgtcctccattccgattaagctaccaaggactaggcgagccgttgtgtttcgctgcatttggtccgttggcaaccacagccttttacttctcaaacagcagcttaaatacttcgagcggaggagcggctcttctccctctcactaaaacagttatagcttcatctgttctcgtcgggctgacaactactctgatactcttctgcagccatttccatcagatcgatggagatctcgccgttggaaagatgtctcctctggtaagaatcggcactaaatcaggatcgcggatagtgtcgattgggattgtcatgctttacattctcttggctacgtttgggacatgcggatctctcccgccatcttgcattgtcctctgtgcccttactctgcccatgggcaaaacggtcgtggactacgtgctgaaacatcacgaggacaacgcgaagatattcatggcgaagtactactgcgtgcggctgcacgcgctgtttgggatggcactggcctctggtttggtcttggcccgaaatggtatattagcctgacagacaggctcatagtcataggcggcgctgaaatccaggagagggtccagagcaccctggagtttcagaatcagcgagcaccctgttcctcaatttatgttctgaatctgaactacttctgattcgactatcgaacaggccgatgagaatggggcgcagtactgagcagctgcagttttgccaagaaacggtggagggaatggccctaggagaagtagaactactacagcgtcagaactcagatgcgcaccggcccgtatcggacggcaagtttggtgctcgagttcatttggttcagcgtccttgtacgctttggtccgctctcgggggcttgcttgctcgtgcacggtcagagactgccgttgcgccggggtccgggggatgccagtgtatgtatgcatatggattgaatcccaagcaaggacgagtcatgcactcatgtacaagcattacttctgtgcacagacgaccatacagattttatgagatcccaaaaaaaaaaaaaaaa

SEQ ID NO: 9693 - protein, 362 aa, Zea mays
  misc_feature: Ceres CLONE 439210
  misc_feature (68)..(357): Pfam Name: UbiA Pfam Description: UbiA prenyltransferase family
MPLTGIALTPLLVSPLAPSPRRSRVATSAARRPRALQRARCSATAASGEAGELSRATLLWRAAKLPIYSVALIPLTVGSASAYYHAGLFFTKRYFVLLTAAVLVITWLNLSNDVYDSDTGADRDKKESVVSITGSRAMTQNAANFSLFLGFAGLLWAFAEAKDIRFILLVISAIFCGYVYQCPPFRLSYQGLGEPLCFAAFGPLATTAFYFSNSSLNTSSGGAALLPLTKTVIASSVLVGLTTTLILFCSHFHQIDGDLAVGKMSPLVRIGTKSGSRIVSIGIVMLYILLATFGTCGSLPPSCIVLCALTLPMGKTVVDYVLKHHEDNAKIFMAKYYCVRLHALFGMALASGLVLARNGILA

SEQ ID NO: 9694 - DNA, 618 bp, Zea mays
  misc_feature: Ceres CLONE 439313-R
  misc_feature: Encodes the peptide sequence at SEQ ID NO. 9695
ccgattgtgtaccgggacccccctcgaggtagatttatacgaccccccctccccggtttattgttcaatttgatcacagctggccatggatgtgaagcagcatttgcagctgcagttctgggtgataatgccctcatggagaaagcatggcaagacacaggaatgctggctgaggccgttttacatgctcaagcccatggtcgtccatcgttaaggagctcagtcataacatggaacaagatgctgcaaaaggagctggatcacatgccaaccgtaaaaaccgatgctgcagcagcattcttggcttctcttgaggacccgaagctcactagtttgggagaaactgagaaaaagccaccaattgaaatacttcctcctggaatgccgcctctatctgcacctcccattattattaaaaaggctgctgcaaaacctgggcttcctaatgccgcacagaccccaggtgctcccatgaatcaaggcaccccaatggctcaaggtactcccatgaatcaaagcaccccaatggcccaaggtactcctgtggctcaaggtgcccccatggctcaaggccctcctgctctggcacaaagcaccgatgacgtaaaggcattctag

SEQ ID NO: 9695 - protein, 205 aa, Zea mays
  misc_feature: Ceres CLONE 439313-R
PIVYRDPPRGRFIRPPLPGLLFNLITAGHGCEAAFAAAVLGDNALMEKAWQDTGMLAEAVLHAQAHGRPSLRSSVITWNKMLQKELDHMPTVKTDAAAAFLASLEDPKLTSLGETEKKPPIEILPPGMPPLSAPPIIIKKAAAKPGLPNAAQTPGAPMNQGTPMAQGTPMNQSTPMAQGTPVAQGAPMAQGPPALAQSTDDVKAF

SEQ ID NO: 9696 - DNA, 670 bp, Zea mays
  misc_feature: Ceres CLONE 439418-R
  misc_feature: SWISSPROT Homolog: EC 3.2.1.2 Beta-amylase
caattgggtaccgggccccccctcgaggtcgacggtatcgataagcttttttttttttttttttgttgtaaatttcatcagtatttcattaatagccttcccctaaaaggagaacgaagcagaagcgtgcacaggtacaatgtcggtgtcatgacatggtgctgttagcgcaactgcatatatcactggccatgccattcctgttgcggatcaatggttcgtgtccaacggaaatgctgatgacaggtcacaagagggattgaggagggcctgaccgcctgagtgcgatctgattctgatcctatccaaataaccacgcgatcttgtcgagcacccagtcgacagcctctgcgagcccgccgccgacgctcatgtcggtctccggatcaaacaggaacgccggcgccggcgcggtggcttccagcaactgctccatgggcatctccggcgcggaccgctctaggggcttgaggggccgaccgtaccggtccgcatcagggcagtaatccaggtcggcgtgcattttgcggacgaaggtccggaagatccggaagttgttgctcgccaggagctcgtccgagagccggaggaacatcaccgccacgaccctgcgccgcgcggcgccggcgccggagagacccacgccgttgggccgcgcgttgagcagcat

SEQ ID NO: 9697 - DNA, 1899 bp, Zea mays
  misc_feature: Ceres CLONE 439447
  misc_feature: Encodes the peptide sequence at SEQ ID NO. 9698
acacatgtgtgtgcagtgtagacgagcgcgtacgtaacttattgggaggttgcgcgtacggcaactcccgtcgcctccgcgctcccctaaccgcctcccccttgtctcatggtggaagtggaacaaccctccgcctgcgccgctgcgaagtaagtgagaagggaaaacaagaaacgaggagggagggaggggacgacgtacggagcgagctagcggcgcggcgggcgtcgctcggcatggacgcggaggcggcggcggcggcggcggcgacggcggtggaggagagggagcggctgcggaggagcttcgcgtcggggaggacgcggccggcggcgtggcgggaggcgcagctgcgcggccttctgcgcatggccgccgagagggaggacgacatctgcgccgccctgcacgccgacctcgcgaagccccttaccgagtgttatgtacacgagatatcattggtcatttcttcgtgcaaatttgctctcaagaatctcaagaaatggatgaagccccgaaaggtccccggcgggctgctgaccttcccgtcggcggccagcgtcgcggcggagcctctcggcgtcgtgctcgtcatctccgcctggaactaccccttcttgctggccatcgacccggtcgtgggggcattcgcggcgggcaacgccgtggcgctgaagccgtcggaggtggcgccggccacgtcgttgctgctggccgacctgctgccgcgctacgtggacccctcgtgcgtcagggtcgtgcagggcggcatcccggagaccaccgcgctgctggagctccagtgggacaagatcttctacacaggtaacagcagagtaggacgcatcgtcatgtcctacgctgccaatcacctgacgcccgtggtcttggagctcggtggcaaatgccctgtcgtcgtcgactccgacgtcaacctccacgtcgctgccaagaggatcgccgccggcaagtggggctgcaacagcggccaagcctgcgtctcgccggactacgtcgtcaccaccaaatcgttcgcgccaaagctgctggagtccctgaagcgagtgctattcgagttctacggggaggagccgctgcggtcgccggacctgtcgcgcgtcgtcaactccaaccacttcaacaggctcatggcgctcatggacgactactcggtctccggcaatgtcgcgttcggcggccagatcgacgagcggcggctaaggatcgccccgacgctgctgctggacgtcccgctcgactccgcgatgatgaaggaggagatcttcgggccgctgcttcccataatcacggtggacaagatcggcgagagcttcgctgtgatcaactccatgcccaagccgctggcagcttacctcttcagcaacgacgggcagctcaagcagcagttcgagaggaccgtctcggcgggagggatcatgttcaacgacaccggcatccacctgacaaacccgaacctgccgttcggaggagtcggggagagcggcatgggcgcctaccacggcgccttcagcttcgacgccttctcccacaggaaggccgtcctggaccgcagcttcctcggcgaggccagggccaggtacccgccgtacacgccggcgaagctcgccatcctcaggggcgtgctcaatggcagcccgcttgccacggttcaggcggctgcggggtgtacaggaggggcatcagctgactgactgactgaccccccttcatgcttattattaataataagcataaatattcaccgcatacacattgctgtgcttttattaaggttgttgtgagggcgaaaaatgtattgaccctttgcgtgtgcgcgtgcgtgtatagcaactattaataaaagaaaaaagtgatgttcattcaaaaaaaaaaaaaaaa

SEQ ID NO: 9698 - protein, 491 aa, Zea mays
  misc_feature: Ceres CLONE 439447
  misc_feature (1)..(442): Pfam Name: Aldedh Pfam Description: Aldehyde dehydrogenase family
  misc_feature: SWISSPROT Homolog: EC 1.2.1.3 Aldehyde dehydrogenase (NAD(+))
MDAEAAAAAAATAVEERERLRRSFASGRTRPAAWREAQLRGLLRMAAEREDDICAALHADLAKPLTECYVHEISLVISSCKFALKNLKKWMKPRKVPGGLLTFPSAASVAAEPLGVVLVISAWNYPFLLAIDPVVGAFAAGNAVALKPSEVAPATSLLLADLLPRYVDPSCVRVVQGGIPETTALLELQWDKIFYTGNSRVGRIVMSYAANHLTPVVLELGGKCPVVVDSDVNLHVAAKRIAAGKWGCNSGQACVSPDYVVTTKSFAPKLLESLKRVLFEFYGEEPLRSPDLSRVVNSNHFNRLMALMDDYSVSGNVAFGGQIDERRLRIAPTLLLDVPLDSAMMKEEIFGPLLPIITVDKIGESFAVINSMPKPLAAYLFSNDGQLKQQFERTVSAGGIMFNDTGIHLTNPNLPFGGVGESGMGAYHGAFSFDAFSHRKAVLDRSFLGEARARYPPYTPAKLAILRGVLNGSPLATVQAAAGCTGGASAD

SEQ ID NO: 9699 - DNA, 656 bp, Zea mays
  misc_feature: Ceres CLONE 439486-R
  misc_feature: Pfam Name: TFIIF_beta Pfam Description: Transcription initiation factor IIF, beta subunit
cgattgggtaccgggccccccctcgaggtcgacggtatcgataagcttttttttttttttttttgctgaaatttcagatcctccactttctctgtgttgagtggctaaaacttagtgttacaaatagtaatattttatacccatgaagcacatttatcaggcaattgtttcaaaacttttttcctttccctaaaaaacgtgtatccagcttatattgttacagaaaagaacgcctgttaaagcatacacatgaaactggatcacaattgtgtttgtgtggcctgagttaccaacagagaactatcgattctaccacgtcgtctatcatcttcaagcagtatcagtgtcccctgtggatttcttgtactcaggcttcagctcatgcgttccctggtttggtcctcgtttattatacacacacagatcgttcaatatctccttcaggaattgctctggctggtcagtttcttgcacgagggcctttagggcccaattgggctgcctttcaaaaagcttgaatataacgttttccatctccgtgcgatccctacgagttcttttggcatcagatggtttcgctggtgcttgcttcttcttttcctttgaactagaagatatgagaccaacaatgccaggcattggcctcatgctcattc

SEQ ID NO: 9700 - DNA, 673 bp, Zea mays
  misc_feature: Ceres CLONE 439615-R
  misc_feature: Pfam Name: Glycos_transf_2 Pfam Description: Glycosyl transferase family 2
  misc_feature: SWISSPROT Homolog: EC 2.4.1.12 Cellulose synthase (UDP-forming)
  misc_feature (1)..(1): n is a, c, t, g, unknown, or other
ncgattgggtaccgggccccccctcgaggtcgacggtatcgataccatctggagccgatcagtcaggggaaagacgggccactttaccaaggactcctgatggctgtcatgatggtgatggcagtgggaatgtagaacattccccaggcagggatgctgacttcggggaccatgacagacagtgggatcacgacgcagtagaacaggaacgttaggatgggagcgatgacccttcggacaaagaagaagctgtacagaaggtgaagcttcttccatacagttacccccttgcttataacaatgtccccggccattttcctgaagaggttggcagcaccacaagtccacctgtgctgttgatgacggtatgccttgaaagtacttgggagttcactcttaacctgtacaaaaaaccttatatcaccaacatacaggaattgccatcccttgaggcttgcccgcacagccaagtccatgtcttccacagtggtgcgatccttccatcctcctgcttcaccgatagctgatacccgccacacgccagccgtaccgttgaaaccaaagaaggcatgcatagatgaccctgattcctgctctaccttaaaatgataatctagcgacatcttctgtatccttgtcagtaggcaaatattgtagttcactgcaaaattgc

SEQ ID NO: 9701 - DNA, 1119 bp, Zea mays
  misc_feature: Ceres CLONE 439961
  misc_feature: Encodes the peptide sequence at SEQ ID NO. 9702
acacgatgtcgtggcctggcctctgtctctccacgccgccgctagccagagccaagctactgctttgcttcctgctgacttgctcatcgccgccgctagcctagcccgctacaggctatagcctacgccctacagcttcccgcaatcctgctcgtgccgctactagccaccgacagccagccgcgcggaccgccctccactaccagctgcgacgtcggccgcgacggcgccctcgacgtcgactgtgtgcccgtgacgccgccctcgacgccggccacaaggacgcccttgacgccagccgcgacgctggccacaaggacgccctcgacggcagccacaaggacgcccttgacgccagccgcgacgatgccctcgacgctggccacaggcctcccttgacaccaacacaaatatttgtgcacagagccacagactagagcgccctcgtcaccggccagaccagatcagctagctgttcagctttgaaacgaccaacacttgtgcgcagacttgagcgccctcgacgtcgcccacggctctggagtctgctccatttctgagatgacgcagccggttggaagtaatgctccctcaggctcagccatgagattggccaagttgatgtctaccacaagagcaccttctactcgcaaaacaaattcgatattctctgcatatgctcaagggttgaaaagaaaagctgaagcctcttctagtcggattcggaatgtacgtgcacgcgcgcgcgggcatggatatggccgcacatcactatcatcctcaacagctgaggccgagagacattttattcagagtgtcagcagtagcaatgcaaatggtacaactacaaatccgagtcaagatgttgttgctattgttgatgaaccacaaatccgagacattttattcagagtattcagacattttactgctgctgttgtacttctgtggtgcatactgcttgctatcttgctattttacattactgttggtgtgtactacttgttgctgggacatactgcttgctgccttgttattcacttgactgttggtgcatagctgttgttgtttgatactacttgcatactaattcatgttggatgcaaaaaaaaaaaaaaa

SEQ ID NO: 9702 - protein, 165 aa, Zea mays
  misc_feature: Ceres CLONE 439961
MTQPVGSNAPSGSAMRLAKLMSTTRAPSTRKTNSIFSAYAQGLKRKAEASSSRIRNVRARARGHGYGRTSLSSSTAEAERHFIQSVSSSNANGTTTNPSQDVVAIVDEPQIRDILFRVFRHFTAAVVLLWCILLAILLFYITVGVYYLLLGHTACCLVIHLTVGA

SEQ ID NO: 9703 - DNA, 673 bp, Zea mays
  misc_feature: Ceres CLONE 439962-R
ccaattgggtaccgggccccccctcgaggtcgacggtatcgataagcttttttttttttttttttcttttttttttttttttgcacatatacattatcatcattggaaataaatacgaatccaaacatcagatttttcattaacaccatacgaagatttgaaatgttcaattggcagggaataaatgagtacttctactacatctttagaaagccaaactttttcataggggttgagcgaacgacaaggcccttagtccaggtcccgagttgatgacctccgaacagacagcagcgagcatgcatagaactgatgcatcatgtacgcaatttaatcgcagtccaccaatcatattctaggatggtttggacggtcgaacaacctgtataagtgcaagtcttcgtgtgtagctcggaaataagatactgttatacgttgtagtagcacattacttgcgcctgaagaaaataggaatccttatattttctgccactcccgatgtggacaccatttttaatccattcagaataatcatccacgcatcctatatatgtaccctcttttatttttttctctctcttttaaacttgctgctgttatttgttatttgaattaaagttacgtataccgtatacgtacgtcaaagagtaaaaaaaaaaaaaaaaaatttgaa

SEQ ID NO: 9704 - DNA, 1331 bp, Zea mays
  misc_feature: Ceres CLONE 439990
  misc_feature: Encodes the peptide sequence at SEQ ID NO. 9705
acactgccgtgcaccaaagccgaagcccgctgtcgctgtcggccctggcacccgcgggcaccaaagccacctgccgtcgagcgctccgccgccgtcgccaccatcttgtgcctgcccaggtcacttgtcgtcgttgccatgccatcaaacgagaggagggccccgtcgccgtcgccatctcggccgaccgcgtagccctgctggcgcacctcgctgggccactggacgcctatctccatccgtgcagcctcccaacgcccaagcaggttccaccgctcctccccacaagcaccaccacctcaatggtgtcgatccagcaagggagggccagatataggccgacgggacctagatctgccggcaagcgcagcccttacacccacctctcctcctccccacccctaagtcgtttctcacgcagaggaccgcgctcgtgagaggcaggggcgcgcggtctacgtcgacacctgcccttgaatccgcctgcatcgacaaccttcatgccgccgccgcccttcaagtagtcgccaatgccgcgtggcacccgcccttgaggtgtgggtgtgggtgggaggggagagctgaggagctcctcgtcgccgccttcctcgtgcccgctgtcagtattcagactgacgaagctgacgatggcgccaagaagactgatattcagaagctaccgtagcaccagaacttctctctttgatggcattgaggagggtggaatcagggcaacatcctattcttcccatgagattgatgagcaagaaaatgatggagcgattgatggattgcaggatcgtgtcagcattctcaagcggttgtcaggtgatatccacgaagaggtggagactcataacagaatgctagaccgaatggggagcgacatggatacatcaaggggctttctctctggcaccgtgggcaaattcaagacggtgttcgagaccaaatcgggtaggaggatgggaacccttgtcgcatcattcgtcgccctttttctgctggtttactacttgaccaggtagaatcatccacggtggaagttttgtggggctgggcgtgttcaagaacattctgaaaatggacgtgctgatctggtggtgccgtgccgcgtatatatatatacactcatgagtagcaaagtatgctgatgtgggttccgtgaacaccgcagcgtgttgggtcgatcctctgctacaggaaattgttgtccgttcctttggcatgatatgtgtgtatggagggagtatgtacatgttgtattaccgtactagtaaggtcctctttagaatcaattaaattattttttagcaaaaaaaaaaaaaaaa

SEQ ID NO: 9705 - protein, 126 aa, Zea mays
  misc_feature: Ceres CLONE 439990
  misc_feature (41)..(103): Pfam Name: SNARE Pfam Description: SNARE domain
MAPRRLIFRSYRSTRTSLFDGIEEGGIRATSYSSHEIDEQENDGAIDGLQDRVSILKRLSGDIHEEVETHNRMLDRMGSDMDTSRGFLSGTVGKFKTVFETKSGRRMGTLVASFVALFLLVYYLTR

SEQ ID NO: 9706 - DNA, 663 bp, Zea mays
  misc_feature: Ceres CLONE 440028-R
  misc_feature (250)..(250): n is a, c, t, g, unknown, or other
  misc_feature (251)..(251): n is a, c, t, g, unknown, or other
  misc_feature (252)..(252): n is a, c, t, g, unknown, or other
  misc_feature (253)..(253): n is a, c, t, g, unknown, or other
  misc_feature (254)..(254): n is a, c, t, g, unknown, or other
  misc_feature (255)..(255): n is a, c, t, g, unknown, or other
  misc_feature (256)..(256): n is a, c, t, g, unknown, or other
  misc_feature (257)..(257): n is a, c, t, g, unknown, or other
  misc_feature (258)..(258): n is a, c, t, g, unknown, or other
  misc_feature (259)..(259): n is a, c, t, g, unknown, or other
  misc_feature (260)..(260): n is a, c, t, g, unknown, or other
  misc_feature (261)..(261): n is a, c, t, g, unknown, or other
  misc_feature (262)..(262): n is a, c, t, g, unknown, or other
  misc_feature (263)..(263): n is a, c, t, g, unknown, or other
  misc_feature (264)..(264): n is a, c, t, g, unknown, or other
  misc_feature (265)..(265): n is a, c, t, g, unknown, or other
  misc_feature (266)..(266): n is a, c, t, g, unknown, or other
  misc_feature (267)..(267): n is a, c, t, g, unknown, or other
  misc_feature (268)..(268): n is a, c, t, g, unknown, or other
  misc_feature (269)..(269): n is a, c, t, g, unknown, or other
  misc_feature (270)..(270): n is a, c, t, g, unknown, or other
  misc_feature (271)..(271): n is a, c, t, g, unknown, or other
  misc_feature (272)..(272): n is a, c, t, g, unknown, or other
  misc_feature (273)..(273): n is a, c, t, g, unknown, or other
  misc_feature (274)..(274): n is a, c, t, g, unknown, or other
  misc_feature (275)..(275): n is a, c, t, g, unknown, or other
  misc_feature (276)..(276): n is a, c, t, g, unknown, or other
  misc_feature (277)..(277): n is a, c, t, g, unknown, or other
  misc_feature (278)..(278): n is a, c, t, g, unknown, or other
  misc_feature (279)..(279): n is a, c, t, g, unknown, or other
  misc_feature (280)..(280): n is a, c, t, g, unknown, or other
  misc_feature (281)..(281): n is a, c, t, g, unknown, or other
  misc_feature (282)..(282): n is a, c, t, g, unknown, or other
  misc_feature (283)..(283): n is a, c, t, g, unknown, or other
  misc_feature (284)..(284): n is a, c, t, g, unknown, or other
  misc_feature (285)..(285): n is a, c, t, g, unknown, or other
  misc_feature (286)..(286): n is a, c, t, g, unknown, or other
  misc_feature (287)..(287): n is a, c, t, g, unknown, or other
  misc_feature (288)..(288): n is a, c, t, g, unknown, or other
  misc_feature (289)..(289): n is a, c, t, g, unknown, or other
  misc_feature (290)..(290): n is a, c, t, g, unknown, or other
  misc_feature (291)..(291): n is a, c, t, g, unknown, or other
  misc_feature (292)..(292): n is a, c, t, g, unknown, or other
  misc_feature (293)..(293): n is a, c, t, g, unknown, or other
  misc_feature (294)..(294): n is a, c, t, g, unknown, or other
  misc_feature (295)..(295): n is a, c, t, g, unknown, or other
  misc_feature (296)..(296): n is a, c, t, g, unknown, or other
  misc_feature (297)..(297): n is a, c, t, g, unknown, or other
  misc_feature (298)..(298): n is a, c, t, g, unknown, or other
  misc_feature (299)..(299): n is a, c, t, g, unknown, or other
  misc_feature (300)..(300): n is a, c, t, g, unknown, or other
  misc_feature (301)..(301): n is a, c, t, g, unknown, or other
  misc_feature (302)..(302): n is a, c, t, g, unknown, or other
  misc_feature (303)..(303): n is a, c, t, g, unknown, or other
  misc_feature (304)..(304): n is a, c, t, g, unknown, or other
  misc_feature (305)..(305): n is a, c, t, g, unknown, or other
  misc_feature (306)..(306): n is a, c, t, g, unknown, or other
  misc_feature (307)..(307): n is a, c, t, g, unknown, or other
  misc_feature (308)..(308): n is a, c, t, g, unknown, or other
  misc_feature (309)..(309): n is a, c, t, g, unknown, or other
  misc_feature (310)..(310): n is a, c, t, g, unknown, or other
  misc_feature (311)..(311): n is a, c, t, g, unknown, or other
  misc_feature (312)..(312): n is a, c, t, g, unknown, or other
  misc_feature (313)..(313): n is a, c, t, g, unknown, or other
  misc_feature (314)..(314): n is a, c, t, g, unknown, or other
  misc_feature (315)..(315): n is a, c, t, g, unknown, or other
  misc_feature (316)..(316): n is a, c, t, g, unknown, or other
  misc_feature (317)..(317): n is a, c, t, g, unknown, or other
  misc_feature (318)..(318): n is a, c, t, g, unknown, or other
  misc_feature (319)..(319): n is a, c, t, g, unknown, or other
  misc_feature (320)..(320): n is a, c, t, g, unknown, or other
  misc_feature (321)..(321): n is a, c, t, g, unknown, or other
  misc_feature (322)..(322): n is a, c, t, g, unknown, or other
  misc_feature (323)..(323): n is a, c, t, g, unknown, or other
  misc_feature (324)..(324): n is a, c, t, g, unknown, or other
  misc_feature (325)..(325): n is a, c, t, g, unknown, or other
  misc_feature (326)..(326): n is a, c, t, g, unknown, or other
  misc_feature (327)..(327): n is a, c, t, g, unknown, or other
  misc_feature (328)..(328): n is a, c, t, g, unknown, or other
  misc_feature (329)..(329): n is a, c, t, g, unknown, or other
  misc_feature (330)..(330): n is a, c, t, g, unknown, or other
  misc_feature (331)..(331): n is a, c, t, g, unknown, or other
  misc_feature (332)..(332): n is a, c, t, g, unknown, or other
  misc_feature (333)..(333): n is a, c, t, g, unknown, or other
  misc_feature (334)..(334): n is a, c, t, g, unknown, or other
  misc_feature (335)..(335): n is a, c, t, g, unknown, or other
  misc_feature (336)..(336): n is a, c, t, g, unknown, or other
  misc_feature (337)..(337): n is a, c, t, g, unknown, or other
  misc_feature (338)..(338): n is a, c, t, g, unknown, or other
  misc_feature (339)..(339): n is a, c, t, g, unknown, or other
  misc_feature (340)..(340): n is a, c, t, g, unknown, or other
  misc_feature (341)..(341): n is a, c, t, g, unknown, or other
  misc_feature (342)..(342): n is a, c, t, g, unknown, or other
  misc_feature (343)..(343): n is a, c, t, g, unknown, or other
  misc_feature (344)..(344): n is a, c, t, g, unknown, or other
  misc_feature (345)..(345): n is a, c, t, g, unknown, or other
  misc_feature (346)..(346): n is a, c, t, g, unknown, or other
  misc_feature (347)..(347): n is a, c, t, g, unknown, or other
  misc_feature (348)..(348): n is a, c, t, g, unknown, or other
  misc_feature (349)..(349): n is a, c, t, g, unknown, or other
  misc_feature (350)..(350): n is a, c, t, g, unknown, or other
  misc_feature (351)..(351): n is a, c, t, g, unknown, or other
  misc_feature (352)..(352): n is a, c, t, g, unknown, or other
  misc_feature (353)..(353): n is a, c, t, g, unknown, or other
  misc_feature (354)..(354): n is a, c, t, g, unknown, or other
  misc_feature (355)..(355): n is a, c, t, g, unknown, or other
  misc_feature (356)..(356): n is a, c, t, g, unknown, or other
  misc_feature (357)..(357): n is a, c, t, g, unknown, or other
  misc_feature (358)..(358): n is a, c, t, g, unknown, or other
  misc_feature (359)..(359): n is a, c, t, g, unknown, or other
  misc_feature (360)..(360): n is a, c, t, g, unknown, or other
  misc_feature (361)..(361): n is a, c, t, g, unknown, or other
  misc_feature (362)..(362): n is a, c, t, g, unknown, or other
  misc_feature (363)..(363): n is a, c, t, g, unknown, or other
  misc_feature (364)..(364): n is a, c, t, g, unknown, or other
  misc_feature (365)..(365): n is a, c, t, g, unknown, or other
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (369)..(369): n is a, c, t, g, unknown, or other
  misc_feature (370)..(370): n is a, c, t, g, unknown, or other
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (374)..(374): n is a, c, t, g, unknown, or other
  misc_feature (375)..(375): n is a, c, t, g, unknown, or other
  misc_feature (376)..(376): n is a, c, t, g, unknown, or other
  misc_feature (377)..(377): n is a, c, t, g, unknown, or other
  misc_feature (378)..(378): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (446)..(446): n is a, c, t, g, unknown, or other
  misc_feature (447)..(447): n is a, c, t, g, unknown, or other
  misc_feature (448)..(448): n is a, c, t, g, unknown, or other
  misc_feature (449)..(449): n is a, c, t, g, unknown, or other
  misc_feature (450)..(450): n is a, c, t, g, unknown, or other
  misc_feature (451)..(451): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
caattgggtaccgggccccccctcgaggtcgacggtatcgataagcttttttttttttttttttctttttttttttttttttttttttttttttttttttagcacccaagtacgtacaatacaccaactgaagcacgttgtacatacaggatcttacagcactccttgggtctactgtcaaatcctggctaaatgtagtaacacataaagcatattctacgcaaattcccagaatcttggaagccttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnna

SEQ ID NO: 9707 - DNA, 649 bp, Zea mays
  misc_feature: Ceres CLONE 440113-R
  misc_feature (1)..(1): n is a, c, t, g, unknown, or other
ncaattgggtaccgggccccccctcgaggtcgacggtatcgataagcttttttttttttttttttgcacaagtccaataacaatatttatctattcaaatacattgcacgtcactattccatagttgacaactaatataaaaatacaatacacccttcggtgaagatcattcccatcccccatgcaatgtatttttacttctccaatgagagcaacagaataccttgctcatgcattaactgcgccttgtaatctgtctaagtctgtctggtccacacagaagtcatactccacgagtccaccaacttttggtagtactcaagctccttatctatcattgcttgaagcgggggtccaatagccttgttgtaggccttggtatcccatccccgtgaacgtgatcctatgctcctcaggtgcatcgtgatcttggtgttgtgtacaatggcagaggacgaatttttttttggtatggctctacacaactttgattttgctttgcttactgttacagctcggaaggcacaggcgcgtcagcgcgtggcccgtggccggaaggctgggcgcctgggcacagcagcggacgctggctcgccggctcggcacagaaggccggaaagttggggccgctgggcagtgggcatagtgg

SEQ ID NO: 9708 - DNA, 686 bp, Zea mays
  misc_feature: Ceres CLONE 440718-R
  misc_feature (545)..(545): n is a, c, t, g, unknown, or other
ccgattgggtaccgggccccccctcgaggtcgacggtatcgataagcttttttttttttttttttctaagccacgatgaaagcatagatctagcaaaacgacattataacgtatcgccatgtttgaaagttccacagcccccgacaactcaaactcatcagaaatactcgctccattatttgaacatacaggccgctatgatgttaacagcaaacactagccaatacatatcgttctggaatcgtattgatgagcactctttggagagggcacaaactagctcctcttgtcggcgtagctgtccggctcatcgtccttgaagatatcatccatggtttcttcattcttgttaccaccaaagttatcatcaggtgtgccagagaacccatcatcgcctgtggaaccgccggttgcatcaaagccaccagcaccgtttccaccaaaactactgtcagaaccaaagttactgttggcaaagctgtcgctacctccagcagtaaaggtgcctccacctccaccagcaactccataatcaccaccaccancccctgttgcggttgccaccatagtcgccgccaccgtatccaccgccgccgccaccaccaccatagcctccaccaccaccatagccaccgccaccaccaccatatcctccaccaccaccgtagccgccgccaccatagcca

SEQ ID NO: 9709 - DNA, 666 bp, Zea mays
  misc_feature: Ceres CLONE 440741-R
  misc_feature: SWISSPROT Homolog: EC 1.3.3.4 Protoporphyrinogen oxidase
ccgattgggtaccgggccccccctcgaggtcgacggtatcgatatttttttttttttttttatttttttttttgaaagcatgctactattggatttttcgtagcatcaattctaatttctaaatttaaatggcctgtgttcaacaggaacgagcagagtttgctttaccgatgaagcgacacagaccatctgcgtacaatccactagtagaatctatcatgacaaactcagctaatgttccagaggtaagttcaataggagtatttggaagattaagtcagatagcataatttctgacaatgaattgtaaatctagaaaacaggtagtagtcttccgtatgtcaaccagatgctttacatctgattttggagagattatccactctggttcaagggccaccatcgaaaaggttccaatcacgcacattgaaattcgtcactgcaagttggaagacctcagacattggcaagcaccctacttgttcagcaggtattgccggaccagctgcaactgccacagcactttcactcagggggctggatgtaatggcatttggaagcatggcaagacccttcctgaaagacgcaactgtctgcccttttggcttcggaaggcgggcatccctcggtggttttggattcttgctcctctcctgaattgtcttg

SEQ ID NO: 9710 - DNA, 1308 bp, Zea mays
  misc_feature: Ceres CLONE 441364
  misc_feature: Encodes the peptide sequence at SEQ ID NO. 9711
aaccaaaaccctagaaggcccacggccaccgtggcaccgtgccgcctccccaacctcagcgactccggcggtggtcgagtcgagcccgctagaaatctttctgcttcggttctctgcttgcagcgatgatggacagctctttgcaagtctagatgtgtgacctagtacctaagaaagattaatgcattgtggccttgtaccccccactcaagttaggaccagccacaggtcatagcattttgtgccggccttcgaggccttaatgtttctgcgtgtaattgatcgaccatccattgccatcctcaggaaaggagaccgggactagggtagctgcatggctgcgacctgctgaagaattgagcaaagccaagcaccctagcttcttagatttctaagctggcatgcaatgccgatgacagggacctactctttggggattcttaggattcaagtatccttcactggtcactttttaatgttctgaaagggagaaaggggaaaaatacagagagaaggggaaaaggccactgagtgaggtagggcaaaaagggactccaatctaaggctgtctttaatggcccaacaattattcagctctgcgattgtgaggtggaatttgctggaccatcaatttagccagcccaattcggtcttgtactgctccacatgtgaaaatttttgcatgccttgccacaccaccagagggcgtcatcctgtgctgaaagggggaggaagctgacgatgaagaggctgttgatcctgcaaaggtgtgagccgatcgtgcggttcagctgctgcagcgtgcgctacggggactgccgtcggaaccatgcagcgagtactggaggccacgcagttgatggatgccgagagttcatcgctgaaggggaggagggcaccagtggtgctctaaagtgcgccgcctgcggttgccaccgcagcttccaccgcagggttcaggtgtatgaggttgcatggggttatggatccgacacgtcgtcgactgagtagagaggggaggtgcaagccacttggagcttggatttgtgcttcctgcagcggcaaacgcccaacaatattggccccccttcttctctgtctccggtgacaagctgaccggtggatgtataggagccttttgtgattgtttgtagctccgtacgccctgatttgacacgtcggaattcttacctaaagtttctttgtctgctatgctacacccgtgtattgtattctgagtgaagtatacatgagatgagagttcaaactatctatgtattctttccacctgcaaaaaaaaaaaaaaaa

SEQ ID NO: 9711 - protein, 89 aa, Zea mays
  misc_feature: Ceres CLONE 441364
  misc_feature (18)..(77): Pfam Name: ZF-HD_dimer Pfam Description: ZF-HD protein dimerisation region
  misc_feature: The sequence is a functional homolog of SEQ ID NO 64 in the 10/714,887 US patent application
  misc_feature: The sequence is a functional homolog of SEQ ID NO 64 in the 11/435,388 US patent application
  misc_feature: The sequence is a functional homolog of SEQ ID NO 108 in the 10/714,887 US patent application
  misc_feature: The sequence is a functional homolog of SEQ ID NO 108 in the 11/435,388 US patent application
  misc_feature: The sequence is a functional homolog of SEQ ID NO 60 in the 10/714,887 US patent application
  misc_feature: The sequence is a functional homolog of SEQ ID NO 60 in the 11/435,388 US patent application
  misc_feature: The sequence is a functional homolog of SEQ ID NO 110 in the 10/714,887 US patent application
  misc_feature: The sequence is a functional homolog of SEQ ID NO 110 in the 11/435,388 US patent application
  misc_feature: The sequence is a functional homolog of SEQ ID NO 112 in the 10/714,887 US patent application
  misc_feature: The sequence is a functional homolog of SEQ ID NO 112 in the 11/435,388 US patent application
  misc_feature: The sequence is a functional homolog of SEQ ID NO 14 in the 10/714,887 US patent application
  misc_feature: The sequence is a functional homolog of SEQ ID NO 14 in the 11/435,388 US patent application
  misc_feature: The sequence is a functional homolog of SEQ ID NO 626 in the 10/666,642 US patent application
  misc_feature: The sequence is a functional homolog of SEQ ID NO 106 in the 10/714,887 US patent application
  misc_feature: The sequence is a functional homolog of SEQ ID NO 106 in the 11/435,388 US patent application
  misc_feature: The sequence is a functional homolog of SEQ ID NO 104 in the 10/714,887 US patent application
  misc_feature: The sequence is a functional homolog of SEQ ID NO 104 in the 11/435,388 US patent application
  misc_feature: The sequence is a functional homolog of SEQ ID NO 62 in the 10/714,887 US patent application
  misc_feature: The sequence is a functional homolog of SEQ ID NO 62 in the 11/435,388 US patent application
  misc_feature: The sequence is a functional homolog of SEQ ID NO 624 in the 10/666,642 US patent application
  misc_feature: The sequence is a functional homolog of SEQ ID NO 58 in the 10/714,887 US patent application
  misc_feature: The sequence is a functional homolog of SEQ ID NO 58 in the 11/435,388 US patent application
  misc_feature: The sequence is a functional homolog of SEQ ID NO 622 in the 10/666,642 US patent application
  misc_feature: The sequence is a functional homolog of SEQ ID NO 118 in the 10/714,887 US patent application
  misc_feature: The sequence is a functional homolog of SEQ ID NO 118 in the 11/435,388 US patent application
  misc_feature: The sequence is a functional homolog of SEQ ID NO 116 in the 10/714,887 US patent application
  misc_feature: The sequence is a functional homolog of SEQ ID NO 116 in the 11/435,388 US patent application
  misc_feature: The sequence is a functional homolog of SEQ ID NO 52 in the 10/714,887 US patent application
  misc_feature: The sequence is a functional homolog of SEQ ID NO 52 in the 11/435,388 US patent application
  misc_feature: The sequence is a functional homolog of SEQ ID NO 620 in the 10/666,642 US patent application
  misc_feature: The sequence is a functional homolog of SEQ ID NO 102 in the 10/714,887 US patent application
  misc_feature: The sequence is a functional homolog of SEQ ID NO 102 in the 11/435,388 US patent application
  misc_feature: The sequence is a functional homolog of SEQ ID NO 54 in the 10/714,887 US patent application
  misc_feature: The sequence is a functional homolog of SEQ ID NO 54 in the 11/435,388 US patent application
  misc_feature: The sequence is a functional homolog of SEQ ID NO 120 in the 10/714,887 US patent application
  misc_feature: The sequence is a functional homolog of SEQ ID NO 120 in the 11/435,388 US patent application
  misc_feature: The sequence is a functional homolog of SEQ ID NO 1554 in the 10/666,642 US patent application
  misc_feature: The sequence is a functional homolog of SEQ ID NO 44 in the 10/714,887 US patent application
  misc_feature: The sequence is a functional homolog of SEQ ID NO 44 in the 11/435,388 US patent application
  misc_feature: The sequence is a functional homolog of SEQ ID NO 114 in the 10/714,887 US patent application
  misc_feature: The sequence is a functional homolog of SEQ ID NO 114 in the 11/435,388 US patent application
  misc_feature: The sequence is a functional homolog of SEQ ID NO 122 in the 10/714,887 US patent application
  misc_feature: The sequence is a functional homolog of SEQ ID NO 122 in the 11/435,388 US patent application
  misc_feature: The sequence is a functional homolog of SEQ ID NO 126 in the 10/714,887 US patent application
  misc_feature: The sequence is a functional homolog of SEQ ID NO 126 in the 11/435,388 US patent application
  misc_feature: The sequence is a functional homolog of SEQ ID NO 50 in the 10/714,887 US patent application
  misc_feature: The sequence is a functional homolog of SEQ ID NO 50 in the 11/435,388 US patent application
  misc_feature: The sequence is a functional homolog of SEQ ID NO 618 in the 10/666,642 US patent application
  misc_feature: The sequence is a functional homolog of SEQ ID NO 46 in the 10/714,887 US patent application
  misc_feature: The sequence is a functional homolog of SEQ ID NO 46 in the 11/435,388 US patent application
  misc_feature: The sequence is a functional homolog of SEQ ID NO 616 in the 10/666,642 US patent application
  misc_feature: The sequence is a functional homolog of SEQ ID NO 128 in the 10/714,887 US patent application
  misc_feature: The sequence is a functional homolog of SEQ ID NO 128 in the 11/435,388 US patent application
  misc_feature: The sequence is a functional homolog of SEQ ID NO 48 in the 10/714,887 US patent application
  misc_feature: The sequence is a functional homolog of SEQ ID NO 48 in the 11/435,388 US patent application
  misc_feature: The sequence is a functional homolog of SEQ ID NO 628 in the 10/666,642 US patent application
  misc_feature: The sequence is a functional homolog of SEQ ID NO 68 in the 10/714,887 US patent application
  misc_feature: The sequence is a functional homolog of SEQ ID NO 68 in the 11/435,388 US patent application
  misc_feature: The sequence is a functional homolog of SEQ ID NO 56 in the 10/714,887 US patent application
  misc_feature: The sequence is a functional homolog of SEQ ID NO 56 in the 11/435,388 US patent application
  misc_feature: The sequence is a functional homolog of SEQ ID NO 66 in the 10/714,887 US patent application
  misc_feature: The sequence is a functional homolog of SEQ ID NO 66 in the 11/435,388 US patent application
  misc_feature: The sequence is a functional homolog of SEQ ID NO 124 in the 10/714,887 US patent application
  misc_feature: The sequence is a functional homolog of SEQ ID NO 124 in the 11/435,388 US patent application
MKRLLILQRCEPIVRFSCCSVRYGDCRRNHAASTGGHAVDGCREFIAEGEEGTSGALKCAACGCHRSFHRRVQVYEVAWGYGSDTSSTE

SEQ ID NO: 9712 - DNA, 1056 bp, Zea mays
  misc_feature: Ceres CLONE 441430
  misc_feature: Encodes the peptide sequence at SEQ ID NO. 9713
ctttctctctcgcaattcgcacacagcctcctcttctgctccttgtctccctgtcaagctagtagaccagtagtagtacagctcctcagccctcagtgcaagattcaacctgctacagttctccttgcttccgcagttatcctgcacagaggttcgttgttcctgttgttggcaggccctattgtggttgctttccgtaaacagcacctcgatctgctcctcgggcagtcgccagattcgattgatgcggggcgctcttggagccaggggctgtaattttgtcaacagcttcccgtactcccccattcccgactttgatgaggctctcccattgtgagagccactgcgccggccccttccgcttcatcccctgcctcctcccatccaaagatgccagccgcgacgctgcctccgcgccggcgccgcgcccggccgccgtcgccgaggaggagccgcctccggttcagaagttagaggtgccggaagccggaaaggacggcgacgctgagaagcacgaggatgacgagaaggcgacggcgccggctaagagttgcctgaagagaaccagctgcggcgatgacaggtgtgccgacaaaggcaatgtaaagtggctggatttgctggggaaagatctgacagagattaaggagtacgagccaagcgaatgcggagacctgcttgacgacggagacggcatctcgacatgtgtttgcgttatccaatgagtcaaagaagaatcccgctaattctggtgacggggaaagaagggtggttcgcatcggccatgatgcgttctttccggtcgatggccagggtgtcttgttgctaacctccatgagctccgtcgaagatgcccaattagctgttgtgttgtgtgtaaaccagtctcatcagtacatgccactgtatatgcttcgtagcttagccgtaggtttgtatcagtttatcaggtctatgtgcatcggttactgggtagcatagacaggatgtaacctttttgtaaagcttttatactaggggagaaaaatggcttagtccaaaaaaaaaaaaaaaaaa

SEQ ID NO: 9713 - protein, 135 aa, Zea mays
  misc_feature: Ceres CLONE 441430
MRLSHCESHCAGPFRFIPCLLPSKDASRDAASAPAPRPAAVAEEEPPPVQKLEVPEAGKDGDAEKHEDDEKATAPAKSCLKRTSCGDDRCADKGNVKWLDLLGKDLTEIKEYEPSECGDLLDDGDGISTCVCVIQ

SEQ ID NO: 9714 - DNA, 2161 bp, Zea mays
  misc_feature: Ceres CLONE 441488
  misc_feature: Encodes the peptide sequence at SEQ ID NO. 9715
agctcgtgcgctctcgtcttcgcgatcgcgaacagtcgcggcggcctcgtcattgccgcagaaaccctaaccctagatccgccgtcatggatctcctccagtcctcttacgcgccggacgacgcgtcgtctccggaggcttcggcggccgcgtcctcgccggactcctcgccgctccgccttccgtccaagtccgccgcccccgccgtcgatgacaccgcgctcgcactctcctccgcggcgtccgccgcccgcccactcgactcttcgctccacctcgtcgccttcaacccaactgctgaccagctctgggctcccatcctcgggccccagcacccccacgccccgatctcgtccgcctccggcaaccgcaaccacaagctcggccacgttgaggacgccgctgtcctgccattcctattcgacgagcagtacaacaccttccatcggtttggctacgccgccgacccgtctggcctccacatcgtcggcgacgcccagccccaggcgcctgagcccgacactgtctacaacctcgccccttccgagcacaagcgccgtcgcctcctggccaaggcggacaacgaggcggagctagcccccccggaggcaaagaaccccgcctccgaggaatggatcctccacaacaagcagagtccctgggctgggaagaaggaagcgcctcccgcggagctcactgacgagcagaagcagtatggcggaggcgcacgctgccaagaaggccgagaaggaggcccgcctcgaaagggaagagcgagaggacagaggttgtggtcaagaaccaccttccacggcaaggaggagaaggactaccaaggacgctcctggatcacgccgcccaaggatgccaaggccacaaacgaccactgctacatccccaagaggtgtgtgcacgagtgggtcggtcacaccaagggggtctcagctatcaggtttttcccgaagtatggacatttgctgctctctgcgagtatggattgcaagattaagatctgggatgttcttgggtcacggacatgtatgcgtacctatatggggcactcaaaggcggtaagggatatatcattctccaatgacgggactaagttcttgagcgctgggtatgacaggaatatacagtactgggatactgagacagggcaggtgatctcgaccttttcaactgggaaggtcccatatgttgtgaagctcaatcctgatgaggataagcagcatattctccttgccggaatgagcgataagaagattgtgcaatgggatatgaagtcaggacagattacacaagagtatgatcagcatttaggggctgtgaacaccataacttttgtggataacaacaggagatttgtgacctcaagtgatgacaagtctcttcgtgtgtgggagtttggcatccctgtggtgattaagtacatcagtgagccgcacatgcattcaatgccatcgatgtcactgcatcccaactccaattggctggcagcacagagtttggacaatcagatactgatatacagcaccaaggagaggtttcagcttaataagaagaagagatttgctggccacattgtggcaggttatgcttgtcaggtgaacttctcacctgatgggaggtttgtgatgtctggtgatggcgagggtagctgctggttctgggactggaaaagctgcaggagattcaagactttgaagtgtcacaacggggtttgcattggatgtgagtggcatccgttggaaactagcaaggttgcaacctgtggatgggatggtgtaattaaatactgggactgaactttggcagagatattggttgagctcctgggaaaggttttgtaacaatccgattcacgccgaatgtcatggcatactgtaagtcacatgctcgacaagagaatcccggaggaaaaaacatgtgttttttgaggttacatatatgggagaaaaaggtggggttttgctgctacctttgtgttggttctgccctgttagatgtccaaatgtacaatattcgcaccatattcaaatttttagttgtatctctgccactagcaacttgtttgcggtttctggtaatcctgttccttcgaacgtttgtaccatctgaggaagtgtctgttgtgtagtatccaaaaaaaaaaaaaaaa

SEQ ID NO: 9715 - protein, 573 aa, Zea mays
  misc_feature: Ceres CLONE 441488
  misc_feature (272)..(311): Pfam Name: WD40 Pfam Description: WD domain, G-beta repeat
  misc_feature (316)..(354): Pfam Name: WD40 Pfam Description: WD domain, G-beta repeat
  misc_feature (402)..(440): Pfam Name: WD40 Pfam Description: WD domain, G-beta repeat
  misc_feature (534)..(573): Pfam Name: WD40 Pfam Description: WD domain, G-beta repeat
  misc_feature: SWISSPROT Homolog: EC 2.7.11.7 [Myosin heavy-chain] kinase
MDLLQSSYAPDDASSPEASAAASSPDSSPLRLPSKSAAPAVDDTALALSSAASAARPLDSSLHLVAFNPTADQLWAPILGPQHPHAPISSASGNRNHKLGHVEDAAVLPFLFDEQYNTFHRFGYAADPSGLHIVGDAQPQAPEPDTVYNLAPSEHKRRRLLAKADNEAELAPPEAKNPASEEWILHNKQSPWAGKKEAPPAELTDEQKQYGGGARCQEGREGGPPRKGRARGQRLWSRTTFHGKEEKDYQGRSWITPPKDAKATNDHCYIPKRCVHEWVGHTKGVSAIRFFPKYGHLLLSASMDCKIKIWDVLGSRTCMRTYMGHSKAVRDISFSNDGTKFLSAGYDRNIQYWDTETGQVISTFSTGKVPYVVKLNPDEDKQHILLAGMSDKKIVQWDMKSGQITQEYDQHLGAVNTITFVDNNRRFVTSSDDKSLRVWEFGIPVVIKYISEPHMHSMPSMSLHPNSNWLAAQSLDNQILIYSTKERFQLNKKKRFAGHIVAGYACQVNFSPDGRFVMSGDGEGSCWFWDWKSCRRFKTLKCHNGVCIGCEWHPLETSKVATCGWDGVIKYWD

SEQ ID NO: 9716 - DNA, 547 bp, Zea mays
  misc_feature: Ceres CLONE 441961-R
cgatattttttttttttttttttctttttttttagccaaaaacgtggttaagtgttagctcaatagaatcaagtgggtaaggaccaagctcttgtgaaacacaatggtcacgaagaaaacaagcacaagaaacacggtgatttatcccgtggttcgaccaagtataacacttgcctactccacgttgtggggtcccactggacgaggggcggactcaacccctttcaagtgatccaatgatcaacttgaataccacgggggtttcctttcttttactatctcccggtcgcgaggaatctccataacttggagggtctcgacctgagaattgatgatcacaaagaaggacggaagtaaggcaggggagagcaacacaccctgctccaagggagaggataatcatgcacaccaggcacaacttgatgtcacaacacaatgcgaggagttctctactcaaatagaactcaagtgactatcacaaagaatcaaatacccctgaatggaggcttgaggcttagagatgatcaaagaatgcttagattccccc

SEQ ID NO: 9717 - DNA, 868 bp, Zea mays
  misc_feature: Ceres CLONE 442111-R
  misc_feature: Encodes the peptide sequence at SEQ ID NO. 9718
  misc_feature (1)..(1): n is a, c, t, g, unknown, or other
  misc_feature (10)..(10): n is a, c, t, g, unknown, or other
naacgattgngtaccgggccccccctcgaggtcgacggtatcgataagcttttttttttttttttttccatccaattcataagatttgttttccagtcgtacagatatcggcttgaaaacttgcttttgctctggtggccacaggagaactttctttacacaaatagcactttataaaaggagctaccgcctaggttcaaaattccaaaccacagtcctgcagagatccaacccaccatttctttttgagttatcccttgtacggtcctgcagcctgcttgcgcaggtacctccggtaggcttttacattcatatctaccccaccacaaaagacgtatctcactaatcatctcctcgacctccttccggtggacaacccgccaactgacacggtctaacctaccctgtgctgcaatccccttctccctcagagccattgccttacctgcctccccgaacatgaactccttgaccgccctcttaatctcctcgctcttgaccaaacctccaaccgatccttcgctaggatggaccctgacacctatgcacgactcctccaccaggaacttggacctcacaggatgcccgaattcgcacagccgtgctagccatgagacacttgaggcgactttctaccccaacaactatcacccctcaagaattagatatcctcggatacatgggtgcccgagcacccgccgctaggactactactgcactgaccgcatagtctgctccaacaacactggcctcgtaccccgtgcgcgaaccttctgccaattgcttgctctcgcccagcccacacgcattgtgagcccggcactgactcccccagtcggacccagtcttaaatctcgctgcggtataa

SEQ ID NO: 9718 - protein, 81 aa, Zea mays
  misc_feature: Ceres CLONE 442111-R
MNSLTALLISSLLTKPPTDPSLGWTLTPMHDSSTRNLDLTGCPNSHSRASHETLEATFYPNNYHPSRIRYPRIHGCPSTRR

SEQ ID NO: 9719 - DNA, 1293 bp, Zea mays
  misc_feature: Ceres CLONE 442129
  misc_feature: Encodes the peptide sequence at SEQ ID NO. 9720
atacatgtcagtctctccccctgcagccttcaccttccacttcagcttcattccacttccacttggatcgatcgatcgcatatggcggtactgtggtggtggtcatcgtcctgcttgtcctcccgcgccgtcgctgctgcgctgctttgcctgctggtggctcacggcagcgatggaaccaggcacaacagcaacaatggcggtggtagtggtagttccagcagcagcaagagccacaagcaaggcggagggggacgagcccatgccgcgccgacgacaccgtctccgtctccgtatccgtctccggcggctggcaacaacagcagcagcgacgacgggtggctgaacgcccgtgcgacatggtacggtgccccgaacggtgctggtccggacgacaacggcggcgcgtgcggcttcaagggcgtgaacatgccacctttctcggcgatgacgtcgtgcggcaacgagccaatcttcaaggacggcaaaggatgcgggtcctgctaccagatccggtgcaaggcccaccctgcgtgctccggcgtggcggagacggtgatcatcacggacatgaactactacccggtggccccctaccacttcgacctgagcggcactgccttcggggccatggcaaaagacgagcacaacgacgagctaaggcacgcaggaatcatcgacatccagttcaagagggttccctgccagtaccctggtctgacggtgaccttccacatcgagcgcggctccaaccccaactacctggcggtgctggtggagtacgagaacggcgacggcgacgtgatgcaggtggacctgatggagtccagccccgacgacggcgagcccaccggcgtctgggagcccatgcgcgagtcctggggctccatatggaggatggacacccgccggccgctgcaggggcccttctcgctgcgcgtcaccaacgagtccggcaagacgctggtggcggaccaggtcattccggcagactggcagcccgacaacgtctacagctccatcgtccagttcgagtagtagtatatgccatgcgtgcgtcgtacatatagatatatatacactacacacacaacgcagtgtcagcagtaagtatatgcatcatcattaattccatggacggatcggatcgatgatatatatgtacgtaaagatacgatagacaggcatcagacgacgtctctacctagctagctagctagctgctgaatacatacatatacttgtcgatcgagacgtcgcttgtgacgtccgtccataaaaaaaaaaaaaaaa

SEQ ID NO: 9720 - protein, 318 aa, Zea mays
  misc_feature: Ceres CLONE 442129
  misc_feature (215)..(302): Pfam Name: Pollen_allerg_1 Pfam Description: Pollen allergen
  misc_feature (124)..(203): Pfam Name: DPBB_1 Pfam Description: Rare lipoprotein A (RlpA)-like double-psi beta-barrel
MAVLWWWSSSCLSSRAVAAALLCLLVAHGSDGTRHNSNNGGGSGSSSSSKSHKQGGGGRAHAAPTTPSPSPYPSPAAGNNSSSDDGWLNARATWYGAPNGAGPDDNGGACGFKGVNMPPFSAMTSCGNEPIFKDGKGCGSCYQIRCKAHPACSGVAETVIITDMNYYPVAPYHFDLSGTAFGAMAKDEHNDELRHAGIIDIQFKRVPCQYPGLTVTFHIERGSNPNYLAVLVEYENGDGDVMQVDLMESSPDDGEPTGVWEPMRESWGSIWRMDTRRPLQGPFSLRVTNESGKTLVADQVIPADWQPDNVYSSIVQFE

SEQ ID NO: 9721 - DNA, 718 bp, Zea mays
  misc_feature: Ceres CLONE 442452-R
  misc_feature (10)..(10): n is a, c, t, g, unknown, or other
tttttggttngttttgttgggccctttagattattttaaaaatatataaataaaaaaatggataacgggccccccctcgaggtcgacggtatcgatattttttttttttttttttggaaatcagaagtgcctaatattcataaatacctccaagttagaacaaacccacgtctcagattggaactcaaatccttcacaggtaagaaggaaagaaattattagaacacccatctgaatgaaccgaaaatgaaaggcgacatgacgtgaacatataacagctctaaaacaggagttacaagactcgactgaaaacctagtatcagcaaactcaggacatcaacatggcttcagttattttgtggtcccaacaaagaccagcctgatgaacactcagtggagtgttgggacggtctgagaattcgccatcctcaatgagatagctactgttactcgtgtgattctctgctggcactgtgttgctgctagacatttgtaggactccggttggaggacgctagtcacgagtcgaagtccaatggtcagttaagatgtctgcggatgctgactggcaactcttgcccttgaacacctcgcccagaggcccgtcggcaattgtttccctcgagactagcagctgaccatcctgagacttggtaacgattttctgctgagctgccggctccctgcaccaaaatacagcttaatcatggttcgggcc

SEQ ID NO: 9722 - DNA, 720 bp, Zea mays
  misc_feature: Ceres CLONE 442500-R
  misc_feature (47)..(47): n is a, c, t, g, unknown, or other
  misc_feature (48)..(48): n is a, c, t, g, unknown, or other
tttttttttcttttttttctaactaataaaaattaatatcacaaacnnggttcaaattgggtaccgggccccccctcgaggtcgacggtatcgataagcttttttttttttttttttaaataacattcaatatatcataaataatcattgtcaaataactcatacataagtgtactctaaatttaaagttgctcatcaactgtttgtgctaacattgagcctaagtatataacttgatacatatgtatgaactccgacggttcaatataaataagtgtactctacataagtgtactctaaattgagcctaactaagtatataaattgacatcaatgctcattgtggtttttatcagatacatatgatctttctgaaaggggaactattccatctcggccatgaaaaagcttgaatgctgactcaaagcctgacccttcctcaaaaattggacccttgcctccttgagcagctactggcaaagcaaaagagagggaaaaggttgtagctccattgatattcctcaggaatgggcatctctcgacatctgggtgtccaaaaaggttctgcggtgatactgattcactgagaaagctgccaaaaaacatttccatcctgataattgactcatacatcaccttactgcttggtgtctgctggccagctgtaaatagaaaatgcctctgcctagctgaaaatagaaacaaacatggtacaatttc

SEQ ID NO: 9723 - DNA, 1660 bp, Zea mays
  misc_feature: Ceres CLONE 442540
  misc_feature: Encodes the peptide sequence at SEQ ID NO. 9724
acctaggcgagctgccgagctattgctcggcgcctccatctcgtccacaccacacagccgttgagtccaattcgctcactcaccgtcaaacccacacctcaaactccttcccttcaagaatgtcagattatccactgcggcctcttcctcctcttcctccgcccctcccaccatgattgccacccatctctccccagccctcaagcagtaccgcttcccgtccccgctccactccacctctcacaaccaccaccttcccgtgcacctcccgctcccccgccgccaccgcaacttcgctaagcccgccgcggccgcgccagacctcctcgccagcgtcgagtccgtggtctccgcggcctccgtcctggccgccatcgtgctcgtccacgagtccgggcacttcctggccgcggcctcccggggcatccacgtctcccagttctccatcggcttcggcccggcgctcgcccgcttccgcctcggccccgtggagtacgcgctccgcgccatcccgctgggcggctacgtcggcttccccgacgacgacccggagtccggcttcgcgcctgacgaccccgacctcctccgcaaccgccccgtcccggaccgcctgctcgtcgtctccgccggcgtcgccgccaacctcgccttcgccttcctcatcgtctacgcgcaggcgctcaccgtcggcgtccccgtgcaggcgcagctccccggggttctcgtgcccgaggttctcccgggctccgtggccgcgcgcgcgggcctcctccccggggacatcatcctcgctgtgcccggggccgcgccggacccgtccgtccccgtcctcgtcgacctcatcaaggccagccccagcagggaggtgcccctcaccgtctcgagagccgcgcccggggcggtggacaggcggtccgttgagctcaccgtcgtgccggacaccagcgccgatggctcggggcgcatcggcgtgcagctctcccccaacgtccgcgtcacgcgcgtgcgcccccagaacctggccgacgctaccgtccttgccgtgcgcgagttcacgctcttgaccgggacggtgttcgacgggctcaggcagacattgctcaacttctctcagtccgccgacaaggtgtcaggccctgttgccatcattgcagtgggagcggaagtggccaggtccagcgcggatgggctgttccagtttgcggcggtgatcaatctcaacctcgcagccataaacttgttgcccttgccagcattggacggtggcaccttggcattgatccttcttgaggcagctcggggtgggcgcaagatcccccgagaagttgaacagggtattatgtcatcggggatactggtggtgctcatggttggcatgttcctcattgtacgtgacacactcaaccttgatttcatcaaggagatcttgtgatacttcgcgtgaaaaatcaattgattgcagttgtagtaaaattgccagtgtcagaacttggttggcctggaaatgtgtagttgttgtgattctttttgcctttggtgggactgctctaccactctagtttcttgctatactgatcgtagtttcttgtattgctggttttggaatgaagcttgtgatattatagttaatcgtgactgagataaaaaaaaaaaaaaaaaa

SEQ ID NO: 9724 - protein, 419 aa, Zea mays
  misc_feature: Ceres CLONE 442540
  misc_feature (60)..(408): Pfam Name: Peptidase_M50 Pfam Description: Peptidase family M50
MIATHLSPALKQYRFPSPLHSTSHNHHLPVHLPLPRRHRNFAKPAAAAPDLLASVESVVSAASVLAAIVLVHESGHFLAAASRGIHVSQFSIGFGPALARFRLGPVEYALRAIPLGGYVGFPDDDPESGFAPDDPDLLRNRPVPDRLLVVSAGVAANLAFAFLIVYAQALTVGVPVQAQLPGVLVPEVLPGSVAARAGLLPGDIILAVPGAAPDPSVPVLVDLIKASPSREVPLTVSRAAPGAVDRRSVELTVVPDTSADGSGRIGVQLSPNVRVTRVRPQNLADATVLAVREFTLLTGTVFDGLRQTLLNFSQSADKVSGPVAIIAVGAEVARSSADGLFQFAAVINLNLAAINLLPLPALDGGTLALILLEAARGGRKIPREVEQGIMSSGILVVLMVGMFLIVRDTLNLDFIKEIL

SEQ ID NO: 9725 - DNA, 660 bp, Zea mays
  misc_feature: Ceres CLONE 443201-R
caattgggtaccgggccccccctcgaggtcgacggtatcgataagcttttttttttttttttttgctgttttcaagaggggcacgagcaatactgcatacattgtttaacatgaccccccaaaaaagcaacttaactctgttgttttgtcctaattatctcatatcagaaaggggtttggttgcagttgcaacaagttgctagcgaacaaaatcttgttacactcgaaacctttggtcagtaaagcacaactagctgaattaatagggaaatggaacagtagtgtcagccacaaccattactacatttcagcattcaatccgaaccgaaccactctgcgtcgagatgaacttgggcttcctaatcacctgctccacgcactgtatgatatcccctacctggaaatcatcgcaatcctgaatcaccagcccacagtcgttacccttttcgactgtttctgcgtccttcttctcccgcttcagagactcgcatggaccctcaaagacaacatctccgctcctcaacagtctcatggttccggatttgctgaagtggccatcagttatgcggcagccagcaattttgacatccggtccttttgacttgctgcgccctttcagctcaaatatgttcagaacctcagcctctcctgaaacctggg

SEQ ID NO: 9726 - DNA, 1348 bp, Zea mays
  misc_feature: Ceres CLONE 443205
  misc_feature: Encodes the peptide sequence at SEQ ID NO. 9727
agtcgtcctcctcctcgctcccagcccagctagctagctgctgcatatgccttctagctagctagctttcatccccagccccctttcgatccatccatcctgtgttccaagttcatcattcactcgtcactaatagctttctatctgatcgattcatcatcatccgggcatgcatgagcatcatcgtctccagatcgttgggctctcgcagctacttacattcaacattcaagctcgctctacatatgcatgcaaatctgcaacactcgctcttggcagggatacattcacgccgagagagagagagagagagagagagagagagagagagagagagagagatgtgtgtgctgtagtcatcagccagccggtgatttctggagtggcatcatcaagattcacacactgcatgccaacataatgcgcgtgttcatgcatccatcgccgccgctgcatcatgcatcatatataatatatatatgtgtatgtgtgggaatcttgatgatgctgcattggatatcaagggctatatatatatatggatcaagcatatatatatatatatatcagatcaccagtcatatcgagttcttccttccaggcttgctagaaggcaatatataataagaaaagactgaaaggaaaaggcaccactgccatgatggatcgcatcagtgcatctgttttgttcttctaaacgattcaggtcatcagctcagctcagcacagcaggatttgtatcgctcgtatgtgtggctgggctgccagagcgtgttcggcccaatctaaatccggattggcatagcaggccaaactgggccagccatggatgaccccgacccataattgtatgtttgggcctggtttggatcatcggtcaaactgacccagcgggctgcttgcttcaactccgatctccactctcctctcctctcctctcctctatacagagattagagagaagagatctaggaaggcagacactgcaactagctagcaggtccggcaggccgcacgccatggacgcctccgccggcagcgtgctctgcagcaggagctactcggccagcgtgagcagagcctcgtcttcccagcaagcagaatcgtcgtcgcggctgtgcgtggaggagcaccgggcggaatggtgattcatctgcatgtactacgagcagcatttgttcgatttttccgctgtgttcgtaccgagaatatccagtcacttgtgggtccgagagagcatttcgtttgtgagttttagtgtttacaaggattaagtgaaaacttcacaagtaagtcgtaactattttctgcaaataagttttattgtctgaaaaaaaaaaaaaaaaaa

SEQ ID NO: 9727 - protein, 124 aa, Zea mays
  misc_feature: Ceres CLONE 443205
MQICNTRSWQGYIHAERERERERERERERERCVCCSHQPAGDFWSGIIKIHTLHANIMRVFMHPSPPLHHASYIIYICVCVGILMMLHWISRAIYIYGSSIYIYIYQITSHIEFFLPGLLEGNI

SEQ ID NO: 9728 - DNA, 929 bp, Zea mays
  misc_feature: Ceres CLONE 443207
  misc_feature: Encodes the peptide sequence at SEQ ID NO. 9729
agccgaacaccactctctctcactctcccggacttcagaggccgaggacgctggagcacgcgtcggtccggcgcccccatggacccagcctgcgaggagctcgagcgccgcagccgctacctcagcgcgctcgtgcgctgcaccaagctcgccgacccgccccagcccgagccggaggccaaggcggacgtggagcctcagctgaaggcgccgccgcacgtcggcggtgagggtaagggagggaaggatgaggccaaggcggaggagaggacgccgatgaagaagccgaggggggaagcggcggcggcggaggcggaggggaggaaggtggcggtgtgcgtgcgggcggcggacatgccgctgccgctgcagcggcgcgcggtgaggatcgccctcgaggccgtcgccgccatgccgcggctcgagagcaagcgcctcgcgctcgcgctcaagaaggatttcgatacaacatacgggcccgcatggcactgcattgtcggcacaagctttggctcctacgtcactcactcgttggggggtttcctgtacttctccgtcgacaaagcctacgttctcctcttcagaactgctgtccagccacttgtccagctacaatgagacctgaaacatgttttactcgaactggtgtagatgcagcgcaaatgtaactttgaacagaatagctgacgctcagcacaccgtgtcttgacgcgtttgagtagcagaggtaatttgatctgtacacaagactgtagaacagccatgcctctaacgttgtactgcccgaagtcctgctttgtaaacgttcttgtgcaatcgtttggagttacagaggctgactgtcagatactcggatctcgatctccggctttacctcaatatccaatgtatacaatctttcttgtgactgcaaaaaaaaaaaaaaaaaa

SEQ ID NO: 9729 - protein, 179 aa, Zea mays
  misc_feature: Ceres CLONE 443207
  misc_feature (80)..(171): Pfam Name: Dynein_light Pfam Description: Dynein light chain type 1
MDPACEELERRSRYLSALVRCTKLADPPQPEPEAKADVEPQLKAPPHVGGEGKGGKDEAKAEERTPMKKPRGEAAAAEAEGRKVAVCVRAADMPLPLQRRAVRIALEAVAAMPRLESKRLALALKKDFDTTYGPAWHCIVGTSFGSYVTHSLGGFLYFSVDKAYVLLFRTAVQPLVQLQ

SEQ ID NO: 9730 - DNA, 661 bp, Zea mays
  misc_feature: Ceres CLONE 443240-R
  misc_feature: Pfam Name: FSH1 Pfam Description: Serine hydrolase (FSH1)
  misc_feature (278)..(278): n is a, c, t, g, unknown, or other
  misc_feature (353)..(353): n is a, c, t, g, unknown, or other
  misc_feature (354)..(354): n is a, c, t, g, unknown, or other
caattgggaccgggcccccctcgaggtcgacggtatcgataagcttttttttttttttttttgaccaacaaacacagtcaatagccattcacgaacccacacttgtgtatatccgaacttacaactgcaatacgtcacgttcaaaacatttcacaggaaactggaaagaaaatcctttatccgatcgatgtagggcgaccgggtggggattatgtggcccatatcatgctcaacaacggagcagcaatcctgctcgaacaaaccagcaagttcagcgncttgccctgttcgctatctgcctatcatgaccatccccattgccgaaaacatggagcgaggggagcttgattggnntcgttgccaaaatcgcccacaggtgctggatattccagagcagaacatcccaaccctgaacttttggaagccgaaaatctcctgctgcttgctgcaaaataaggcagcaatggcaacgcccttgaaggagccccgggattcatcccaatttccccagggtgaaaaattgcccttttcaaaaaaggggatgaaatcccccaaacccttcggttttttgcgggcacccaaaaagggaaaaaagaaaatttttgcccccccccatttttttccggggtccccggggaattttggaaaacaaacccctcct

SEQ ID NO: 9731 - DNA, 629 bp, Zea mays
  misc_feature: Ceres CLONE 443248-R
  misc_feature: SWISSPROT Homolog: EC 1.1.1.184 Carbonyl reductase (NADPH)
cgattgggtaccgggccccccctcgaggtcgacggtatcgataagcttttttttttttttttttcttttttttttttttttttttttttttttttttttttttttttttttttttttttttagcaaacgacaaatattcaatccccagacgttcaccatttctgtctgatcaaaatagcacccagttggtccatcatcggggaggaaagctagcatgactggccctctcccaccttgttcaggcgtcaggacccccaaattccagttgatgtccgtcttgacaaaaccaggtcgcacacagttgatgcgcatctccggatacctccttgccatgatcctggggtacaaattgatgaccattttccataccctgtaggctggtagcatcacgggccacccagcctcttccagccgcccgctcctcaggtcctccaaaaatgtgtcgagcactgcttctatccgggcctcgtcccaaatatcaatgttgctcaaatcgtttcgcagcttctcatttggcattctctggcaacaatataatcagggtgagtaacataaatatcttctctgttcgtgcaggaatgcaggagctccacaccttcagctccgaagcaagtgaggaggcattgaca

SEQ ID NO: 9732 - DNA, 872 bp, Zea mays
  misc_feature: Ceres CLONE 443343-R
  misc_feature (845)..(845): n is a, c, t, g, unknown, or other
  misc_feature (857)..(857): n is a, c, t, g, unknown, or other
  misc_feature (865)..(865): n is a, c, t, g, unknown, or other
caattgggtaccgggccccccctcgaggtcgacggtatcgatattttttttttttttttttatttttttttttttttttttttttttttttagaagaaacaacatctttgctttgtaagtttaggtacacactgtcctccccatcgtccaggtacatcatatctatgtctgttacccataagccaaccgcatgagacgcagggcacgcccagttacctactagctacgctgtgagactgatcatttactttgggtgaatactcgagggcaccttaaaacctctctgcagtatcaaccaccggccgtgcctccacacgcttcctatcagaaaggtaagggccccgtttcaccgcgtcattcaacttcccaacgagttcaaaaagacttgcttcatgcaaaaaatgggatgatgatagggccttgttgattgccacacagcagccataccgggtttccatgccaagttttgttgtctccattgttggatccgtaacaaatctgattatctctgaatttaagcaaacctcccttaagcaccattcccggatgaccagtcctgttattactctgtagccagctatcctaacgtctgggtcttgttgcagaactgatagtaaaagagctgaaggggttaattttggactgtttgctgcagtcgtatagaccaagcgcttcaagttttcctcggcttcgctatccagtttcatctggtcttcttgtctaccaacaccacagatgctcccaaatgcatgtaaagcagccagctgtctacccctgccttgtcggtcaaaggatgactcgacaacatgtctggcaacatttgatgatgtcagcaagaatgtgcntccttgacttgntgtacaanttagacc

SEQ ID NO: 9733 - DNA, 1231 bp, Zea mays
  misc_feature: Ceres CLONE 443665
  misc_feature: Encodes the peptide sequence at SEQ ID NO. 9734
acccagacgaacaatagcctttcctctcactcgcccctctgcatttaccactttgccctcgtcggcggcgctgaccacccgccgccgagtccggcgaaacaaccgcctgtagttccagagaccagagtagtacctcatggcggccatatcgtcgcttcccttcgcggcgctgcgcggagccgccgagtggaggccgtcgtcgacggcggcggccgtctccggcgccgtcgtgctcagcgcgaggtctcgccggggctcgtgctcggtggtgcgatgtgtcgccacgacgggtgatgtcccacccactgtcgcagaaacaaaactgaacttccttaagtcatacaaacgcccaatcccaagcatttacagtgcagtcttacaagaacttttggttcagcaacacctgatgagatacaaaaaaacctatcagtatgatgctgtgtttgctcttggcttcgtcactgtctatgatcagctcatggaaaggtaccccagcaatgaggacaaggattccatcttcaaggcatatataacagcattaaatgaagatcctgatcaatacagagctgatgcactaaagatggaagagtgggcacgttcccagaacggtagttccttagttgatttttcttccagagatggagaaatcgaggctattctgaaagatatatcagaaagggccaagggtaagggaaacttcagctacagccgattctttgcagttggcttgttccgtttgcttgagctctcaaatgcaacggagccaacaatactagacaagctttgcgctgcactaaacgtcagtaaaagaagtgtggatagggaccttgatgtttaccgcaacatactctcaaagttggttcaagccaaggaacttctcaaggaatacgtggatagggaaaagaagaagagagaagaaagatcggaagccccgaagccgaacgaagctgtcacaaaatttgatggaaacctttattccacaaggcattagaatcagccctttgcagaggagagtttcccaggataacagaattaacagtaacatctggaccgtgttgagaaaccaccaaatgttcccctttcatcacagacgtctttggctgctcgtcgtgtgatgtagcattctgccgtacaaaaggatccagattattcttactactgaacagatatttgtattttctcataagtcttgaaatcaaatgtatacattttcaaaaaaaaaaaaagaaaa

SEQ ID NO: 9734 - protein, 284 aa, Zea mays
  misc_feature: Ceres CLONE 443665
MAAISSLPFAALRGAAEWRPSSTAAAVSGAVVLSARSRRGSCSVVRCVATTGDVPPTVAETKLNFLKSYKRPIPSIYSAVLQELLVQQHLMRYKKTYQYDAVFALGFVTVYDQLMERYPSNEDKDSIFKAYITALNEDPDQYRADALKMEEWARSQNGSSLVDFSSRDGEIEAILKDISERAKGKGNFSYSRFFAVGLFRLLELSNATEPTILDKLCAALNVSKRSVDRDLDVYRNILSKLVQAKELLKEYVDREKKKREERSEAPKPNEAVTKFDGNLYSTRH

SEQ ID NO: 9735 - DNA, 1095 bp, Zea mays
  misc_feature: Ceres CLONE 443795
  misc_feature: Encodes the peptide sequence at SEQ ID NO. 9736
cgcgattccacccccacaaatcctccgacccaacccaatccagcgtctcaaaattcacgcaacttcgcgtcgcgtcggctccaaatttgcccccttcgatccacaaatcccctcccccacccccgattctgcgccgaattcggttagcttattactctccgagcttatcgccaaccgtctgtcccgacctcgagatccggctcattttttcaccctcttacgtattcggatcgagcccgagctgccaattcgaggagctccgaacgcgggccgcataaatcgaatcgaatgaatcaagcttgcgcgacgggcagttgatgccacccggcgatggatcgccgcatcctcaggacctcgtcgtgcaacggcagcggtaagaacccgtccccttcctctcccgcggcggtctcacggcctgcgtcctccgggggcatcggctccaaggacgacgccgctgccggcgagcgcaaagcgctgctgccgcggcagcctcctggcggcatggcgcggaagggccgcaaggggtccaaccgccgcgtgcagtggaaagataagcatggcagcaagctcaccgatgtcagggagttccagcctagtgactcaagtgactcagatgatgaatatttggatacatgcatatgctcaatcatgtaaatacatcttgcacaggtggattctatcatgtgtataaggagctgtatctcagtattactgtcttcggcttggccctaacagtacagtgacaatcatgcatgcatgcatagttcgttccaacagactccgaactggtgataatcagctggccttaactgggagttacatcaaagacctagaaaatgatcaccggattcagtaggtagacatgattaaagaagccgagaaagaatgcctttctttggtttaattttggataccaacagcatcctgagtttttggcagagtaatgattcatgtgataatgcaaatgctattagaatcgaacattactaattcctgtgcatgattcagatcgattttgtcaaataggatttgatgtattaacatggtatgtttcttttaaaaagaatccttgctaccaaaaaaaaaaaaaaaaaa

SEQ ID NO: 9736 - protein, 107 aa, Zea mays
  misc_feature: Ceres CLONE 443795
MDRRILRTSSCNGSGKNPSPSSPAAVSRPASSGGIGSKDDAAAGERKALLPRQPPGGMARKGRKGSNRRVQWKDKHGSKLTDVREFQPSDSSDSDDEYLDTCICSIM

SEQ ID NO: 9737 - DNA, 1070 bp, Zea mays
  misc_feature: Ceres CLONE 444095
  misc_feature: Encodes the peptide sequence at SEQ ID NO. 9738
gaaaaatccccagcccaaaatgaacgccaccaccgccgtggctgcgaggcgcctcctcctcccgctccgcgcccagccgccagcaccgcggggcgcagcgccggcctcggcgcacccctggtgtcgatccgttccgcggagacgacgagtccgtgccgccccggcgcgcgcgtcgctggaccgcgccgcggtcctcctcgacaccgcggccgcggtggccaacggcgggacaggttactcgcaggcgagctactacacgtctctgggactcttcgttctctccgttccggggctgtggtccctcatcaagcgctccgtcaagtccaagattgtgcaaaagacatttgtgaaagacgatggacagtcgatggcgccaaatcaggtggctggagagatcctgtcgttcttcactcgcaataacttcaccgtctcagaccgcggggaggtcatcacattcgagggcacaatgataccaaacagaggccaggcggcgctgctaaccttctgcacctgcattagcctcgggagtgtcgggcttgttctatctatcgctgtcccagaaggtggcaacaactggttctggctcatgaccctgagccccttggcgggagcgtactactggacgaaagcgtcaaggaaagaagagatcaaggtcaagatgatcctatccgatgacgggaacgtgtccgagatccttgtgcagggcgatgacgtccaggttgagcagatgaggaaggacctcaagttcagcgagaaggggatggtctatgtgaagggcatctttgagacatgactgggagtttcatactctatctgtgagtgaacaatcgagtggagacgagtctttgctgcaacggaaactgcgtaagcgtaacccaggtgaggaaatgcaaattggacgggcaaatctgtaccttggcttaaaggaaaaaaagaagtgatcttcatacgggatttgattattgtaagtgttgcccgtatgaggatagttaatgtatgaactcaaactaatgactttataaaaagctgatgagaaacacctttttgagcacaaaaaaaaaaaaaaaaaa

SEQ ID NO: 9738 - protein, 257 aa, Zea mays
  misc_feature: Ceres CLONE 444095
MNATTAVAARRLLLPLRAQPPAPRGAAPASAHPWCRSVPRRRRVRAAPARASLDRAAVLLDTAAAVANGGTGYSQASYYTSLGLFVLSVPGLWSLIKRSVKSKIVQKTFVKDDGQSMAPNQVAGEILSFFTRNNFTVSDRGEVITFEGTMIPNRGQAALLTFCTCISLGSVGLVLSIAVPEGGNNWFWLMTLSPLAGAYYWTKASRKEEIKVKMILSDDGNVSEILVQGDDVQVEQMRKDLKFSEKGMVYVKGIFET

SEQ ID NO: 9739 - DNA, 763 bp, Zea mays
  misc_feature: Ceres CLONE 444230-R
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (20)..(20): n is a, c, t, g, unknown, or other
  misc_feature (23)..(23): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
aggggggcacaacnnncacncanaaccatcaacaaaaaaaaaaaaaaatnnnnaacgattgaagaacgggccccccctcccagtcgacggcatcgatatactttttttttttttttctgccacatataaatcctttatttctttccttcaaaccacagagataagcatgatgcatgcattcccgacacaaatgcactcagcaagcaagcagagtacaatgaatgttacatggtcaatctttctcaaacccgatcatttgaattgtcaggaggccccaagcaaaaatggtcacaatccaacagcaaactggacgtcatactcctgagataaagtgtgcttggactacggtcttcaaaaacggcacatgccagatttgataccaaagccaatctcacatagctcatcgcaagagcttgaaagaaattacaggaaaaatcagggtgcagattggccattgacacctcttgcccccccattgaggaacaatggcgtctcagcaacatccataagagggctgaagattgttattaattagctccaccgaatcatgtagaagggggaggccgaaacgttaaggggtggatgggtttttcctaaactgtaattaaaaaatccaaagtttggggagcaacctcacccccactttcgttctaaagctttgatacccagacctccttgaaaatccacgggaacctggggaaggtaactcaaaaaccggctgtgaacttaccagttgcttggaaaccctagggggacccccagc

SEQ ID NO: 9740 - DNA, 1714 bp, Zea mays
  misc_feature: Ceres CLONE 444550
  misc_feature: Encodes the peptide sequence at SEQ ID NO. 9741
accccaaaatggcactcgcgccatcacccccagcgctgccgcctaacccggcgctccctttgccgtggtgggggcgggccggccgcggtgtgctcgtccgcgcccgcgcccgcgccgtccgcgcggcgctacggcccccgagccagtggtccgtcgggagctggcggggccgcccggcgcagcagcagcccgagtacccggacaaggcggacctggaagacgtgctgcggacggtgggaacgttcccgcccatcgtcttcgccggcgaggcgcgcaccctcgaggagcgcctcgcggaggccgccgtcggccgggccttcctcctccagggcggcgactgcgccgagagcttcaaggagttcaacgccaacaacatcagggacaccttccgcgtcctcctgcaaatgtccgttgtgctcatgttcggaggccagatgcctgtcgtcaaggtgggaagaatggcaggtcagtttgcgaagccaaggtcagatggttttgaggagcgggatggattgaagttgccaagctatagaggggacaatatcaatggggatgcattcaatagggagtcaaggttgccagatccacaccgcatgataagggcgtactcacagtctgcagcaacactgaatctgctgcgtgcattcgcaactggaggttatgctgcaatgcagagggtagcacaatggaaccttgatttcacagagaacagcgaacaaggtgataggtacatggagttggctcaccgagttgacgaagctttggggttcatgtcagctgctgggctccctttagatcaccctataatgacaacagcagaattctggacgtcacatgagtgccttcttctaccttatgagcaagcgctcactcgtgaggattccaccacgggcctctattatgactgctctgcccacttcctatgggtcggagagcgcactcgccagcttgatggtgctcacgttgagttccttcgaggcattgccaaccctcttggtatcaaggttagtgacaagatggacccagcagaacttgtgcggttgattgatatattgaatcccgaaaacagggctgggagaataaccatcatcacaagaatgggacctgaaaacatgagggtgaaacttccacacctgatacgcgctgtccgtggggccggtcagatagtaacatgggttactgacccaatgcatgggaacactatgaaggccccttgcggactcaaaacccgctcgttcgataggattttgggtgaggtgcgtgcgttctttgatgtccacgaacaagaagggagccaccctggaggagtgcatctagagatgactggacaaaatgttacagagtgcatcggcgggtcacgtacggtgaccttcgatgatctggggtcacgctaccacacgcactgcgacccaaggctcaatgcctcacagtctctggagatggcatttatcatcgccgagcgccttaggaaaaggaggatggcctcgtcgcctttgtacacgaaccagctgggttcgattccatcaatgggtctgtgaacaacactagaggttcactgtcaaggactagtccttgggttttgtttcagctgctgtgtcaaactttgctggcatgcactggtaaactagatagcctgctgtactgctcattcccggcactgggtctgccctcaaagtataatagatactcatcactttttgaccaaaaaaaaaaa

SEQ ID NO: 9741 - protein, 509 aa, Zea mays
  misc_feature: Ceres CLONE 444550
  misc_feature (46)..(483): Pfam Name: DAHP_synth_2 Pfam Description: Class-II DAHP synthetase family
  misc_feature: SWISSPROT Homolog: EC 2.5.1.54 3-deoxy-7-phosphoheptulonate synthase
MALAPSPPALPPNPALPLPWWGRAGRGVLVRARARAVRAALRPPSQWSVGSWRGRPAQQQPEYPDKADLEDVLRTVGTFPPIVFAGEARTLEERLAEAAVGRAFLLQGGDCAESFKEFNANNIRDTFRVLLQMSVVLMFGGQMPVVKVGRMAGQFAKPRSDGFEERDGLKLPSYRGDNINGDAFNRESRLPDPHRMIRAYSQSAATLNLLRAFATGGYAAMQRVAQWNLDFTENSEQGDRYMELAHRVDEALGFMSAAGLPLDHPIMTTAEFWTSHECLLLPYEQALTREDSTTGLYYDCSAHFLWVGERTRQLDGAHVEFLRGIANPLGIKVSDKMDPAELVRLIDILNPENRAGRITIITRMGPENMRVKLPHLIRAVRGAGQIVTWVTDPMHGNTMKAPCGLKTRSFDRILGEVRAFFDVHEQEGSHPGGVHLEMTGQNVTECIGGSRTVTFDDLGSRYHTHCDPRLNASQSLEMAFIIAERLRKRRMASSPLYTNQLGSIPSMGL

SEQ ID NO: 9742 - DNA, 676 bp, Zea mays
  misc_feature: Ceres CLONE 444584-R
  misc_feature: Encodes the peptide sequence at SEQ ID NO. 9743
caattgggtaccgggccccccctcgaggtcgacggtatcgataagcttttttttttttttttttaggacgccaaaagccaaagcacatcgtcagacacggctctgaaaagtcaaagttaacggaaggtcgctgaatcaccatgccctacaaggctacaactaactgctgcgctagcatctaaacagactaaacccgattagctagcacaaggctttcgaaggggaatggcgcgagagatcacatcactgcatcagcgcagcgctacaggaagatgaaacattccaacgacactagcgggttctccaacgactctttcccgtcgtcgccgccgccgccgtggccaccttgaacatcgccacctgcgctgccgtccgggatgctgggctcacttgccgcggtgacggcgtcgtcttccggcggcgacggcggggtggcggaacgcggaggagttgcagcttcctgtgcccgccgcggcgagacgcggccggccggccttgccgggacaggcggcttccgctgcacgggcgcagctgggctggcggctctgcggcgctcagacgacggccgattggccgccggcgacggcgaacgccggacggagcggtcccgtggcacgtgccgcggcggatgggacgccgacgctcgcgcgctgcgggagcggacgccgtaggaggc

SEQ ID NO: 9743 - protein, 97 aa, Zea mays
  misc_feature: Ceres CLONE 444584-R
MLGSLAAVTASSSGGDGGVAERGGVAASCARRGETRPAGLAGTGGFRCTGAAGLAALRRSDDGRLAAGDGERRTERSRGTCRGGWDADARALRERTP

SEQ ID NO: 9744 - DNA, 594 bp, Zea mays
  misc_feature: Ceres CLONE 444835-R
  misc_feature: Pfam Name: Collagen Pfam Description: Collagen triple helix repeat (20 copies)
tcgataagcttttttttttttttttttcagtcctctaaaatctgatcatgataaccatgtaaaactttgctcagaatacagtaaaaaaagagcgttatgcatgtgaggggtcactcacagacaaaataaattacaccaaaaataaaataacactacttcacaaacttaagtaatatattctatatataacacgtttctagcacttataaaatagcaaaacgaagcaccttaattaactcgcctatcgggctgggtagcccggtattccttcaacgaaaacccacaaaaaaacgggccagggcccgatgggaaaacaccccgcgacttggtaatgggcccccggggggtccccgggccaggggagggaacccccaatccgtccaccccccgggaaggggttgggggggcccgggtaaaaaccccgggaaaccccgggaaggaagggggttccgccggcggcgggggcttggccccagaaggggaatccacctggtacggtgggggaaaaaacccgggggcattccctcccggcggggggtcagcttggaagctcccctggggggaagttggcggattacctgccgcccgagaccg

SEQ ID NO: 9745 - DNA, 759 bp, Zea mays
  misc_feature: Ceres CLONE 444990-R
ttgggtgggaggggggggcccgcgccgcggcggtgcgccaccttttttattattgagctaatacaaatgagtacgggccccccctcgaggtcgacggtatcgataagcttttttttttttttttttccaggaaatctgatattcctcacattcaatataatgacaacataaagatccgataggtctagttgtcaccggcgtattcaaacatacatgtcagaatcaaatttcattcacatcttctcactctgcatcctctatctctgcatcctctggaacgcctcggagatcataaggttgttgcacctgatcagaatcactcccaggtttccagagaatttgcccatcaatggactccccactattggccaacactggagattcatataggaagtccactgaagtaatgataaccctttgttactccaataccccacctggaagtttgaaaaaattacagggtttcccacggtatcgtctgtgccacgcaaacacgctttgggggttaaagtggccactagtcgcccttttgatataattgcaaccacctcgacctttccatcgtctacgcccaggccccttctccggatctggtagcgaaaaagcaaggggcccccggagggaacaaaaaagcttcgatttactctgagcgatttggtgttcgcgcgctcacactaaatatacgagtttttatttttccgaaccagggcatgttccctccatcttattgcgtcgtctttgtctgaacgcccctcccgc

SEQ ID NO: 9746 - DNA, 514 bp, Zea mays
  misc_feature: Ceres CLONE 445096-R
  misc_feature: Pfam Name: XET_C Pfam Description: Xyloglucan endo-transglycosylase (XET) C-terminus
  misc_feature: Pfam Name: Glyco_hydro_16 Pfam Description: Glycosyl hydrolases family 16
  misc_feature: SWISSPROT Homolog: EC 2.4.1.207 Xyloglucan:xyloglucosyl transferase
cgataagcttttttttttttttttttcaaaaaacccttcttttctttacagcaaattaaaactacagtgatatactcccgtgcccacacacttctttacaagtactgtaatcacgatttaacaataacagaacaagaatcatgcatatagagatgtatgattgtccatccagcaagaacaaaccaacaagaggtgtcatcagcggacgccgcacgaaaaccggcggaatcagctagctgcggctgcactcgggcggaaggccctgggggaaccgccagccgtcgtcgcagtagttgtagcgcatgtagttgctctcggcccaccggacggtgccccactcggcgtcgtcgggctgcttgctcatccacccgtcgtcgccgccgccgccgcaggccccgccgctgacgcaggcgttggcggagtagccccggtaggagacgacgaagggcgcggcggaccagtccacgggcaccttgcccttctcggtggcccagtagctgccgtcccacagcgt

SEQ ID NO: 9747 - DNA, 739 bp, Zea mays
  misc_feature: Ceres CLONE 445191-R
ccgattgggtaccgggccccccctcgaggtcgacggtatcgataagcttttttttttttttttttctttttttttttttttttttttttttttttttttttttttttttacaaaacaaatcctgcattttgtacctggaatttattacatacacatagtaattagtagagacgcatatcacctgattaaccgtgtccaacgctggggcgatcaacaagtacgtaccctatgcccctcattattaaccatcacaagacaccacaatataatttccaacacatgcataaaaaaatttgacaacaggacacggcccaactaaggaaaccccgccgcgccggcgccggcgccggccgactagctagtaatcctctggcccgagcggctggtgcgtgtgcggcacggcatcggcgggcgggataaacaggtactcgtacaccagccctgcgagccccgccccgaggaaggggcccaaccagtaaacccagtggtgcctccaccgccacccgaaaaacgccgggccgaagacccgcgccgggttcatcccggagccgtcaaagggcccgcccgccagcacgttggcgccaagcaggaaacccacggccagcggcgcgatggtgcccaagtggccccacttcgggtcgaccaccgtggcgtaataggcgtacacaaggccgaacgtcatgacagccttcagcaacacggcgtgccggtccccgaccccggacgcgagggcgaaccg

SEQ ID NO: 9748 - DNA, 836 bp, Zea mays
  misc_feature: Ceres CLONE 445273-R
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
gaggtttttgttttgctcgtcggcggcaccccaactcattttnnnnnnnnnnnnnnnnnttcgattgggtaccgggccccccctcgaggtcgactctatcgataagcttttttttttatttttttataaggacacatggttgacagcattcagatagatattgtgctcacactcacacacacaatgacacacacaccaccacgccgcgagcacgttttattgtatatacacgtacaaacaagcaaacaataggctgataccactcccttgtatgagataacatgagtttagattagaagaagactacgccccagcaaaagcacgttcgcaggttgatggaccttccaagtacaagactgaaagagcgaaaccgcaaagtctctctctccactatcaaccatgcacggacacctattctcgaatgtcatggatatagggggggcacccaaacaaattattgcgcttaaattatagagaaataaccccccccctggggacccaccccccaaagcattataatagtataggaagctgcgggaacccaatggagcgacaggtatatgggtcgttaagttattgttgttaaaaaagtatgttagcttgttcgtaagctatttaactaaaagtagtagggtaaaccaatgagtgctgtgtatctacaccctatattacgtggggtgttcttaatatagataattaaatgaagtgcagaacgggcaacatatttttatatggtggaggagatctcccgtctcctcacaatcgcaaaatggcattgaatattgctgacacttctcgacatggtgtgtggcggtgtccctgcctttgtacgagtg

SEQ ID NO: 9749 - DNA, 624 bp, Zea mays
  misc_feature: Ceres CLONE 445275-R
  misc_feature: Pfam Name: PMM Pfam Description: Eukaryotic phosphomannomutase
  misc_feature: SWISSPROT Homolog: EC 5.4.2.8 Phosphomannomutase
cgaggtcgacggtatcgataagcttttttttttttttttttatttttttttttttttttttttttttttttttttttttttttttttttttttttttgggacccttaaaggattaccactttaaatatttttctttgttatctcccttacatgtttggttcacatgagtcaatgatttgtggagccaaaagtatatttctaaagttgccatcttttaatggtataaatcccatttttcaaaaaaaaaatagggggctttttttttcttgaaaaaaattccaaaagggtttccgcccaaaatgacttaataaaaatttgttggaaataaactggaaatcccttctacaaaaaaaaaaatctgcattgctaaactgggtcaccggggctggtaactgtatgaccaactgttctttcaaattcaaaaatctcataatcattgccacccttgtaggtcttatccccaaaaaaatggatttcttgaaattcctcaagatatctcaagcaataatttttgtcccacccttgggaaaatacatcaaaacaaatctgccccccgaaaaaaaatgtccagttcctgtttgcaaaatttttcccaaaccctgacccctttttaggccggatgtt

SEQ ID NO: 9750 - DNA, 1544 bp, Zea mays
  misc_feature: Ceres CLONE 445389
  misc_feature: Encodes the peptide sequence at SEQ ID NO. 9751
agtcagtaatagtcagtcgagtcctcctccctccgccgcggccccgccgcccgtcacaccaaaccttccctccacctctttctccggcctctcaccggcaccacacgcacctaccctcagtcacctcacctctccgcgttttatcggcgttccggcagggggacgatggcgaggcggcgagccgcgctggcggcgctgctagtgctgctgctgctggcggcgtgcacggcggcggcggccgccgtgaccgtgtcgcggaagcagcggcagcggcaccaccccggcggggcgtcggcgtcggcggcgcggtcctgcgaccccttcgcggcggcaggcgcgtgggtggaggacgggtcgtacccgctctacgactcggcgcgctgccccttcatccgcgacgagttcgcgtgcgcgcgcttcggccgccccgacacggcgtacctccggtaccggtggcggctggacgcgccgtgcgcgcagcccgccttcgacggggccgcgctgctccggatgtggcgcggcaagacggccatgttcgtcggcgactcgctggcgctcaaccagtacgagtcgctgctctgcatgctccacgccgccgcgggccccgccgcgcggaccaccctgtcgccgccgtccgggaagatcgacccctcctccaccgtccgcttcgagtgcgagcaggactacaacgtgaccgtcgtgtactacctgacgcactacctggtggacctcgtgacggagccgcacaccggccggcgcgtcctcaagctggacgccatcgaccaggcccgcgactggctcgccgccgacgtgctcgtcttcgactcctggcactggtggccgcgcaccggcgccacgcagccctgggactacatccaggtgggcgacacggtggtgaaggacatggaccgcacgcaggccttcgccaaggcgctgcacacctgggccaggtgggtcgacgccaaccttgtccagaccgacaccaaggtcttcttccaggggatctcgccttcccactacaggggccaggactggggcgcgtcgccgaagaagacgtgcatgggggagacgcggccgctcaacgccacggggccctacccgggcggcccgatcccgcagcaggcgatcctgcgcggcgtgctggcggccatggccaagcccgtctacctgctcgacttcacctacctctcgcagctgcgcaaggacgcgcaccccaccaagtacgacggcggcatcttcggcggcgactgcacgcactggtgcgtcgccggcctccccgacacctggaacgtcctcttctacgccgcgctcaccgccgggcaggggcacaactgatggatgagtactacgttttttctttctttcctttttctttttaccgacacgcagtgttacgtagctcaataagtaaagtaaaagaaaaagatagcagattgatttcgtatagttacgagggggccttcaaaagatttttcaacctaaatgagttgatagaagaatatcaaaagagaatattgtaattcattccaaaaaaaaaaaaaaaa

SEQ ID NO: 9751 - protein, 389 aa, Zea mays
  misc_feature: Ceres CLONE 445389
  misc_feature (225)..(382): Pfam Name: DUF231 Pfam Description: Arabidopsis proteins of unknown function
MARRRAALAALLVLLLLAACTAAAAAVTVSRKQRQRHHPGGASASAARSCDPFAAAGAWVEDGSYPLYDSARCPFIRDEFACARFGRPDTAYLRYRWRLDAPCAQPAFDGAALLRMWRGKTAMFVGDSLALNQYESLLCMLHAAAGPAARTTLSPPSGKIDPSSTVRFECEQDYNVTVVYYLTHYLVDLVTEPHTGRRVLKLDAIDQARDWLAADVLVFDSWHWWPRTGATQPWDYIQVGDTVVKDMDRTQAFAKALHTWARWVDANLVQTDTKVFFQGISPSHYRGQDWGASPKKTCMGETRPLNATGPYPGGPIPQQAILRGVLAAMAKPVYLLDFTYLSQLRKDAHPTKYDGGIFGGDCTHWCVAGLPDTWNVLFYAALTAGQGHN

SEQ ID NO: 9752 - DNA, 699 bp, Zea mays
  misc_feature: Ceres CLONE 445520-R
  misc_feature: Pfam Name: DUF604 Pfam Description: Protein of unknown function, DUF604
  misc_feature (374)..(374): n is a, c, t, g, unknown, or other
cgattgggtaccgggccccccctcgaggtcgacggtatcgataagcttttttttttttttttttcttgattacaaacaaggccactgcatactctccaggagaaacaaagtcttgcttgaaatccggagacgataagaatttgaaatcttcctatcttcttctatactcgagtaatagctaatgctcctgctagttgcctgtaactcaccttccctgcatatgcctacagcgctggtcatcgtcttctgtcagctcttcccatctttgggcgaagaagccactgtgcaacagtttcgccttgtaaacctttcccagacaccggggtcaggcttcttgaggacgatgatgtgatcgatatagctgtacggggccnttatgacccaccggatacgctggccccgtctcttccccaccccccccccactggtatctcttcaccttcgtctccccaaccccaaaggactggtggcaagccaacgataggtagcacaccaccaggttcgggaacgttggctgctcccctactgcctcatttttaacgcgtccccccagaagtcggagcagcaaataccgttggagagagtgggcgccagcatctccatctccattggggacattatgtccctcacaaccggctctagggaccccccgcgcgtgggataccggccaggtggattcgggctgtcccacctagacgg

SEQ ID NO: 9753 - DNA, 1584 bp, Zea mays
  misc_feature: Ceres CLONE 445725
  misc_feature: Encodes the peptide sequence at SEQ ID NO. 9754
aagatgaatgtttaactggaactagcgagtgtgataaaatgttccttatcggcggaaggggcagatatttttcggttctgtgacggctttccgagtttggtggattgtgtcgagagagtcagagagggacaccaaagccggctacggccagtccccagtcagcctagcttcgctcgctgttcgttcgtcctgatagcttgaaaccgccatggccatggggctccccggccaccgctgccgccttcccgctctcgggtcggtcactccactctgtcccgccctcgctcgcaggcccctcccgcggacctcggatctccgctactcctccctcgaagcccaagctggggacactattggggaggaggtcctgcgcatgttccttgaggagaggcaactgcacggcgatttcgtcaccaagatctctgacatggtctggaggaggaatggcggcaatgttgatgcggttgaggcgaccacagaccaaggcaatgctgtagatgttgctcagcctgaagacgtgcgggaagatgttgtggacgacggaatgttgagactagcggcaaccagaggttgggtgcccggtgacagcagccctcctttgagcaagaggctttcagctaaggattggcagaatgagagagacaaaaggaaggagctgaatcttttgaaatatgaagcactcaaggatgaattgctgctcttgaccacagggattggagcagcatgtagtttatactgtctcctggttttctctctcgagactgctgtcagttatgctttgggggttggtttcagctgcttgtatcttcaacttctgtgtcaacatgctgataacctatcaaagcaagatattccacaagtttttctaaagaagaaagtgaagaaaattggcattacaagtgaagatttgaagaatacaatagagaagacattgggtggtggaagagtagctctttcatccccaaggcttgtgattcctgccgtgatttttggattgtcagctttatcagaccacttcaaaaatagttttttcagttttgaggttcttccagggatgatgggtttcctcgcatacaaggctgcagctttggttcaggtctacagagataacgaggatctccgcttgatacttcctgaggaagaggatgctgacagtgaaagcacttgatgcatacaaattagagattatgttaacctgttgataaaaacagaacggtctgatttactgagtcatgcttcagttctgaaaaaaaatctcttaaggatatcctaaaattcgtttgcttgaacagcctagtgccaggagtccaggacagctcactactattaaaatgagatgtaaaattacctgataatgtcataatttttcacaaaccaaacaacttcaactcgtcatagcaaggcttctgattgttaacccagacaagagagtttttttttactattatgatactcataagaagtggcttctctacaatagtatcaatagattggaattctctataatgatatttgtaagcgaggaacttctccaaaacggtatttcaccaatacttattgtattttcctaaaaaaaaaaaaaaa

SEQ ID NO: 9754 - protein, 319 aa, Zea mays
  misc_feature: Ceres CLONE 445725
MAMGLPGHRCRLPALGSVTPLCPALARRPLPRTSDLRYSSLEAQAGDTIGEEVLRMFLEERQLHGDFVTKISDMVWRRNGGNVDAVEATTDQGNAVDVAQPEDVREDVVDDGMLRLAATRGWVPGDSSPPLSKRLSAKDWQNERDKRKELNLLKYEALKDELLLLTTGIGAACSLYCLLVFSLETAVSYALGVGFSCLYLQLLCQHADNLSKQDIPQVFLKKKVKKIGITSEDLKNTIEKTLGGGRVALSSPRLVIPAVIFGLSALSDHFKNSFFSFEVLPGMMGFLAYKAAALVQVYRDNEDLRLILPEEEDADSEST

SEQ ID NO: 9755 - DNA, 733 bp, Zea mays
  misc_feature: Ceres CLONE 446018-R
  misc_feature: Encodes the peptide sequence at SEQ ID NO. 9756
  misc_feature (21)..(21): n is a, c, t, g, unknown, or other
  misc_feature (38)..(38): n is a, c, t, g, unknown, or other
tttttccccgccttgggcccngaaggaagaaaagaaantccgccctcttcttggttaaacaaattgtgtacggggccccccctcgaggtcgacggtatcgataagcttttttttttttttttttacacagaaaagactaacatatatattttttttttgttactccgctccggtagtacccaatatacatggacatgaacgaatggaattcacgttacatatcagctcttcccttgtgccaaaccacaagaggatcagtcgaccatgtcctcgagcacgacggtggcgagcggcgggtgcgcgtaggggcccttgacccaggtgttggcgatgaagcggtagggcgcctcggtgaggtggatgccgtcccagctgacgtgcgcgtcggggtcctcgcaggtggtggcgccggggagcccgcacgacgcgctcacgttgtagttgtacggcccgccgccgccgcagcaagcccgcagagcgccgcgcttgtagccgtataggtgcggtgtgcgcgcgaactgtatgtagggcgtgtagtagtcggcgtagacgacgcgggactccgggcggcggcgctgcaggcggtctagcgccacaccggaacatggcgttgtgggaaaaacgcgaaccctgtttgtactttcttgaagggcaatccgggtgcgccagggtccttactccggaagcgggtcccttcggaacgggtaaccattggcgaaaaccgcgaatgggg

SEQ ID NO: 9756 - protein, 103 aa, Zea mays
  misc_feature: Ceres CLONE 446018-R
MDMNEWNSRYISALPLCQTTRGSVDHVLEHDGGERRVRVGALDPGVGDEAVGRLGEVDAVPADVRVGVLAGGGAGEPARRAHVVVVRPAAAAASPQSAALVAV

SEQ ID NO: 9757 - DNA, 1296 bp, Zea mays
  misc_feature: Ceres CLONE 446156
  misc_feature: Encodes the peptide sequence at SEQ ID NO. 9758
aactctccatcgatggcggaggcgaacgtggcagcggcgtcgctcttcggcgctgacggccgcctctgctcagccgacatcctcgcgccgcctgaggtccgggctaggatcgaggtagcggtgctcaacttcctcgcagcgctagcctccccttcctcgccggccatctccgtcctccccctgattagtcgcagctctgccaactgcagcctgcgcagtgggttgctgaacgacgtctcttcggtttatctctcatacaccttctgcaagaggtctctgacgcacaatccaaaggcgttcgtaagagtgtggaaggtcatggagatgtgctacaagatcttgggggaggggaagctggtccagcaacgggagctgttctacaagctcctgtccgactcacccaagtacttcagctgtcaacgtcatgtcaaccaagccattcaagatgttgtttccttgctccggtgcacaaggcagagcttaggagtcatggcatcaagcagaggggcactcattgggcgccttgtgttgcatgaaccggacggggagcagattgattgctccattcttggagcttcagggcatgcaattacgggggacctgaacctgttgagcaaattaaatttgtcttcgggctctcggtacatcattgtggtggagaaggatgccgtatttcagaggctggctgaagaccgcctgtataatcagctcccttgtattctgatcactgcaaaaggatatcctgatattgccacaaggttcatcttgcatcgactgagccagacatttccgaatatgccgattttcgcattagtggattggaacccagcagggcttgctatactgtgcacttacaaatacggaagcatatcaatgggcctagagtcatacagatatgcttgcaacgtgaaatggctcggggtgagaggaggtgatctgcatcttatccccgaggacgcgtttcaagagctgaagccacgtgatctgcagattgccaaaagcttgatgtcgtcaaagttcctgcaggagagtcacagagctgagctggcgctgatggtggagaggggcaagcgtgcagacatcgaagccctctactcccacgggttcgatttcttggggaagtacatcgcgagaaagatcgtgcagggcgattacatctgacgattggccgctggaatgttagcatggttgcacggaacaatgagctgcatggactgtagtacagtagctatgtccaactgcctgtagactgaaacaatggtctgtatgggaatgtacataaatacaacaagagta

SEQ ID NO: 9758 - protein, 382 aa, Zea mays
  misc_feature: Ceres CLONE 446156
  misc_feature (92)..(160): Pfam Name: TP6A_N Pfam Description: Type IIB DNA topoisomerase
  misc_feature: SWISSPROT Homolog: EC 5.99.1.3 DNA topoisomerase (ATP-hydrolyzing)
MAEANVAAASLFGADGRLCSADILAPPEVRARIEVAVLNFLAALASPSSPAISVLPLISRSSANCSLRSGLLNDVSSVYLSYTFCKRSLTHNPKAFVRVWKVMEMCYKILGEGKLVQQRELFYKLLSDSPKYFSCQRHVNQAIQDVVSLLRCTRQSLGVMASSRGALIGRLVLHEPDGEQIDCSILGASGHAITGDLNLLSKLNLSSGSRYIIVVEKDAVFQRLAEDRLYNQLPCILITAKGYPDIATRFILHRLSQTFPNMPIFALVDWNPAGLAILCTYKYGSISMGLESYRYACNVKWLGVRGGDLHLIPEDAFQELKPRDLQIAKSLMSSKFLQESHRAELALMVERGKRADIEALYSHGFDFLGKYIARKIVQGDYI

SEQ ID NO: 9759 - DNA, 1031 bp, Zea mays
  misc_feature: Ceres CLONE 446190
  misc_feature: Encodes the peptide sequence at SEQ ID NO. 9760
atttttctccaaaccatataccctagtccgtgcacaggtgggcgcccgccgccacctgcggctcggtggactccggcatcgacacccctggcccccagcgccgcagatcgcaagctctcagcaacgacgtgcttggtaggaacccgtgccgaccgactctttctctgcgggacggtctcgagtttggtcgggagatgggtgtcgggagctgctgcgtctgcaaggaggcgccgcccaagtacaagtgcccttcctgtcgcacgccttattgctctgtcacatgctttaaaaagcacaaagaggaatcttgtcaaaagatattgcatcaggaagaaattagcaagtcagcattgcaggaggaagttactaggttagtggaagatgcaacaaagtgccctaatgacaaggatcatccctctttatcactgcacaccacatgcactgcagaatctccaaatacagcgtgccctacaaaagctcttgaagttgaggacctaagctggcttgttgacaacaatagactaaggtccttagcggaactgaaagggatccacgacgctctcagggatcctgaactgcagagaatgatacttcaaattgatgggtcttccgaaccagaaaaagaattggagaaagtgatggaaggtcaagcttttcgcgagttcactgataagattcttgacattgtcaacccacaagaataaccgtctaccctgtttggtgggattctgatgctggagtaaacagaagcatccgggcaaacaaagcaaaagtggagctcatctccgttttccttattccaggatggtataattcataacatatcttgagtcgcctgtttttccatgatggggtagactttagaacacatactgtgtcgcctagtgaaaggaaattacgtctgctgaaaaatctctcttgccaaatataggccctgtttggattcggtactactaaagtttagttggactaaactttagtaactaaattttagtcactaaaatctaaaaaaagaaaaaaaaaaaaaaaaa

SEQ ID NO: 9760 - protein, 169 aa, Zea mays
  misc_feature: Ceres CLONE 446190
  misc_feature (2)..(32): Pfam Name: zf-HIT Pfam Description: HIT zinc finger
MGVGSCCVCKEAPPKYKCPSCRTPYCSVTCFKKHKEESCQKILHQEEISKSALQEEVTRLVEDATKCPNDKDHPSLSLHTTCTAESPNTACPTKALEVEDLSWLVDNNRLRSLAELKGIHDALRDPELQRMILQIDGSSEPEKELEKVMEGQAFREFTDKILDIVNPQE

SEQ ID NO: 9761 - DNA, 669 bp, Zea mays
  misc_feature: Ceres CLONE 446642-R
  misc_feature: Pfam Name: Globin Pfam Description: Globin
  misc_feature: SWISSPROT Homolog: EC 3.5.1.52 Peptide-N(4)-(N-acetyl-beta-glucosaminyl)asparagine amidase
ccgattgggtaccgggccccccctcgaggtcgacggtatcgataagcttgatgggctcaccagcaggcagtggcttaggagcttgaagttgaccgggtccacccgaagcttgtgcgcgtgcaggtcgctcagggcggacagcgcgttgggcatgtcgtccacgtgcgccacggcgttggtcagcgcgtcggccaccttcttgccgtggcccttaacctgggcagagccgtggctcaggtcgaagtgcgggaagtaggtcttggtggtggggaaggacaggaacatcctctccagggcctccgcaccatactcgccagcgtgcgcgccgaccttaccccaggcggccttgacgttggtcttgtcatcgaattctgagctcacattaaggttcaatccggatgcctcatagctgagcaagcctccagtggtcttctcgctcttgtgatccagccacagatgcaaattggcatcaacgtaccacacatcaagagcatttgtcacgccaaacccgaaatcatgttcctcgccgtccaggagcttgcccaagaatggcgtgatgtcaatgtcatatgtcgggagattgaatgagccgattcctgtgattggccgccatagaagcgggttaacaccaccggtgtaaatcacagtgaatggccaaacagcgccgac

SEQ ID NO: 9762 - DNA, 634 bp, Zea mays
  misc_feature: Ceres CLONE 446767-R
  misc_feature (634)..(634): n is a, c, t, g, unknown, or other
caattgggtaccgggccccccctcgaggtcgacggtatcgataagcttttttttttttttttttgtcactgaactaaagaaaatcactgaatggaacttattgaacattatttttattctgcatgtcacattcggtggtattattaataaaaccaatgctattactgcaaatgatgctatggctaacagctagcagcctagcactaacacctcaccaccaaaccatgtactactacaatctttgtcctctcattcagtgcagaagttctttgccaaataacccagctataggcaaacatcaagatactgcagggagaaccttgtgcatttgtatgacttgctgccaccactcaactgcagcagccaccagcctgagaggacgagccagcaccacctccggatgagttgggaacagcgtagccaactttgatcccgttggactcatttgatacatcaaatatgccatcttggattttcttgtatattgtaccagcggtcttaatgaatgcctcctcaacgttttgtgcagttttagcagatgcctccataaagaccagaccatgctccttggcaaactgttcaccttcctcatagctgacagcacgtctatgagaaagatcacacttgtttccan

SEQ ID NO: 9763 - DNA, 689 bp, Zea mays
  misc_feature: Ceres CLONE 446976-R
  misc_feature: Pfam Name: V-ATPase_H Pfam Description: V-ATPase subunit H
  misc_feature: SWISSPROT Homolog: EC 3.6.3.14 H(+)-transporting two-sector ATPase
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
ggcccccccccccccccccccctctcccccccccaccaaccccccccaccaccatctttccccctcttttgtnnngctnnntttccaaatgggtacgggccccccctcgaggtgacggtatcgatattttttttttttttttttgctacagttggagatcagaatttacataaatgaatcaacaagcccatggacactttattacatcgagcatggtatggctctaattatttattatacatcggtctcagaaatcaaataacaataggatataatggacaagaattttcaaggttttcttaacagccatttttaaaaatggccaggagttctctggatctaaatacaaaaaagactcggtttctctcaagcccgcagaaaactggcatactttgcgccaaggaagagcctctgcacacatagcagcgcatttttctgcacttcagtgttttcatgattcatgagcttcatgactcggtccttggccttgaggtctgccaccacgattcggccagatggatggcactggaggaactgtgagaggtcataccaggccacggctagagcggcggtgtcacttgttgtgtcaatgattgtcatgataacgccgagaatctggaaatcatttctctttgaaattgttaatgtttgtccggcagaaactttgatctttggttgatttcatacct

SEQ ID NO: 9764 - DNA, 707 bp, Zea mays
  misc_feature: Ceres CLONE 447255-R
  misc_feature (8)..(8): n is a, c, t, g, unknown, or other
  misc_feature (20)..(20): n is a, c, t, g, unknown, or other
  misc_feature (39)..(39): n is a, c, t, g, unknown, or other
  misc_feature (56)..(56): n is a, c, t, g, unknown, or other
  misc_feature (57)..(57): n is a, c, t, g, unknown, or other
tttttccncctacttttttntcctctcagatttgcacancataacttcctaaaacnnccaaatgagtaccgggcccccctcgaggtcgacggtatcgataagcttttttttttttttttttgtccaaaacgatagtttatcaaaatttcatctgtatagacagcccaaggtggggctctcgcatgctttgaacagtagcttttcccaaggacacagctctggcagacctccaagcgctacaccacacacacaggagcaggaagccaaaaggggtaaagtcacagcaatgcttcagacccaagcataccccatgcagtagatgtagatcacaatcatctatagatctgaaagaaaagaacccacaccgccaccaacacaacggtctcccaataatgtcacggcaaaggtgaaaaggaggaacaaaatgctaccaagtgtacacaggtcagcatgaagaagaagctcacggccaagccaaactccggcgcaacaccaatgtatggcctgcctggccaagtgggagaccaacaacccccaagaagggaacccctatatgtaccactgctcccccttcaatcgccataatcagtgctgccgctacacgagctgctgctgtcccgactgtgctgcgacaggcccctcaagtgacccggcaggctggccactccgccgtcgatgctcgtcgatgctcttctcctggaaaaacc

SEQ ID NO: 9765 - DNA, 646 bp, Zea mays
  misc_feature: Ceres CLONE 447376-R
  misc_feature: SWISSPROT Homolog: EC 3.1.1.11 Pectinesterase
  misc_feature (354)..(354): n is a, c, t, g, unknown, or other
  misc_feature (357)..(357): n is a, c, t, g, unknown, or other
  misc_feature (364)..(364): n is a, c, t, g, unknown, or other
tcgaggtcgacggtatcgataagcttttttttttttttttttggagcaacagaaaaatgtaaatcttgtatattgttttgttcctctgcttctttacatggcgtggcgacgtgctgccgtgtgagcgactgggagatttacgataatatacaactaccgcctgatccactcgttgccgtcgatgaagttgagcgagacgaagggcctggcctcgtcgtcggtgagctcgtgcgaccacgccacccggccggcgtaggtcgcgcccggccccctgcacttgtactgaccctaaaacaccgtccgctcacggctggggtcgccccacctgcaccatcccttggggatgatgatgtngtncacgcanctgcaggcgaagacgacccgggagaaggtgccccaggcgcagcccatgtagaacgcgccggaacccgttacccggaagttgacgaacgagaaccccgtgtcctccagcatgctctgccggttctgcgccatcagcgccccgtaatccacccccatcgcgtgcacctggcagtcctcgtacagcgacagcgcgtttcccaagatgaagacccccgacccttggatgtagcactccttgtcatagtgccggcccaaatggacgcacagccgtgtccccgtggtt

SEQ ID NO: 9766 - DNA, 753 bp, Zea mays
  misc_feature: Ceres CLONE 447410-R
  misc_feature (37)..(37): n is a, c, t, g, unknown, or other
atggaagcaccaaaacaaggcccccggaggagtgtanggggatgtcgcgtgagagaaaaaactgttttttttttttaagttgaattatctgaaggcagagattcgacgaattgtttgatcttgtcatgatttcatgacgacgagaacgagatatgcagacacgcaggatcaacaaccaaacatgcaagaagccggtggcattaagagaggccagcgatggcgaggctgccaccggtcgtcagtcacgcttgacgaatcggtccttcatccgtggccgcttctcgttgttgagcttgcgcacctcgtaccgtatcttcttgaagaagagcctgcgtcctccgcttctcccggtaccgcgacacgccgggcctcccggtcgtcgtccatccccagactaggcgtgaccggaaggtactacgcgtcgtggacgtgcactccgtcccacaacccacatgttcgtgtagtccagtggccacctgaagtctagcttgacgtgtggtcgctcaccgcctccgattgcagaagagctcccccagatctgtatgaaggccctccgtagttgacgttagagccgatagaatctactgcaagaactggggagtcacgctccccgggaattctgctgagcgggtccactccggccgcctccctatgaccctgtaggccattccggtactctgaaatcgaacgtcccaggtatgttccttcagaacggcctacctaagttccatgaattccatggtccaacagggc

SEQ ID NO: 9767 - DNA, 873 bp, Zea mays
  misc_feature: Ceres CLONE 447410-R2
cgattgggtaccgggccccccctcgaggtcgacggtatcgataagcttttttttttttttttttgaaaaaaaatgttttttttattttaagttgaattaactaaaaggcagagcttcgacgaattgtttgttcttgtcatgatttcatgacgacgtgacgagatatgcagacacgcaggctcaacaaccaaacatgcagcaagccggcggcattaagcgaggccagcgatggcgaggctgccaccggcggtagcacgcttgacgaatcggcccttcatccgtggccgcttctcggcgttgagcttgcgcacctcgtaccgtatcttcttggagaagagccgcgtcctccgcttctcccggtaccgcgacacccgggcctcccggccgccgtccatccccagcctcggcgtgcccggcaggtcctcgccgccgtggccggccactcctcccacaacccacatgttcgtgtagtcgtggggccacctggtgtcgagcttttgaacgtgtggtcgctcaccgccaccggtccacggcgagctcccccagctctggatgatggcctcgtatttgagggtgagcgagaggctcgtctgcaagaactgagcgtcggctcccgtgtcgctgctggcggatctctcgtccgtcgccgtgtcctgaggcgacccgtactccgaagtcgatgtccagaatctcgtcagatgcctctaggtccagctccaggtcacatgccagagggccactggtttcccagaacaacttgggtgccgtccgttctcacccttaacttgcttggaaatcacaccccacttcctttggggtccaggaagcccacggtctcattgttaaacgaagaagcctccctcgtttcggcat

SEQ ID NO: 9768 - DNA, 795 bp, Zea mays
  misc_feature: Ceres CLONE 447410-R3
  misc_feature: Translation starting site: 143
tttaagttgattaactaaaaggcagagcttcgacgaattgtttgttcttgtcatgatttcatgacgacgtgacgagatatgcagacacgcaggctcaacaaccaaacatgcagcaagccggcggcattaagcgaggccagcgatggcgaggctgccaccggcggtagcacgcttgacgaatcggcccttcatccgtggccgcttctcggcgttgagcttgcgcacctcgtaccgtatcttcttggagaagagccgcgtcctccgcttctcccggtaccgcgacacccgggcctcccggccgccgtccatccccagcctcggcgtgcccggcaggtcctcgccgccgtggtcggccactcctcccacaacccacatgttcgtgtagtcgtggggccacctggtgtcgagcttgacgtgcggtcgctcaccgccaccggtccacggtgagctccccccaactctgcatgatggccccgtagttgacggtgagccgacaggctcgtctgccacaactggggcggccggttcccgcgtccctgctggcggctccttcgcccgtcgccgtgtcctggaggcgttccgtactccaactcccaggccccctaatctcctccgatggcctctaactccacgttcagggcaccaggctcacggcggcccctgggctttcgcagaaacgccacctggtgacccgacgggtccccaactcttgcccttgcggtgggcatccgcccgcccacactcccactgggatccaaggaagggccccacagcgttcccagagggtaaaaacca

SEQ ID NO: 9769 - DNA, 625 bp, Zea mays
  misc_feature: Ceres CLONE 447580-R
tcgaggtcgacggtatcgatattctttttttttttttttgcttgaaaccatttcagttttcataaaccagtttcttaaaaaaatagatgctccaaacatgtcctaagtcagtgagcaaaactgtacattctttggcgaagaaaatttttgcatctcaatcttctagagggtcctgaggagtcttttctggcttactgaggtactgaacggctcgtgggaatcctatctactgcgtggaccgtgggatcacacacacaaaggtcttttgcttccaactcacggaacacgcttctacatctcataatggtccttcctaggagcagcatcaaagtagatcttgagcaacctttgatccatgatcatgttaggaatcctttctcccaagaaaatctttgagttattggcgattgattcaatgaacctcacctcaagatactcaggtgtctccttgagcctattggcctctgcttccttcaatatcctggaatagtttgcatcagccacggctttctctcgtgcgaggaacatgtcattatcaatctgctcccgtcccttggaactgtcctttaccttcaacttccgctccatctggatcatgctcacaagtgcggtcgtctctgcctcc

SEQ ID NO: 9770 - DNA, 664 bp, Zea mays
  misc_feature: Ceres CLONE 447682-R
  misc_feature: Pfam Name: Peptidase_C14 Pfam Description: Caspase domain
cgattggatccgggccccccctcgaggtcgacggtatcgataagcttttttttttttttttttcggcatctaatttgtcttctcctttaacaactgttgcactgaacattgtgagggcatgccaaataaagggcaattccacgtcgattgttaacaatactggatggattgtgtaggacttctaaggtcttgttacgtttgtgccggattgcttctctaatttatataaactttgattatctggaacgattacaggtgcaatccgacacaaactaacaaggtttaataccgaaatgtacataatgataacgtgaaatgggaggagatatatagcccattgggcaatactatcaacacgtcatacggagaagggcttcacataaacatcaaatggctcacacgccgtcacctgtggctcctgtctcataccaccagctgaaaggctccctccagtaagaatcattgtaattagagatgtaacagcaccgccacctacacccgctgaatcacctgtgttgcgtattgtggaacacatagagttcatgatactaccgtaggtggtgccctgtccacgttcaatatcttggatgaagcagaatgtcattgcaccagtcgaagtgatctttgataaaccacaggtatctgcagaggtctgatcatcatc

SEQ ID NO: 9771 - DNA, 1071 bp, Zea mays
  misc_feature: Ceres CLONE 447822
  misc_feature: Encodes the peptide sequence at SEQ ID NO. 9772
aagcaaggtatctgtctccccgttttatggcttgttgatcaggccgtcttcgctcgctgaccaccaccgcctcgctcgtcgagcatatagccatgccatggcaagcacaggctcagagggatagataggtccagtgcaagcgcgcaggcatcgtcatccagggagggtggtggcccgtggtccacatcgatgcgatgccggttcacgttgcgctcctcgccgtgccggcggtggccgctgggttcctgcaggcgttccagttcgcgttcctgctgtggcccttcaacctggcgctgccgctggcgcgccacctgccgcaggcgtgcatcgcgttccgcggggtcgcgtccttgtacggagccgagctgcggcggtacgcgggcgccgccgcccgggccgccgtgcccgtgctgcagccgccgagccaccaccggtacgcctcgctccgcctccgcggcgtgcagcagcgggcgcacggggatgccgtcgtcgcgcacgccatggtcgcgctcgtcgacatctcctactgatgccggccgcttgcatcgcgactccgggcgcacgtccgggcgattcctcagccttttagcatgccgtcccgagtgtaaataaaacaatatataccggttcttcctccctaccttcgtcagctgaggtgtgtagtttgtttcttcaccatggacctgtggcgagcttcaatgtgtacaagaccggaattcgagttgcttgatgtgcctcctgttgaagtcacatcaattctgtacagtatgtcatttgaagctacttgttcgaaccggttttgagccggcggacagtccggccctgaggccggacggtccgcggtccggacggtccgcgcctgtgggccggacggtccgcgcgtgcgcagaacagattagggttccgagttttgtgctacggttgttagctatattcgcgggattagctcggaatcagttgtgtaaagggtccagcccccctcctctataaatagagaggtctacggccgatttgtaataatcaacaatcgaatcaatacaacttctatttcgcaaaaaaaaaaaaaaaaaa

SEQ ID NO: 9772 - protein, 111 aa, Zea mays
  misc_feature: Ceres CLONE 447822
MPVHVALLAVPAVAAGFLQAFQFAFLLWPFNLALPLARHLPQACIAFRGVASLYGAELRRYAGAAARAAVPVLQPPSHHRYASLRLRGVQQRAHGDAVVAHAMVALVDISY

SEQ ID NO: 9773 - DNA, 669 bp, Zea mays
  misc_feature: Ceres CLONE 447878-R
caattgggtaccgggccccccctcgaggtcgacggtatcgataagcttttttttttttttttttaaggaccatatgataatctccttagttattattttattttagattgctgtcaaagaaaaccaacgtatcagttcgctgccaagtgcaagagttgggatcaaaactgcaaaaggctatatttctgtacatgatattaatcgcaagaatgacttccattggccattaccaatagaatacaaattgacccaaatatatctgagtgcagtggccaccagagactaggcctttcttatatttgtggggtgggggtggagggaacaccaatgacacgcctggccaaatcaaggtcctacctgattccatgctgaaaatggtagccacacaacattctacaccgtcaacttagacggatgcacaaaacggataggctgcacaagcccaatgatcgatctaaatcacctgaagagcccagggctacctgccccctttccaggagacaacccggtgccgcctcctacataaaggatactacaatgcctcttaacagaccggaaaaccgaagggggaccatccggttcgtgataactgacccattgggttcggtcggacaaacccagacaacgggcccacaccaataaaggccagagaaccaactccccgacgct

SEQ ID NO: 9774 - DNA, 899 bp, Zea mays
  misc_feature: Ceres CLONE 448000-R
  misc_feature (1)..(1): n is a, c, t, g, unknown, or other
  misc_feature (2)..(2): n is a, c, t, g, unknown, or other
nnccgattgggtaccgggccccccctcgaggtcgacggtatcgataagctttttttttttttttgttctgacagaagttactttgatggttgattgccgaatagtcattctcaatggttccatcatgtctaaaatgcaaggcaaaagggcctgacctaaccagttccctcccaacaggtttgcaaaagggtacaaacagagtgtttgtaagaatgtaagcaaatgcatcatgatgcacaggaccacggaagccttcagcttatggccatgccttccggttgagcttaggcagagtcagttagatcccattcgatttacacgtggcttcaccggagtcttagaaggactcaccctaacaggcagagttcccaaaatcatcccgctgcaattcagagccatgatggcacccccagcatgaacaaactcaacaaaagcaatccttgtggaatgtacattgtctcctagaagtctcaaccgagagacctcaccgcaaagttcttcaaagaatttctttacatctaattgagtaaccatcttatctatgtttgtacaatagacagttcccatgaccatttccttctcatcctccctcctgggaagaaactttggattaaccgggaaaaaagcttgtcttttaaaggcaaaactctaacagggaagaaacccaaaaattgttcctcccgaaggttaaattccatgttcttgccacccttctttattcaaaaagaacttaaattaaatggcaaaccctaaaaaaacttgaagtgggggaattcccccaccaaaattcttggcaaatcaaaacaaacattggccccaaccagggtgagcgcaaaaaatatttcccccccaaaaggctctcctcccccccttggcccccacacagcttagtagatcca

SEQ ID NO: 9775 - DNA, 647 bp, Zea mays
  misc_feature: Ceres CLONE 448498-R
  misc_feature: Encodes the peptide sequence at SEQ ID NO. 9776
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (594)..(594): n is a, c, t, g, unknown, or other
  misc_feature (595)..(595): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (641)..(641): n is a, c, t, g, unknown, or other
ccaattgggtaccgggccccccctcgaggtcgacggtatcgataagcttttttttttttttttttatgaaaaaaaacagggcaacgaaggggaggtgggaactgggaagacctgtttgataaattacagaggtgaggagatggtctgttgaatgagcaattgatggccaagattgtatatgtgcaccatgtgcatctctcctcaatgtgcacaggatacttcgccaaccgaacaagcctaagtgggggtgatgatgagccaccggaggcgttctcgcgctgccggctcgccgcctggcgacgccagtacgggtacgccccctactcctgagaagtcgggacgggtccggccgtgggcggcgacagcgtcgaaccggaaggtgctggtgttcgcgctggcgttccgcgcggccaacgcgctgctcgtgcgcacgtacttcaaccctgatgagcactggcagtgtctcgaggtcgcccaccgcgtcgccttcgggtaacctcgccctcgccttgctgttgctgcctgcttcctgtgtttnnnnnnnggggggggggaaagnnnnnnnnnnnnnnggnnnnnnnnnggnnnnnnngnngggnnnnnngnnnnnnngnnnngggggnnnngnnnnnnnnnggggngggggg

SEQ ID NO: 9776 - protein, 80 aa, Zea mays
  misc_feature: Ceres CLONE 448498-R
MSHRRRSRAAGSPPGDASTGTPPTPEKSGRVRPWAATASNRKVLVFALAFRAANALLVRTYFNPDEHWQCLEVAHRVAFG

SEQ ID NO: 9777 - DNA, 641 bp, Zea mays
  misc_feature: Ceres CLONE 448573-R
cgattgggtaccgggccccccctcgaggtcgacggtaccgatattttttttttttttttttgcttttttttttttttttttttttttttggcataaatctgataagtggatataaaaaaatcataagtatttcagattccctctccatgatacaacatacaggtaactctattcaacttccagactacaaatcagaatagaaacaaaggcctgagtggataaaccagaatagaaacaaggcctgggtgcataatggttatccaatccgagagcgtcactgccttcagcagtgcagcagcccaaaggaatacagaagtaattttaggatccatcttcataggctctggtggaaatcaatggttcttgaaccaagttcaaaaacccatgactaccaagtatgatctgatatggaggtaaggatctgagagacatgaaccaagttcatactgcacggtactcaataaacagaatcaacttctgaaccaacacggcttgtgaaccatatacaggttttctcccttcactgatccagttcttctccaagctggatggttttgcattagctcgtaggtcatcgatgaatgctgaaactatctgatatacagaagtccgaagaacatctgccatggtataagctttct

SEQ ID NO: 9778 - DNA, 1186 bp, Zea mays
  misc_feature: Ceres CLONE 448834
  misc_feature: Encodes the peptide sequence at SEQ ID NO. 9779
cctattctggcacgttcccggttcaacggaccacgacgcattcccgtcccccaactcagcagaaataacacgccgagggcgcaaatccccgcgatccccacgccaatcggagaagcgagccgtcgccgatcgattcaccaccggacccaatcacaagtaaacctgcgccgggaaaccaaatccttctcaattccttcgcgacgcggaccgcaagccgaaggcgcgacgatgtccggagcggcggactaccaggagatggtggcgtcggtgccgccctcgctgaaggccatcacgctgacgcacgttcgctacagccggggcgacccgctgggtctcttcctcgcgtgggtctccctcgtcccggttttcatcagcctcggcggtttcgtctcccacttcctcttccgtcgggagctccagggcctctgcttcgccgcagggctcctcgtctctcaggccctcaatgagctcatcaaacactccgtcgcgcagtcccgcccctcgtactgcgagctgctggaggcctgcgactcccacggttggccgtccagccactcgcagtacacgttcttcttcgccacatacctgtcgctcctctccctccgccggtcgcgcgcgcgccaggtgatcgccgccgtgccatggccgcttgccttcctcaccatgctgtccagggtctacctaggttatcataccgtcgcgcaggttttcgcgggagcagtagtgggcctcgtgtttggtgctatctggtactggattgtcaataccatgcttgttaattacttcccaatgattgaggagagtgcaatcgggaggtggttgtacatcaaggatacatctcatattccagatgtgctcaaatttgagtatgataacgcaagggcagcacggaagaaagttgctactgattgatcttgttatgcttctggattgcattttgctgttgttaaggcgccttataagaattgtgcatgatatttccttcagttatgctacacacgggcacatctgcacatgtagcagcagcaacattcagagaagaaatgctcaccggagcttgtttgatttagctcttcctgggcatacgccactttgtttttccccgtatcagtcactagccagacattattttattaaaggttgttcgactataacttgataattgcttacaaaaaaaaaaaaaaaa

SEQ ID NO: 9779 - protein, 227 aa, Zea mays
  misc_feature: Ceres CLONE 448834
  misc_feature (64)..(183): Pfam Name: PAP2 Pfam Description: PAP2 superfamily
  misc_feature: SWISSPROT Homolog: EC 3.6.1.43 Dolichyldiphosphatase
MSGAADYQEMVASVPPSLKAITLTHVRYSRGDPLGLFLAWVSLVPVFISLGGFVSHFLFRRELQGLCFAAGLLVSQALNELIKHSVAQSRPSYCELLEACDSHGWPSSHSQYTFFFATYLSLLSLRRSRARQVIAAVPWPLAFLTMLSRVYLGYHTVAQVFAGAVVGLVFGAIWYWIVNTMLVNYFPMIEESAIGRWLYIKDTSHIPDVLKFEYDNARAARKKVATD

SEQ ID NO: 9780 - DNA, 951 bp, Zea mays
  misc_feature: Ceres CLONE 448969
  misc_feature: Encodes the peptide sequence at SEQ ID NO. 9781
acccggtacttttttttctctagatttggcgtcgcgactcgcgagactcctcgcgcttttcgccgagagaaaactagggttttgctcctggaatctcctcccccgcagccaccgcccgaccgtgcgccaacgatacatccttctccctcctccgatccggcctttttgatccccggatcccgtacaatatgcttcccctctcgctcctcaagaccgcccaggggcaccccatgctcgtggagctgaagaatggtgagacatacaacgggcatctggtcaattgcgacacgtggatgaacatccatcttagggaggttatttgcacctcaaaggacggtgacaagttttggaggatgccagagtgttacattcgcgggaacaccattaagtatcttcgagttcctgatgaggtgattgacaaggttcaggaggaaacttctaaaagccgatcagataggaagccaccaggtgttggccgtggaagaggaaggggggacgtcggttctaaacctggaagcagaggcattggacgcggccaagatgatggaggtagaggcagtggtggccgtggaaggggtggagttggtgccaaaggtggtaacaaaggtgggggccgtggtcgtggctgaagctggtcgacacaagggagaatgccgctttttgaggcctgtaattgtgttccatagattgcttaggacaccatgaatgaaccgagttggctggttgtatggggacacaaaccagaatggttcctgtgatctagacaccgaggatgcggcggtagccaggcttgttgctgttccccaaaactgtttggttgatatcatgagtatgatccaatctgttcagttgcttagagttatcccggttagatgactaattgattgatgttgcccattattttgctagtggcgcacgttgtgctgagtatgcaaaaaaaaaaaaaaaaaa

SEQ ID NO: 9781 - protein, 146 aa, Zea mays
  misc_feature: Ceres CLONE 448969
  misc_feature (5)..(71): Pfam Name: LSM Pfam Description: LSM domain
MLPLSLLKTAQGHPMLVELKNGETYNGHLVNCDTWMNIHLREVICTSKDGDKFWRMPECYIRGNTIKYLRVPDEVIDKVQEETSKSRSDRKPPGVGRGRGRGDVGSKPGSRGIGRGQDDGGRGSGGRGRGGVGAKGGNKGGGRGRG

SEQ ID NO: 9782 - DNA, 1882 bp, Zea mays
  misc_feature: Ceres CLONE 448996
  misc_feature: Encodes the peptide sequence at SEQ ID NO. 9783
gatcagatactagtaccattctgctttcctcaccacggaagagtaaaacagtcatttcagagctggtaccagtggcgtgctattttaacgactggttcccgctcgtccgtcggcgagcgccacccacacgccacgcccgagagcgcccgcgaaaatgacgccgccggcgagcacatcaggcaaacgcgccgtcgcgatagacgagccgctgctgccggagtcctcggcgggtgggcggcacggcggcggggcgtcggtctcgggcgccgtgttcaacgtgtcgacgagcatcgtcggcgccggcatcatgtcgatcccggcagcgatgcgggtgctcggggtggtccccgcggcgctcctcatcgccgccgtcgccgcgctcgccgacgtctccgtggagttcatgctgcggtacacggggcgggggtggggcggcggcggcaaggacgaggcggccacgtcgtacgcggggaccatgggcgacgccttcggccgcgccggcgccgcattgctcaacgtcttcgtcgccctcaccaccacgggcacgctcgtcgtctacctcatcatcatcggggacgtgatgtctgggagcgtcggcggaggcgacgagcacgccggggtgctgcaggagctgttcggcgcgcgatggtggacggggagggagttcgtgctgctcgtcaccgccgtcttcgttctgctgccgctcgtgctccgccgccgtgtcgattcgctgagattcacgtcggccatttccatcctactggcggtagtgttcatgctcatcagctcggggatcgcgctatacgctctcttcaagggcacagcgaccatgccgcggatgtttcctgacttctccagactctcctcgccgttcgagctcttcaccgccgtccccgtcatcgtcgtcgccttcaccttccacttcaacgtgcacccgatccgcgcggagctgagcaagacgtcggacatgaaggtggcagtgcgcgtctcgctcgtgctctgcgcggccatctacgccgccgtgggcttcttcggcttcctcctcttcggggacgccaccatggccgacgtcctcgccaacttcgaccgcagctctggggccggtgtcccgcaggcgctcaacgacgcggcgcgcctcagctacgcgctgcacctcgtgctcgtgttcccgctcctcctcttctcgctccgggtcaacgtcgacgagctcctcttcccgggccgccggccgctcgccgcggacacgcgccggttcgtgtccctgacagccgtgctcatggcggtgctctacgtcctggccatcgcaatccccagcatctggacgctcttcgagtactccgggtccacgttcgcggtcaccatctcgttgatcttccctggcgccatagttctgagggatgttcatggaatagcgaagcgtaaggacaaggtattggcggcaacgatgatcgttctggcagtggtcacgagcagcatcgccattgcctcgaacatcatgagctccatcagtgacgaagacagaggaggtcatgtagctggcagacgataatggctcagatcgaatcgaattaaaatgtggtttccaggccaaccgcgcgtgaagattgctgctcgtgtcatgcgttcctcctgggtattctttctttgcagcgagattgcttcggcccctgagatgcaagtttagtctgtgccccctcatggtgtagatgtttgtgattgagaggagatacgttggtacatggtaaggaaattgccagttggccaatgttgtatacttgtctcggcgatacatacggtgtaaaatagaaaacggtcgtcctttctttttcaggggtttataaaccgtaccaaataattgcaggccaaaaaaaaaaaaaaaaaa

SEQ ID NO: 9783 - protein, 464 aa, Zea mays
  misc_feature: Ceres CLONE 448996
  misc_feature (31)..(451): Pfam Name: Aa_trans Pfam Description: Transmembrane amino acid transporter protein
MTPPASTSGKRAVAIDEPLLPESSAGGRHGGGASVSGAVFNVSTSIVGAGIMSIPAAMRVLGVVPAALLIAAVAALADVSVEFMLRYTGRGWGGGGKDEAATSYAGTMGDAFGRAGAALLNVFVALTTTGTLVVYLIIIGDVMSGSVGGGDEHAGVLQELFGARWWTGREFVLLVTAVFVLLPLVLRRRVDSLRFTSAISILLAVVFMLISSGIALYALFKGTATMPRMFPDFSRLSSPFELFTAVPVIVVAFTFHFNVHPIRAELSKTSDMKVAVRVSLVLCAAIYAAVGFFGFLLFGDATMADVLANFDRSSGAGVPQALNDAARLSYALHLVLVFPLLLFSLRVNVDELLFPGRRPLAADTRRFVSLTAVLMAVLYVLAIAIPSIWTLFEYSGSTFAVTISLIFPGAIVLRDVHGIAKRKDKVLAATMIVLAVVTSSIAIASNIMSSISDEDRGGHVAGRR

SEQ ID NO: 9784 - DNA, 734 bp, Zea mays
  misc_feature: Ceres CLONE 449016-R
  misc_feature: Pfam Name: Lung_7-TM_R Pfam Description: Lung seven transmembrane receptor
  misc_feature (31)..(31): n is a, c, t, g, unknown, or other
gagtgtttctccccgccccggggggggcccncatttcctttcaccccccgcccccacttatcccacagaatgcgtaagggccccccctcgaggtcgacggcatcgataagcttttttttttttttttttgcgaaaacatatcaggttgtttgtaccactcgctaacccatccacaactgggagaacatgcatgcatgtctcatcacatctcatataatctaccgaaaatgtctcgtcagatctcaaatgagctctccatctcaagctgcccacccgccgcttcctcctcattgacacccacgtacaggtaagggttttcctccaaggggtggaagttatagaacacgaacacatagaacgcacggctggtcatctcgatggagacattgacggcccactggtacttgtagctgagcaacgcggtccacgccgacgtgttttttacccatgaagtagaggcaccacactatctttaccccacaaatgcttgaagagcgtgagcttctggaggttccaagcctgccttgccgtcccgccctggacacctcccgcaggctgcgcgatggaccatatagatgggggaagaacccccgcgcaacagccccatgacgctcccccacccaggaaagatcctgggtcccaacgcccaaccatgtcccctccccacgccagcacccgatcttccccctattaaccaccccaaccacggtgattccctcgactcccccctgccc

SEQ ID NO: 9785 - DNA, 622 bp, Zea mays
  misc_feature: Ceres CLONE 449075-R
cgattgggtaccgggccccccctcgaggtcgacggtatcgataagcttttttttttttttttttagggatcatttaatatggcacccacatacagtgacgacacactgagctctcatgatagctcacagaatcataatacacagaaaagccatcatacacaacattctcatcacaagtcatacacaagtccaacacactagttcttccacaacagaggttcaaacatacaaaggttccaccacaaaggtttgaagcattcaaacagacaccaatgtttggaaggaaggtggatgagcgactgatctggctgagactatcagcaacaatcttggagggtgacttttgtgcttctccttcttctagctctctttccttctctgcaaccatttgctatatatctcatttgcaagcggagtacgaccattttggggactattcatacattccccaaagaaatcaacagcatccggctccatgttgttgtacttagtcctcgatgatccaagttcaccattgggtaacatctgtttctttccattctgatcagaagactttgaaccctttgggtcaccctacaagatgttgggaaaaaagtgcatatttcagtcaaccatggtacag

SEQ ID NO: 9786 - DNA, 621 bp, Zea mays
  misc_feature: Ceres CLONE 449232-R
  misc_feature: Encodes the peptide sequence at SEQ ID NO. 9787
  misc_feature (15)..(15): n is a, c, t, g, unknown, or other
  misc_feature (24)..(24): n is a, c, t, g, unknown, or other
aaaaaaaaaaaaacngccaaaaancaaaaaaaaaaaaaaaaaaaaaaaaaacagaaatatcgattgggtacgggccccccctcgaggtcgacggtatcgataagcttttttttttttttttttggaaaatcatctttcttggcgcagctacaacctgttggtctctttggttacacaggaatgatatcatatttgaaaagaaaaacaattcttctcccttgcaggtcatttattccatagcccatgttcgaagacaatgtgcaatggaataaatgaccagggataacaccagcagcaacaataggaactgcctgttgtgtaagtgcttggtcaaaaccactcacacgcttgctcttccatctacagagtgaatgacaactaaatctgcgatcaagatcacgacccttaaaaggggaacggaagagatgcctacaatgaacatatctgtaaaaatatcttctcatctcaaaatcatgactactgaaaccgacggcgatatcacaacgatcacaaagcgcaccttatatcaatgaaataacaccaatccctgagaagaaaaatacaagaacctgaaactaaagcacaatcaccaagcatgaaactgaataaaaaaaaacccag

SEQ ID NO: 9787 - protein, 89 aa, Zea mays
  misc_feature: Ceres CLONE 449232-R
  misc_feature (5)..(5): Xaa is any aa, unknown, or other
  misc_feature (8)..(8): Xaa is any aa, unknown, or other
KKKNXQKXKKKKKKKKTEISIGYGPPLEVDGIDKLFFFFFWKIIFLGAATTCWSLWLHRNDIIFEKKNNSSPLQVIYSIAHVRRQCAME

SEQ ID NO: 9788 - DNA, 656 bp, Zea mays
  misc_feature: Ceres CLONE 449279-R
ccgattgggtaccgggccccccctcgaggtcgacggtatcgatatttttttttttgttttttgctttaaaacatatatctacaaatcctttaacgtaaaatccaaaacaaatccaataacttcaactcaaagtattaaacattaagcataattgaaaatgatcctatgacttcaagtatagagctactgtaactagccactatagcagccataaggctacaggtcttatagtggtcaaccagacttaagatggaggcacttggcctcgattgtagcttaatagttgacgaaggaggttgttatttcatccatcgacctcttcatactatcaatggtctcctgagatgctggttcttgagccttcaaggtttccacttcttcccgaaggccatctttttcttgcttctcggtctccagtttatcacgaagttgttgaacgtttgcataaactttcattgtggagcttttcttggaggtggactgaagatgaacattgcgtaggaacacactagagctcgatagcacattagaaacaacttctacaggagattttggttgttgtccatcctgaactggtgctgctaccatttcttccatgtcaacctaatttaaaatttaaaggttattcatcagtatagtataccacaagttgcaag

SEQ ID NO: 9789 - DNA, 900 bp, Zea mays
  misc_feature: Ceres CLONE 449350-R
aaaaacaattgggtaccgggccccccctcgaggtcgacggtatcgataagcttttttttttttttttttaagggatcctcggctccggaacccagacgacggaagagcattcacatcgccttctcattctcattctcatctcatctgccgacggacacggatggaatcgatggacggagcgagagcaacacacacacacacacacgagaggagccaacaacaacaacaagaagaagctacaggcaaccacacccagccaggccttggtcagcgcgcgcgctacagctacaggcatgcagtcggcgcccgcccgcccgccggccggccgccgatcagttggggccccagcacacgaggtggtaggccttgcgcatcctgtccgcgtcccgcggcgccggcgggggcggtggccgcgacgcccgcgggggcgcgtccgccggcacggacacggagtccgagagcgcggcggacagcgcgcggattcggggcgctgcggcggcgcggtggtagaacaagcgcaacccgtagtccccgcggcacaggcccgcctgggccctttgagggccttcaccgcggcccaatgctcgccgcccaccacaaggcgaacggcgccctttcccatctggccctgggtggaatttttgaaggtttgcccggggtaaccccccgggttaccaaacccggctttcccaaaactgtccccgggggcaacccccgtgtggcgggccttctcagggggctccctccacctggaaacccccgggcaaacaagggcggtcccccgcaaacggtttcgggtaaaacggcccccctgtcaaaaaccccttgtgagctacagacttaacaaacaaaatgccccctccaccggcagggcctctttcctttatggccggggaccag

SEQ ID NO: 9790 - DNA, 1541 bp, Zea mays
  misc_feature: Ceres CLONE 449481
  misc_feature: Encodes the peptide sequence at SEQ ID NO. 9791
atcacttgtttatgctcgcgcccgggggggctggctggcggatacttgcagttttatactccaggcgtacgctacgcggttgggccgcgggcgtccagttctctgccttctccgatccaccgatcgaattccagttccaggcggccgatggcattgaggcggcggctgttgctgctggtggtggtcgtggcggccgccgtcgctcgctgccgggcggacgaccccgcggtgagcatgctgctgccgggactcccggtcgccggcctcgccgtggggttctacaacgagaagtgcccgcaggcggaggacctggtgctcgccgagatgcggaccctcgtcgacaaagacgagaccatcggcccggcgctgctgcgcttcatgttccacgactgcctcgtccggggctgcgacgcgtcgatcatgctcgtctcgcggaacgggactgcggagagggacgccttcccgagctacggcctccggggctacgccgagatcgagcacatcaaggccaagctggaggacgcgtgcccgctgaccgtgtcgtgcgcggacatcatcgtcatggcggcccgggacgccgtgtacctgagcaacgggccgcggtacgccgtggagaccggccggcgcgacggcaaggtgtcggcggagtacgacgccgacaacgacctcccgccgccctcctccaaaatcgtcgacctcaagacctacttcagcttcaaggggttgggctggaaggacctcgtcgtgctgtcaggaagccacacgatcgggagggcgcagtgcgccacgttcgcgtcggaccggctgtacaactacagcggccacgtggggcaggacccgtcgctgaacaaggcgtacgcggcgcagctgcgggagatgtgcgagccggggctcgccgacgacaccaccatggtggagatggacccgcgcagcccctacaccttcgacctcagctactaccgcaacgtgcgcgccaaccggggcctcttcacctcggaccaggccctcctcgacgacccgtggaccagcgcgtacgtcgagcgcatggccgacgcggcgtcccccgacgagttcttcgccgactacgcggccgccatcaccaacatgggccgcatcgaggtgctcacgggcgacaacggcgagatcaggagcgcctgcgccgcgtacgttgactagaaattattactaaccgatcgagcaataggatagccagcgagtggttggattggctgctgccttgctgctgctgggcggtgccgttgttgacctggtcttgtcgtgcgagcgagtgcaattggtggatgtatggatcgtcagccgtcgcgtcatgtggccacgacaacgtgggagccaaccaggatgcagtttgcggtattctcttctctccgccgtttgggctggggtccatctgttttgttctttacgttgcgcctccattgttttgctgaggtgtgtgtgaagagacggacggtatggttgctcattcacacgacaaccacacaatggcaggatttttttttgtcaaaaaaaaaaaaaaaaaa

SEQ ID NO: 9791 - protein, 342 aa, Zea mays
  misc_feature: Ceres CLONE 449481
  misc_feature (56)..(303): Pfam Name: peroxidase Pfam Description: Peroxidase
  misc_feature: SWISSPROT Homolog: EC 1.11.1.7 Peroxidase
MALRRRLLLLVVVVAAAVARCRADDPAVSMLLPGLPVAGLAVGFYNEKCPQAEDLVLAEMRTLVDKDETIGPALLRFMFHDCLVRGCDASIMLVSRNGTAERDAFPSYGLRGYAEIEHIKAKLEDACPLTVSCADIIVMAARDAVYLSNGPRYAVETGRRDGKVSAEYDADNDLPPPSSKIVDLKTYFSFKGLGWKDLVVLSGSHTIGRAQCATFASDRLYNYSGHVGQDPSLNKAYAAQLREMCEPGLADDTTMVEMDPRSPYTFDLSYYRNVRANRGLFTSDQALLDDPWTSAYVERMADAASPDEFFADYAAAITNMGRIEVLTGDNGEIRSACAAYVD

SEQ ID NO: 9792 - DNA, 1147 bp, Zea mays
  misc_feature: Ceres CLONE 449633
  misc_feature: Encodes the peptide sequence at SEQ ID NO. 9793
aatcggacggtcggaccaggggatagggttccgccgcgcctctccaaccaggcgccactcgccagggcctaggctggtcatggaaggaaacgccgcagccgggaagaggtcccggacggagacggcgaacggggctgccggcggcgggaagcgctccaaagacatggagtcatttcaaactggtctatcaagcaaatcgaagccttgcaacaagtttttcagtacgattgggtgcccgtttggtgagggatgtcgttttctgcactttgtccctggcggttacccggcagttgcaaaaatgctcaatctaggtagccctgctgtatctgcgccatcaagaactcatgtggatcacgccgctcttactggcgcctctcattcagcttcgtcaggcaagacacgcatgtgcaccaagtacaatactacagaaggctgcagatttggtgataagtgccactttgctcatagcgaaagagaacttgggaaaccagcgtacatgccttatggagaacctcctatgggcggtcgatttggaggccgacctgaacctgtgcagccagctgccatgggccctccagcaggaaactttggtgcctcggcgactgccaagatcagtgtggatgcgtctcttgccggtggcataattggtaagggcggggtcaacactaagcagataagcagagttacaggcgtcaagctctgtatccgcgaccacgagtctagccccaacctgaagaacattgagctggaaggcaattttgaccagatcaagcaagccggcgaaatggtgagggacctcatcgcgaccatcagcacgagcatgctggcgaaaaactcatctgctgccgtggctccatctggaggccgaggcggtggtctgggtggcaagagcaactacaagacgaagctatgcgagaacttcgtgaagggtgcttgtactttcggcgagcggtgccactttgcccatggcgagaacgagcagcggagaggtgctgtttgagagttgaggtgccaactccaggcatgacatgtcctgtgctctccatttgcttctctgaatttcctccttgtagcgttagacggttagactgtcgtattgctatttcaatggtttcaactgagttcagctttaaaaaaaaaaaaaaaa

SEQ ID NO: 9793 - protein, 306 aa, Zea mays
  misc_feature: Ceres CLONE 449633
  misc_feature (105)..(131): Pfam Name: zf-CCCH Pfam Description: Zinc finger C-x8-C-x5-C-x3-H type (and similar)
  misc_feature (38)..(64): Pfam Name: zf-CCCH Pfam Description: Zinc finger C-x8-C-x5-C-x3-H type (and similar)
  misc_feature (273)..(298): Pfam Name: zf-CCCH Pfam Description: Zinc finger C-x8-C-x5-C-x3-H type (and similar)
  misc_feature (175)..(237): Pfam Name: KH_1 Pfam Description: KH domain
MEGNAAAGKRSRTETANGAAGGGKRSKDMESFQTGLSSKSKPCNKFFSTIGCPFGEGCRFLHFVPGGYPAVAKMLNLGSPAVSAPSRTHVDHAALTGASHSASSGKTRMCTKYNTTEGCRFGDKCHFAHSERELGKPAYMPYGEPPMGGRFGGRPEPVQPAAMGPPAGNFGASATAKISVDASLAGGIIGKGGVNTKQISRVTGVKLCIRDHESSPNLKNIELEGNFDQIKQAGEMVRDLIATISTSMLAKNSSAAVAPSGGRGGGLGGKSNYKTKLCENFVKGACTFGERCHFAHGENEQRRGAV

SEQ ID NO: 9794 - DNA, 660 bp, Zea mays
  misc_feature: Ceres CLONE 449739-R
cgattgggtaccgggccccccctcgaggtcgacggtatcgataagcttttttttttttttttttgctcaataatgatcgaaacttggaatagattgaagagaaacctcatcgtatggtacaacggtctgtaccaaagcatgtatgaaagaggacactcgaatattgtgtagattacaatgatgaaccatttgctatttgttaagagagtagagagagtcagagtccgatgacgaaccagacctgcgaacggggctgtcgtggatgactccagcttcttgtaggcagaaccgtctgagctcagggcatcgatcagcacaggcgtgttccagtcggcctccaaccaagtcataatgtgcataatgtgggccttgtggctttccaaacactctatagtccaccttgtgattcggaatgagtttcacagtttcataaacagcatctggagggcagattaggtctttatctccagccaatgcaaggacatgagtctgacactcacgcaaatgatccttgtatgagaaggttccatttcggttgcacagcccaccttccctgaaagcggttgtaagttgcagaacaacctttgcaggtattgtacaaaagttgtttgaaacaagcttagccagcaactccggatgcatcatgtcctgagctgatat

SEQ ID NO: 9795 - DNA, 650 bp, Zea mays
  misc_feature: Ceres CLONE 449981-R
cgattggggaccgggccccccctcgaggtcgacggtatcgataagcttatttttttttttttttgttccaccaaatgattttttttcctttcacaactcacaacagctattgtataacacataactcacagcagctttttcaaaacaaaaaaaaggcacagctcaacccttaatacagagatacttgtgctccaagttcagttcgccgtactcttggtagcctgtatgaaaatgttactagcaaaccactacaaaagttacacaaagggctcgtggcagcttcagcttctgcttggtccggttctgtcaccaaggatcatctccgggtcgagggttgacagaatctggggcattgacataccaccagacacaacgatttcgatgccttcacgcacggaaaggtttggccttatgacatcctttgaattcaccatgaagatatcgccaatgtaaagatggttcgttgggacatagacacagtaaagatcttcttgaccggaataactgatgtgatgaaaccaaacgcatattctccaacacgaggatgccttatgatgaccgcttccttgaatgcctgtttgttctgatctggtgatattgcagcactaatttgcttcgatgcattgtagatatgacgaacaaggggcatg

SEQ ID NO: 9796 - DNA, 1669 bp, Zea mays
  misc_feature: Ceres CLONE 450874
  misc_feature: Encodes the peptide sequence at SEQ ID NO. 9797
accagcctctccactgcgctctgcgctccaggcccctctctggcctctgcgaaatgccgctcttcccctccaccgccgtggcgctgccccgcctcagcatcccattcccattccctctccaccacagccccatcccccttcccctcctgctccgccgccaccactcctcgccccacccgcgccttctccccttggcggcgtccctcccgcccccacctcccgaggagctgctccacagtcaggccacgggtctcgtcgctgcctcacaggccaacttcatgcgcgtcatcgtggacgccacggccccggggctggaccaccaccgcggctccgacctgctctgcgtcgtccgcgcgctgctcaagaagatccgccgccgcgtgctcgtcggtgaccgcgtcctcgtcggggcggtcgactggaccgatcgccgcgggatgatcgaggatgtcttcgagcggagatccgaggttgtcgacccgcctgtcgccaacgtcgaccgccttgtcgtgctcttctcgctcgaccagccgaagcccgagccggccacgctcacccggttcctcgtcgaggccgagtcttcaggaattccgtttgtgctcgtcttcaacaaggtcgagctcgtcgacgagcagacaatagcatactgggaagataggttgaggagttggggctatgatccactgtttctaagtgttgataagcaatcaggatttactgctcttgaagagatgttggaaggacaaacaactgtagttgttggtccaagcggcgttgggaagtccagcctgatcaatgcactgaggtgtaaccaggacatatcagaagaagatccaatacataaactagttgaacagaatagtaaatggtttggtgaacagcgtgttggaactgtgtccaagaaaagtggtaaaggaaagcacacaacacgccatgtctcgttgcttcctatagctagcggaggcttccttgctgatactcctggatttaaccagcctagtttgatgaaagtgacaaaaaagagtcttgcagaaacatttcctgagataagaaaagcgctgaaagagaacgagcccaaaaaatgcttatttaatgattgtgttcacctgggtgagcatggatgtgctgtgaagggggactgggaaaggtatccatactatctccagatgcttgatgagatcaaaattagagaagaaatccagctacggacatttggaacaaaaagagaaggtgatgtcaggtacaaaacaggtgtcatcggggtgaagcaagcagagcctcgtcttgaactcaagaagcacaggagggtgtctagaaagaagattaaccaatcgattcttgacgaaatcgaagatgatgttgatgacctcgatgatgactaccagtttgacgtcaagcagcgttctaggaaatgataatcttttttcatctgatgatctaacggcatgaaggaacctttgggtgctgtacacagttggttttgtagtgccaccaccatgcccttgagcagtatgctgatcactgtaagtagaagcgtaatggccggaacccagggtgtcttgacgttgctccagacgtttttctttgcggtagaacgttaagggcatgtttggaaacataatttttttagtatcaagataataacgtgatgccaaaaaaaaaaaaaaaa

SEQ ID NO: 9797 - protein, 453 aa, Zea mays
  misc_feature: Ceres CLONE 450874
  misc_feature (65)..(374): Pfam Name: DUF258 Pfam Description: Protein of unknown function, DUF258
MPLFPSTAVALPRLSIPFPFPLHHSPIPLPLLLRRHHSSPHPRLLPLAASLPPPPPEELLHSQATGLVAASQANFMRVIVDATAPGLDHHRGSDLLCVVRALLKKIRRRVLVGDRVLVGAVDWTDRRGMIEDVFERRSEVVDPPVANVDRLVVLFSLDQPKPEPATLTRFLVEAESSGIPFVLVFNKVELVDEQTIAYWEDRLRSWGYDPLFLSVDKQSGFTALEEMLEGQTTVVVGPSGVGKSSLINALRCNQDISEEDPIHKLVEQNSKWFGEQRVGTVSKKSGKGKHTTRHVSLLPIASGGFLADTPGFNQPSLMKVTKKSLAETFPEIRKALKENEPKKCLFNDCVHLGEHGCAVKGDWERYPYYLQMLDEIKIREEIQLRTFGTKREGDVRYKTGVIGVKQAEPRLELKKHRRVSRKKINQSILDEIEDDVDDLDDDYQFDVKQRSRK

SEQ ID NO: 9798 - DNA, 738 bp, Zea mays
  misc_feature: Ceres CLONE 450919-R
  misc_feature (21)..(21): n is a, c, t, g, unknown, or other
ttgttttttctttgttggttntagccctccccacaaacaaatattatataatttcaattgggtacgggccccccctcgaggtcgacggtatcgatattctttttttttttttttggtttaacttatattcatttattagagaaatctctttatgtacaaaagatgctgagaggccaccaaacaagcattgaatctgaagctagaaagttcactcaattcgaaggcacaacatttttgctgcaacatggccgttcgaggtggccgatgcaacacatgctttgcacaatgtcctcgagtttccacctgttatgcactccagaggcgggactgtgaccctgtcgatgatgtattctattagtttagctcgcggtgaggtgataggagattccggcggtgccaccgcaaattgtgttgttcttccgttccgatgcagaatgatcgccacttccgttggcaacaccatggcttcttcctgtctttgtctttgacgctgctggatactaatagcccaagccataatataacatggccagcaaaaatccagctgctcccacaacaaattagcgagaaaatagcaacatgcatacatcttcatcatcacctgttaatcaatcggtcatgtgtatgccctcaagagtctaatagggccatctataattccaaaaatatagcagcaggactaaatgtccaacacctcaatgttagctcttggttgcgtactactattccctccacaag

SEQ ID NO: 9799 - DNA, 877 bp, Zea mays
  misc_feature: Ceres CLONE 451712-R
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (77)..(77): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (760)..(760): n is a, c, t, g, unknown, or other
aggagcacgcgtggggtgtaggcgcgaggggggagggagcgcttctaactcagagagaggatattattnnnnttttntnnnnnnntctattgggtaccgggccccccctcgaggtcgacggtatcgataagcttttttttttttttttttatttctcaaacttccgaactagcctttacattcttttaggagtcgcagatccttaaagttaacactctttgtgttcataactataaatgctaagcagttttatcatataaccgcgctcgcgtggctcagagcatatatgtaggataacactaaagttccaatcttcgtcctgattagtggtactgcgctcttcaaacagaactgaagtttctcgttgtcttcgtccacgatcgggaagaggtggcctcgccattatcctctgtcgaagctccccgtatccgatctcgccgtttcattctctctgcatacacgttgatgtcaaagtcggccgtgtttcttcctccaaatatatgctccagcttgttcgaggtcgaacatgtccgcccaagtatcttccgggttctccgaaactgtcggttgtacacaaaattttcacttttttccgtccatttggttgggccccaagggaaaggggtttccattaatccttcccaaaagagggattccaaaaaattttgggggaagcgtttgggttttagaaataacccaaactggggttattaaaatccccggggaataaatatatgggtggggaaattttgtggggccnaggcggatgttgggcggggggtctaaaaagaaaaaaagggggggggggggctttgggaaaatttgtggaaccacagacccctttgtggaaaatgccgcgagaggaatgcccacaaaa

SEQ ID NO: 9800 - DNA, 1347 bp, Zea mays
  misc_feature: Ceres CLONE 451962
  misc_feature: Encodes the peptide sequence at SEQ ID NO. 9801
agctgcatgacgatgacgtccgcacgcctcttcacctgctgctgctccagggaccggccgtctccgacgacgagaatgcgcgcgtcctcctcctcgtccttgctgctgctgttggcggcggcggccgtgggcgtgctgctgcaggccaggccgtcggagtgcgcgcgcgccttcttcgtgttcggcgactcgctggtggacaacggcaacaacaactacctcatgaccacggcgcgcgccgactcgccgccgtacgggatcgactacccgacgcaccgccccaccggccgcttctccaacggcaagaacatccccgacatcatcagcgagcacctcggcgccgagcccacgctgccgtacctgagccccgagctccgcggccagaagctgctggtcggcgccaacttcgcgtcggccggcgtcgggatcctcaacgacaccggcttccagttcgtggacatcatccggatgagccgccagctgcactacttcggcgagtaccagggcaagctgagcgcgctggtgggcgcggcgcgggcgcgccagctcgtgcgccgctcgctcgtgctcatcacgctcggcggcaacgacttcgtcaacaactactacctcgtccccttctccctgcgctcccgccagttcgcgctgccggaatacgtcggctacatcgtctccgagtacaagaagatcctcatccgcctgtacgccatgggttgccgccgcgtgctggtgacgggcacggggcctctggggtgcgcgccggcgatccttgcgcagcgcagccgcaacggcgagtgcgcggcggagcttatgcgcgcggcggcgctcttcaacccgcagctggcgcgcgtcctggaccagctcaacgcgcgcttcggcgccggcaccttcatcgcggccaacgccttccgcgtccacttcgacttcgtcagcgacccggccgccttcggcttcgccacggccaaggacgcgtgctgcggacagggcccccacaacggcctgggcctctgcaccccgctctccaacctgtgcgccgaccgcagcaagtacgtcttctgggacgcctaccaccccacggagcgcgccaaccgggtcatcgtcagccagttcatgtcaggctcgctcgactacgtcagccccatgaacctcagcaccgtcttgcaaatggacgccgcatttgactagatcgagtactgactcatcgtcccgagagacccaaccaacaagcctgctgtcgtctacctcgtttcgttttatatctctgtgactgccgtgcgtgtgtctgtgtacgatcacataaacaacatcaacatgtatttatatttatagtcaaaaaaaaaaaaaaaa

SEQ ID NO: 9801 - protein, 392 aa, Zea mays
  misc_feature: Ceres CLONE 451962
  misc_feature (56)..(368): Pfam Name: Lipase_GDSL Pfam Description: GDSL-like Lipase/Acylhydrolase
  misc_feature: SWISSPROT Homolog: EC 3.2.1.51 Alpha-L-fucosidase
MTMTSARLFTCCCSRDRPSPTTRMRASSSSSLLLLLAAAAVGVLLQARPSECARAFFVFGDSLVDNGNNNYLMTTARADSPPYGIDYPTHRPTGRFSNGKNIPDIISEHLGAEPTLPYLSPELRGQKLLVGANFASAGVGILNDTGFQFVDIIRMSRQLHYFGEYQGKLSALVGAARARQLVRRSLVLITLGGNDFVNNYYLVPFSLRSRQFALPEYVGYIVSEYKKILIRLYAMGCRRVLVTGTGPLGCAPAILAQRSRNGECAAELMRAAALFNPQLARVLDQLNARFGAGTFIAANAFRVHFDFVSDPAAFGFATAKDACCGQGPHNGLGLCTPLSNLCADRSKYVFWDAYHPTERANRVIVSQFMSGSLDYVSPMNLSTVLQMDAAFD

SEQ ID NO: 9802 - DNA, 711 bp, Zea mays
  misc_feature: Ceres CLONE 452255-R
  misc_feature: Translation starting site: 276
  misc_feature (14)..(14): n is a, c, t, g, unknown, or other
  misc_feature (21)..(21): n is a, c, t, g, unknown, or other
  misc_feature (34)..(34): n is a, c, t, g, unknown, or other
  misc_feature (40)..(40): n is a, c, t, g, unknown, or other
  misc_feature (48)..(48): n is a, c, t, g, unknown, or other
  misc_feature (51)..(51): n is a, c, t, g, unknown, or other
  misc_feature (55)..(55): n is a, c, t, g, unknown, or other
tgtgttgggggggngcggccncccgccacccccnccctcnccttatangtnaatntaacgattgtgtaccgggccccccctcgaggtcgacggtatcgataagcttttttttttttttttttcgcaaagcccctcttatttccaatttctcagacattaacttacatacacgcctttgttcttaccaagccaatgtaggagtcgtcgtacagcataattatgtagtagtaatatgtaacattcagttccacgactaatttcttctaataaattgcatgcagattggagcaagcgagcaatctatgtacctagttaggcttgaagaacttgagcttcatcccattgttaactatgctccagacgccacccagcgagaacgccagagtgaacgctgtgcccagcagaccaaggccccagttgaggtaccagatgaagctgaacctctcggggttcccgacgcagatccccatcacgaacgggtaggggaaggtcaccggcagggtgagcccgcccagcagcccggctaggctggagagaaatggcagggccacactgatgaacagcgagaggaacccgtagaagaccctgaaccctgaccgtacccatgccgagtacgggcggttggtgcggccggtgtagtaggcctcaaagctgtcaaacaccggtatggagtaaatttggaagctgctgaggcagttgagcaccacgaca

SEQ ID NO: 9803 - DNA, 1466 bp, Zea mays
  misc_feature: Ceres CLONE 452515
  misc_feature: Encodes the peptide sequence at SEQ ID NO. 9804
taaggatctgtcttacttatgcagtctagtttaattaattgaattaatttattgttattttttggtaaattccgaatcctaaaattcggtataaattctgataattgcttccgttttagattcgaaaaagtataatctgtggcgcccaacggtactcatactcagcgcccccagaccgcgaggagttgtcggcggcggccacgagtggcgtgcatattgcagtgacgtcccgaaggattcatcactccacaaccgttgtgtccgaggcttcgacagcggaggccgtaacgatgcaatcggaagcgccgatatcggactattgtgttctccagttcgacctcgaagattcggagacaaagaacatcgccatcgggcactctatcagctacgatgatatctccttagggggacacctctgggggattaactgctaccctcgtggggatagggaagaggaaaagggctagtacttttccttattcctctaccttattggcgactcaaaaggcaaaggcgtcaatgtcatcttccatgttttttgtctggaaagagaaggcgaagcatctgccttctccagtttctccgatgataagaggctagccaaagtgttctcaagtaaatgccccgaataccctgaaggccaccgaagccatgggtggcataagtttatgaagcgaagcgttcttgagtcattctttatagtaaatggtagggtgacgcttatatgtaccatcatggttctgggtgccggcaccattccagtgccaccctccaacataagttctgatcttggttgtctgctcaaatccaatgtcggtacagatgtttcattcattcttaaaggcaagatgatccaggctcaccgtgctgttctcgctgcccgctcgccagtcttcaaagctcagctatttggcaacatggccgacgccacagcgtcatccatcacactgcaggacatggagccagcaacttttgaagctatgcttgccttcatgtacacagatgagatgcctgaagataacgagcttggaggctctcccactcaaatggtgcagcatctgcttgctgcggctgaccgctatgcattggacagactgaaactgatgtgtgctcggaagctatgggacattatttcgatggatacatttgcttctactctagcctgcgcctatatgcacagctgtgcagagctgaagagcaagtgcattggcttctttgccgtggagaataatttcaagaagatagtgttcacagctggtttcatatggttggtgcaggaatttcccgatcttgctgatgagctgaaagagacaattgggatatagtacaacatgctgaaacctctacgtgtatatagtctacgtattcaaccgtggattcactgtgtgccattttggaactatgtatggttgatcttgttaccatatttcttgaattgctgatcttataaaaaaaaaaaaaaaaaa

SEQ ID NO: 9804 - protein, 218 aa, Zea mays
  misc_feature: Ceres CLONE 452515
  misc_feature (41)..(155): Pfam Name: BTB Pfam Description: BTB/POZ domain
MKRSVLESFFIVNGRVTLICTIMVLGAGTIPVPPSNISSDLGCLLKSNVGTDVSFILKGKMIQAHRAVLAARSPVFKAQLFGNMADATASSITLQDMEPATFEAMLAFMYTDEMPEDNELGGSPTQMVQHLLAAADRYALDRLKLMCARKLWDIISMDTFASTLACAYMHSCAELKSKCIGFFAVENNFKKIVFTAGFIWLVQEFPDLADELKETIGI

SEQ ID NO: 9805 - DNA, 654 bp, Zea mays
  misc_feature: Ceres CLONE 452517-R
caattgggaccgggccccccctcgaggtcgacggtatcgataagcttttttttttttttttttactgactaagttaaattaatgcttaatatacatggtatatttgctccagttgttaccctgatacaacaaatagtcatattacatacaaatgacgcatagacattcagaccattcggtagagtaacattagcaataaaccttcacatgtctatagcaggggtgttgttcttcgcatgattctttactacacaaatggtataagaaaatactcggcgtagaataacttccaaatgaacatataaaattgtgtgatacaatccttattctcaatgtcaaattgttgtgctctttgccagagtgtggaggcaagcaagccatgaccagacacaatgacaatcttctgatacaagtttgtagatgatgctcctaccaaaattgcggttgcatatgctgtcatgagaatattaatgcagagcctatgcactctctgttggcctaatcgtacagtcatggactgaatgccgaaatctctatctccatcgacatcaggaatatccttgaatagcgctattactgcagcaaagcaacacatgaaacatgttgcaaagaccaccgaccttgtaggtgccaagagcctctttagaacgtgtt

SEQ ID NO: 9806 - DNA, 648 bp, Zea mays
  misc_feature: Ceres CLONE 452626-R
cgattgggtaccgggccccccctcgaggtcgacggtctcgataagcttttttttttttttttttaaaaaatcatatacacaagtagcactggtagatgcagcattgaatcacgttcagcaaacacgacctagcacgcagctggagatcagttaaaagtgcatgtcgtgcttgtacttgtaagtggagctgcaattttcgtgtcaccaactgattgcaacgcaagttagtgcaggttgtcatgtatctgccaataatgcgcaagttctgaatgcaatctacaaattgattgtctcaagctccatgccccagctttgaatccataaccaacaagcaatcctgaaacacccatcactttcatgcatgcctcatactgtcctcactctgtctaaacggacgttctggctcttccgaggtgttggttccagtgacatgatcacctgcggcatagtcattcctcctgaaacaattatttctatgccttcacgaatagacaaattgggccttataatttcggcggagtttaccaaaaatatgtcaccaatatataaatgattggttggcacataaacactacacaattcttcatcacctttgtctgtctgaagaaccatggttgatgttatgaaatcaaatgcatattcaccaac

SEQ ID NO: 9807 - DNA, 1580 bp, Zea mays
  misc_feature: Ceres CLONE 453074
  misc_feature: Encodes the peptide sequence at SEQ ID NO. 9808
atccccgttcggctccctacaaggctacaactacaacctgaacccccccaccccccggcccccccctccctccgtcggcgactgggcgagcgccgccgcccttgtcttcgccggcgacgagcatcgccagggtttggttacagtgcctggaattttgcatatttacgtctgcttctgccggaacctcaatgctctatctgatgggcagaatgggcggatgggcagaatgggcgtgcaggggactcccgattgcagggcggttgcggagatgggggctgatcagaaaccacgacaaggttcgggttttctcctccagattgcgatctctagaggtggatttgcttttcctcacaatcagagatggaagccgatgatggcagccttggcattcggaactggggcttctacgacaccgtgaaaggcagcctaggcctgcagctcatgtcgtccatgccgcctgaccgggacacaaagccgctgctcccgagaggtgccttgttgcagcaacatggacatcacaatgccgcacaccagctccacacgcagcaatcacaacatcgtcgtgactatgctggcggcacagcctcgggtggcatgcccgcccagccgcactctattcatgtggacttatcgcgcaaaaaagcatggctgcaccagacgcaccaccaacatcctcgtgaccggaaggtccttcaatctcgcccgatgggacccgctggacgtgtcagacatccaggccatggtgggcatattgtgcatcaccatcctactggctatgggacgatgtcagatgcaccgcacactctccagatgatgcaaccacagattgaggcgcagctgcaagagccccctccattcaacgaagaccatgttccatctccttcggttgaggatcactctgtggttagcaccaagccgcctgtaaagaagaggtggcaggttcagcagcctaagtcactgaagcctaggaagcctaagaaggctgctgttccaccagagaatggggcacttaatgagcatgcgccccgaaggaggggacctaagaagactgtggggatggtgattaatggtattgagttggaccttgctaacataccgacaccagtgtgctcatgcaccggagctccccagcaatgctaccgatggggcgcaggtggctggcagtctgcatgctgcacaacttctatttcaacgtatccactgccaatgagcacaaagtgtcggggcgctcgaattgctggaaggaagatgagccaaggtgcattcaaaaaggtgcttgagaagcttgctggcgaagggtacaaccttgctaatccaattgacttgaagacgttttgggctaagcatggcacaaataaatttgtaacgatcaggtaaaatgacatagtatgtttctagctttgtaggttgtagagctgcagttaggcccgatttattgcttttatgtctatgtaagaatctgcagaaatttgtagtagtagtagtagcagcagcatgtagcaatgtttagttttaaatgacttagttgtaatgtctatcttgagcttcagatattgacccgaccaaaaaaaaaaaaaaaa

SEQ ID NO: 9808 - protein, 338 aa, Zea mays
  misc_feature: Ceres CLONE 453074
  misc_feature (224)..(338): Pfam Name: DUF1004 Pfam Description: GAGA binding protein-like family
MEADDGSLGIRNWGFYDTVKGSLGLQLMSSMPPDRDTKPLLPRGALLQQHGHHNAAHQLHTQQSQHRRDYAGGTASGGMPAQPHSIHVDLSRKKAWLHQTHHQHPRDRKVLQSRPMGPAGRVRHPGHGGHIVHHHPTGYGTMSDAPHTLQMMQPQIEAQLQEPPPFNEDHVPSPSVEDHSVVSTKPPVKKRWQVQQPKSLKPRKPKKAAVPPENGALNEHAPRRRGPKKTVGMVINGIELDLANIPTPVCSCTGAPQQCYRWGAGGWQSACCTTSISTYPLPMSTKCRGARIAGRKMSQGAFKKVLEKLAGEGYNLANPIDLKTFWAKHGTNKFVTIR

SEQ ID NO: 9809 - DNA, 607 bp, Zea mays
  misc_feature: Ceres CLONE 453215-R
  misc_feature: Pfam Name: Cdc6_C Pfam Description: CDC6, C terminal
cgaggtcttccctatcgataagcttttttttttttttttttactgatttagcctttaggcaagaaatgtgtaaacaaatgttcttgtatgttaaatgtttagctacatgatcaatcagttctggaagaaccaaaaattgagaaatcataacaacactcagccatctttgggagaatagtgtcacataatactataaactcgtcccacgtacttatccctgcactgcaagaaagagcttcatgatgtaaccaaggtacgtttgaccatgttgaatgaaaccacctgagcagcacatccaggggttgaaattgctggtacttgataatgtcaataaactaatactgtaatgtattacaacagtaagtgtattgatctactctctgctatgggtctagttagcatcttggctgctccagacatttttgaaagaagcgatttcccttaaaagcaaatgtgatatctgaactatcaatctgaagtgttactctcctaagcttatcttccttggactgccctagtttcatgaacccctgatcgctcaaaaccatacacatgttagaaaattcaagcattccaactgctggaacttgggttgatctacaaatct

SEQ ID NO: 9810 - DNA, 664 bp, Zea mays
  misc_feature: Ceres CLONE 453760-R
cgattgggtaccgggccccccctcgaggtcgacggtatcgataagcttttttttttttttttttctacagcaaaaatgagaactaaaaaaaaactcggcagaggagggaaagaccgttctcccagtacatgatcccgaccgagaaaaccctcaaactctgccctccatcactaacgggctgatgaattgcccactctacaacggcccagctggagggtgacgcgtttgatatcgatctccgagagcggatgggacatatagaggagattttttttagctaagcccgaaattcgttctcaagagggatcgaacccgagacctataagtgctgctcggaagtcttaaccattacattagaggaccttttcgcaaaaattgagtaccactgatagatacatcaaagtcaaaggagaactccatgctacacgtaaactgatatcccagaagcatcccagacatcaggtgatgatagatgagatgcgcttccttaaaaagaagtgttaaatcttggagtacatgtctacgaagagtatatttgatcttccaagagaatgcctgcaataagcatctgaggatgtgctcatcttgagggcgaggagcactgcacaaggtcagggaagccatttgtagatcccatgtgcatggcgataaagtaaatagcaac

SEQ ID NO: 9811 - DNA, 1400 bp, Zea mays
  misc_feature: Ceres CLONE 453928
  misc_feature: Encodes the peptide sequence at SEQ ID NO. 9812
aaacccaaacacgctacggaatccaccgccccgaagccggcaagcggccaacccctcacgcgcatccgtccgtccggttccggtctcgatcggacaaacctggaaccattggtcttcgccccccttgcaccagtccacgccccactcccagtctcccactcgctgcagtctggcactgttctcgggagaggcgtattgctgtcctcccgcaccgcaccacaccgcaccgcaccacgttagcggctcggggtggggggttgggccaatcccttccccggcagacggcagtcgcatcgcatcccctccgcctcgttccttgctcggctcgccccaacttcgctcccggccgccgccgcattcccctcggctactcgctccccggtgatgtctggcggtaacgcgtggtcgccactgccttcgcacggatttggatccgagtctagcggcatggcgaatcgcgccggcgagcctgtggcgaggaccaacagcgatggcggcggcggcggcagcaaggactcgggcagcttcgagtgcaacatctgcctggacctggcgcaggaccccgtcgtcaccctatgcggccacctcttctgctggccctgcctctacgagtggctccacgtccacgcgcactctcaggagtgccccgtctgcaaggccgtcgtcgaggaggggaaactcgtccccctctacggccgtggtggcagctccgccgtaccccgtgcaaggtcggtggccggtgtggaaatcccgagcaggccgaccgggcagcggccctccactgccccgcagccggaccacaataaccattacccgcaccagaacccctggttcaatggtgctggcgccccccctttggctaatggtaggtgggggagttacactttctcggccgccatcggagggctgttcccgttgctgagcttccaggtgcacggattcccgcaggcgactgcctatgggcctgctgcagggtttccttatgggtacggccattctttccatgggtggcatggccatggcttcccgcgccaggcaccacaaggccagcaggtcgatgcgtacttgaaggtgctgctgctggcagttggtgtgcttgtaattgccagcctaatcgcattttagattatgtatggttggcgatgtcgctgatccttgttggtgtgtaccgtagttctagcatcattgcatcttagatggctcccaaagtttgatgtcaatgtggagagtattgtggatgcttcggctagtaatagtacttgtgataattggtggcagctgttattcattgtgtaaagttgctatcgaaaaattataggtgcatctgttgtgttcatgccttgaactttggtcatgttcatatttcttcaatgaagtttccctgaaaaaaaaaaaaaaaa

SEQ ID NO: 9812 - protein, 246 aa, Zea mays
  misc_feature: Ceres CLONE 453928
  misc_feature (50)..(90): Pfam Name: zf-C3HC4 Pfam Description: Zinc finger, C3HC4 type (RING finger)
MSGGNAWSPLPSHGFGSESSGMANRAGEPVARTNSDGGGGGSKDSGSFECNICLDLAQDPVVTLCGHLFCWPCLYEWLHVHAHSQECPVCKAVVEEGKLVPLYGRGGSSAVPRARSVAGVEIPSRPTGQRPSTAPQPDHNNHYPHQNPWFNGAGAPPLANGRWGSYTFSAAIGGLFPLLSFQVHGFPQATAYGPAAGFPYGYGHSFHGWHGHGFPRQAPQGQQVDAYLKVLLLAVGVLVIASLIAF

SEQ ID NO: 9813 - DNA, 1526 bp, Zea mays
  misc_feature: Ceres CLONE 453945
  misc_feature: Encodes the peptide sequence at SEQ ID NO. 9814
aaaccgatttcccccttttttctttattttcttcgtcctcttcgtctcgactcgccgcccagtcacctcaaatcccttcgatccaatctccaaaccctaggcaatccaacatcaaagtattagctgcccccttcgtcaaaccgcggcggcgcggccatggcccacggcggcggcgccgggaaggcgaaggtgacgccgaacctggcggtggacggcgagggcacgcgcacgctcaaccgcactgtgctgcagcgcctcgacccggccgttgaggatattctcatcaccgcggctcacgtcacgctgtacgactttgacatcgatgtcaaccagtggagacggaaggacgtggaggggtcgctcttcgtcgtcaagaggaatgctcaacctagattccagttcattgtcatgaaccgcaggaatacagataatctagttgaagatctcttgggagattttgaataccaactccaagctccttatattatgtaccgaaatgctgctcaagaagttataggaatttggttttacaactctcaggagtgtcaagaagttgcaaatctttttagcaggattctgaatgctttctcgaaggtgccaccaaagccgaagattccccctgttcaaagtgaatttgaagaggtggaagcagcacctgtgttggttgatggccctctagaaccgcaaacgtcaaatatcatgtcaactactactcacattcaagaggatcctttatctgcatttttcagtgcagctgcaaatgctggtggcaactctgctgtagctgttgcaaggcaaccaattcaactttttggtgctactccggtggctacacatgcagctactagtatcactacaatacaatcgccaggcttgcattatttgcttccttcacaagcctcatcggtttctgggatgcctgctgatgctcatggttctataggaaggtccacaaaccttgtaaatccatcacttttctcaccattgacgtcttcacagacaacaatggtgtgcactaattctgtagtagcaattgctccacctcaacatcctcagactgctcagcagccgcaaagtgctcccttgcttcagccttttctattacctacggcttcaccatctccaccatatgggactccattacttcaaccatttccgccacctaatccatcgccatctcttgcgtctgcaccagtcttgagcccagcactgtctagagacaaagtccgagatgcattactgagacttgtggagaacgatgaattcatagatttagtctacggcgagatcatgaacagacagtaatggattttcaaggtacagtcctctccatcaggctagcttgtgcttggactctgtcattatctgttgtctaggctatttcaagttatcctgtaaattcattgatgaaatccttcggtttgtggagcttgtgctattaatgtacttttgacatttacaaaatctgtgctgtgttcgtggtgcagaaaagttttgttctgagtataacaaaaaaaaaaaaaaaa

SEQ ID NO: 9814 - protein, 382 aa, Zea mays
  misc_feature: Ceres CLONE 453945
  misc_feature (19)..(141): Pfam Name: DCP1 Pfam Description: Dcp1-like decapping family
MAHGGGAGKAKVTPNLAVDGEGTRTLNRTVLQRLDPAVEDILITAAHVTLYDFDIDVNQWRRKDVEGSLFVVKRNAQPRFQFIVMNRRNTDNLVEDLLGDFEYQLQAPYIMYRNAAQEVIGIWFYNSQECQEVANLFSRILNAFSKVPPKPKIPPVQSEFEEVEAAPVLVDGPLEPQTSNIMSTTTHIQEDPLSAFFSAAANAGGNSAVAVARQPIQLFGATPVATHAATSITTIQSPGLHYLLPSQASSVSGMPADAHGSIGRSTNLVNPSLFSPLTSSQTTMVCTNSVVAIAPPQHPQTAQQPQSAPLLQPFLLPTASPSPPYGTPLLQPFPPPNPSPSLASAPVLSPALSRDKVRDALLRLVENDEFIDLVYGEIMNRQ

SEQ ID NO: 9815 - DNA, 1411 bp, Zea mays
  misc_feature: Ceres CLONE 454176
  misc_feature: Encodes the peptide sequence at SEQ ID NO. 9816
ccacccgctaacggcgacgacgactgcttccccagtgggagacctgcaatcctcagccacctgcccctccccctcccccatctccgttcacctcttcccctcttccctaccttcctgtattcgcggcgtcgagtgccgccgcccttcgccggcgccgagcacggagcaacgcaccagtttcagtacctggattcgaactgagagtggattacgaagtcatggcaaggttatgttgcttcggcgccggttgctccgatttcacggggcaagggtcaatagcatccggtaaagggaaaggctgtcaagggcaagtcaagatctgctatggatataaccttgtaagagggatgacgaatcatccaatggaggactatcattttgccgaacttgttgatgtcaaaggaaacgagcttggtctttttgctatttatgatggtcatttaggggataccgttcctatgtatttacagaagaatttatttacaaatattttgaatgaggaagagttttggacacacacagatagagcgattataaaagcgtatgaaaaaacagaccaagctattctgtcacatactccagatctgggacaaggtggctccactgctgtaaccgccattcttgtgaacggcaggaagttatgggtagctaatgttggcgattcaagagctgttcttttgaaaggtggtgagcccatacagatgtcgatagaccatgatccgaatgttgagcggagtgtaatcgaaaataggggtggttttgtttcaaatatgccaggagatgttccccgagtatgtggtcagttggctgtctccagagcttttggagacaggaatctaaaatcactattgagatcagagcctgatataaaaatcgaagacatagatcacactgccgagctacttgttcttgcgagtgacggtctttggaaggtgatgaacaatcaagaggttgtcgatttggccaaaaggtacaaggatccctatgctgctgccaagccaattaacccgtcgaagcacaaaaaagagatagtaaggatgatatatcatgcatcgttgttcggttcaaggcgtaagtcggtctcgaaggattttcatcgagagcaaaaaaacaagtgaattaggctgcctgacgatggtagtgataatctgatggttgaataatgactggggtgttggatgtaaatgatttgtctgctccaatgtaaagttcatatataagtatgctaggattatttggtttggcgatttcaaaggtacaggtgcgagggcccgagagctactaaatagctaccatctgtaaataatggttatattggatgttgaatttgtaagagtagactgagcaaaagacatctggatagttcctaaaagaacaaggtactctttatgttcgaaaaaaaaaaaaaaaa

SEQ ID NO: 9816 - protein, 299 aa, Zea mays
  misc_feature: Ceres CLONE 454176
  misc_feature (36)..(274): Pfam Name: PP2C Pfam Description: Protein phosphatase 2C
  misc_feature: SWISSPROT Homolog: EC 3.1.3.16 Phosphoprotein phosphatase
MARLCCFGAGCSDFTGQGSIASGKGKGCQGQVKICYGYNLVRGMTNHPMEDYHFAELVDVKGNELGLFAIYDGHLGDTVPMYLQKNLFTNILNEEEFWTHTDRAIIKAYEKTDQAILSHTPDLGQGGSTAVTAILVNGRKLWVANVGDSRAVLLKGGEPIQMSIDHDPNVERSVIENRGGFVSNMPGDVPRVCGQLAVSRAFGDRNLKSLLRSEPDIKIEDIDHTAELLVLASDGLWKVMNNQEVVDLAKRYKDPYAAAKPINPSKHKKEIVRMIYHASLFGSRRKSVSKDFHREQKNK

SEQ ID NO: 9817 - DNA, 985 bp, Zea mays
  misc_feature: Ceres CLONE 454469
  misc_feature: Encodes the peptide sequence at SEQ ID NO. 9818
tatgtttgtctgccaaaaaaaatgcataccattaatgaggtagtaagatttctatgcagcttacacttaattagacccataatctttttatcatcaagacctgtgcacttttgggtttcatttttgactgttacaactcttgggtcttcaccaatgatctttagtgccaaagttatgtgcatctatgttctccaatccccaagatgcttttaagtttctctctttcaattgtcgcacaattacttcgttcttttgatgcaccagtttattgttgagaatgttgaaataatgcttttcgctcatatatttaggttcattgaatttggaaatgacggtggacctgcagcgaagaccttgaagccaaagttcaatttgttcgtcaagctagtgtccaagaatactggactggggctgccgcatatggatataaaaactgtcattgcagctaccatgtttcttaaaggctttggtggtcttctgttcatagtcagcagctcatttggagcattcctcctgctcatttacttggcgtttataacccctattgtgtatgacttctacaaccatgaaatggagtcaacactgtttgtcgatttttttttcaagttcatacagaacttggcgtttatgggtgccctgcttttcttccttgggatgaagaactcaattccaaaacgtcgctccaagggaaggacaacaaaaaccaagacaaactgatgtcagtggttgtaggaggggaagcaattgggctcattatgtttgcatactatacaggaatagatgtcccacttttgttcttggtgcgccaattgaattgtgaattgggacttacagaacttagcatgtaggatatttaagttatcttccgcaattttattttcttatgttgcgatgtgttcttatgtcacattccattttgctacaagaactgctttgacagtaaaaaaatatattaagtcgcatagccaaaaaaaaaaaaaaaaaa

SEQ ID NO: 9818 - protein, 153 aa, Zea mays
  misc_feature: Ceres CLONE 454469
  misc_feature (6)..(134): Pfam Name: HR_lesion Pfam Description: HR-like lesion-inducing
MHQFIVENVEIMLFAHIFRFIEFGNDGGPAAKTLKPKFNLFVKLVSKNTGLGLPHMDIKTVIAATMFLKGFGGLLFIVSSSFGAFLLLIYLAFITPIVYDFYNHEMESTLFVDFFFKFIQNLAFMGALLFFLGMKNSIPKRRSKGRTTKTKTN

SEQ ID NO: 9819 - DNA, 689 bp, Zea mays
  misc_feature: Ceres CLONE 454572-R
  misc_feature: Pfam Name: DER1 Pfam Description: Der1-like family
  misc_feature (398)..(398): n is a, c, t, g, unknown, or other
cgaattgggtaccgggccccccctcgaggtcgacggtatcgataagcttttttttttttttttttcgtgtacacaaattgtcattacagaattatattcatgtgtaaacatggacgatgaacattgttagcaactaaatgagcaaatgaaagggttctccattccgtccgtccaggttttttaagaaaatctctgacgggtaacccttaattttgattgaccctactatgcgttctggtctttgcttctacattgccactccgaccatggatcacattacgaggtgggtgaatctattgattgagcctatagcttcttcctctaaacacaccagacccgctgttgccattggctggtggacggacgggtgactttgcttgcatgcctatcctgaatcnagaaacaatcttatgtacccatttaggagtcttgaggtagttcttcccggtggcaagagggtgcaacactgcaaagaagtagtaaagatgtccaaccatgatacccagaaagtccaggcatttaatgatgacccaaatatccccttccgataaaaacatagccccaaggaaagaaaaaaagggacccccaattgggaacaaaggcccttataatattttttttctgaaccaatttggaattttttcctcggcttcctgaaaattaaaagggaagcatgccttaaacccttt

SEQ ID NO: 9820 - DNA, 887 bp, Zea mays
  misc_feature: Ceres CLONE 454667-R
  misc_feature (1)..(1): n is a, c, t, g, unknown, or other
  misc_feature (2)..(2): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
  misc_feature (177)..(177): n is a, c, t, g, unknown, or other
  misc_feature (178)..(178): n is a, c, t, g, unknown, or other
  misc_feature (179)..(179): n is a, c, t, g, unknown, or other
  misc_feature (180)..(180): n is a, c, t, g, unknown, or other
  misc_feature (181)..(181): n is a, c, t, g, unknown, or other
  misc_feature (182)..(182): n is a, c, t, g, unknown, or other
  misc_feature (183)..(183): n is a, c, t, g, unknown, or other
  misc_feature (184)..(184): n is a, c, t, g, unknown, or other
  misc_feature (185)..(185): n is a, c, t, g, unknown, or other
  misc_feature (186)..(186): n is a, c, t, g, unknown, or other
  misc_feature (187)..(187): n is a, c, t, g, unknown, or other
  misc_feature (188)..(188): n is a, c, t, g, unknown, or other
  misc_feature (189)..(189): n is a, c, t, g, unknown, or other
  misc_feature (190)..(190): n is a, c, t, g, unknown, or other
  misc_feature (191)..(191): n is a, c, t, g, unknown, or other
  misc_feature (192)..(192): n is a, c, t, g, unknown, or other
  misc_feature (193)..(193): n is a, c, t, g, unknown, or other
  misc_feature (194)..(194): n is a, c, t, g, unknown, or other
  misc_feature (195)..(195): n is a, c, t, g, unknown, or other
  misc_feature (196)..(196): n is a, c, t, g, unknown, or other
  misc_feature (197)..(197): n is a, c, t, g, unknown, or other
  misc_feature (198)..(198): n is a, c, t, g, unknown, or other
  misc_feature (199)..(199): n is a, c, t, g, unknown, or other
  misc_feature (200)..(200): n is a, c, t, g, unknown, or other
  misc_feature (201)..(201): n is a, c, t, g, unknown, or other
  misc_feature (202)..(202): n is a, c, t, g, unknown, or other
  misc_feature (203)..(203): n is a, c, t, g, unknown, or other
  misc_feature (204)..(204): n is a, c, t, g, unknown, or other
  misc_feature (205)..(205): n is a, c, t, g, unknown, or other
  misc_feature (206)..(206): n is a, c, t, g, unknown, or other
  misc_feature (207)..(207): n is a, c, t, g, unknown, or other
  misc_feature (208)..(208): n is a, c, t, g, unknown, or other
  misc_feature (209)..(209): n is a, c, t, g, unknown, or other
  misc_feature (210)..(210): n is a, c, t, g, unknown, or other
  misc_feature (211)..(211): n is a, c, t, g, unknown, or other
  misc_feature (212)..(212): n is a, c, t, g, unknown, or other
  misc_feature (213)..(213): n is a, c, t, g, unknown, or other
  misc_feature (214)..(214): n is a, c, t, g, unknown, or other
  misc_feature (215)..(215): n is a, c, t, g, unknown, or other
  misc_feature (216)..(216): n is a, c, t, g, unknown, or other
  misc_feature (217)..(217): n is a, c, t, g, unknown, or other
  misc_feature (218)..(218): n is a, c, t, g, unknown, or other
  misc_feature (219)..(219): n is a, c, t, g, unknown, or other
  misc_feature (220)..(220): n is a, c, t, g, unknown, or other
  misc_feature (221)..(221): n is a, c, t, g, unknown, or other
  misc_feature (222)..(222): n is a, c, t, g, unknown, or other
  misc_feature (223)..(223): n is a, c, t, g, unknown, or other
  misc_feature (224)..(224): n is a, c, t, g, unknown, or other
  misc_feature (225)..(225): n is a, c, t, g, unknown, or other
  misc_feature (226)..(226): n is a, c, t, g, unknown, or other
  misc_feature (227)..(227): n is a, c, t, g, unknown, or other
  misc_feature (228)..(228): n is a, c, t, g, unknown, or other
  misc_feature (229)..(229): n is a, c, t, g, unknown, or other
  misc_feature (230)..(230): n is a, c, t, g, unknown, or other
  misc_feature (231)..(231): n is a, c, t, g, unknown, or other
  misc_feature (232)..(232): n is a, c, t, g, unknown, or other
  misc_feature (233)..(233): n is a, c, t, g, unknown, or other
  misc_feature (234)..(234): n is a, c, t, g, unknown, or other
  misc_feature (235)..(235): n is a, c, t, g, unknown, or other
  misc_feature (236)..(236): n is a, c, t, g, unknown, or other
  misc_feature (237)..(237): n is a, c, t, g, unknown, or other
  misc_feature (238)..(238): n is a, c, t, g, unknown, or other
nnttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttttttttttttttgcctattgggtaccgggccccccctcaaggtcgacggtatcgataagcttttttttttttttttttctttttttttttttttttttttttttttttttttccaagtcagaactgagctgcacgtatattaacagatattgacagcactacaaattgatgtttgccacaccggactaattaatgtacgaaagcaagcagattttattcctgaacaccatgaggtccagccatcgcccaggttcctccgtgctatatactaatcagtcatcactttgtaccactagatgccaagcagggaccacaacatttttcgggctctcattttcggcagactttgatcaagcctccctcgcctaaaagtccccaagaagctggctttcgcccaaatttccctgggtttcccttggcaaaatttttggcttcgggttctttcctcccaaaaggttttggcagttccggccaaaaaggttacttttttccctggggtaacctcccccttttaaattttttaaaggggcctccaaatccccttccgttataacaaaagtttatttttccaaaccctccccccgggggggggtaaaatttttcttttcccaaaaattttattttttaaaagtgggggaaacccc

SEQ ID NO: 9821 - DNA, 758 bp, Zea mays
  misc_feature: Ceres CLONE 454707-R
  misc_feature: Pfam Name: RNase_PH_C Pfam Description: 3' exoribonuclease family, domain 2
  misc_feature (57)..(57): n is a, c, t, g, unknown, or other
  misc_feature (670)..(670): n is a, c, t, g, unknown, or other
taatcccgttcccaatcgtttgacaataagccaaaatacaatacatttttcccactncacgaattgggtacgggccccccctcgaggtcgacggtatcgataagcttttttttttttttttttgaacaaaatcgacaggctactaagtgaagaattatgtgtagactgtagagtacaaatagctacatacttggcctaaatcaacaaaactgctgttacaaccagtgaagccgaggcagagagaaaccatcaatatgtaatccggtcagattaactgaatctatttgtagaattattcagtttggtcgacttccatggctttgatagagtctaacagaatttctcttaggctccgtctcctttctttcgccaagctaatgcactccttaatagtcgccatggaagacactgcacctccaagtttttgtaatgacactaggcggtctgaagaatctacaacaacagtcacgtgggtctttattaacgattcttcttcaaaaaatgggtccgctaataaatcctctttatgaggggcccctgtcaaggaaaataggaatggccccaaccgacagtttccctcttttcccagttttattaatacaaatatgtatttttcccaacctacgcccccaacattaaataattcttgcattactcccccatataaaantacaacgattctctaaatgggtacaaaggcctgccttggcatggaaataatgtgtatgtctccacataaaacaccccttcaaccattt

SEQ ID NO: 9822 - DNA, 751 bp, Zea mays
  misc_feature: Ceres CLONE 455052-R
  misc_feature (23)..(23): n is a, c, t, g, unknown, or other
actattgggtaccgggccccccntcgagtcgacggtatcgataagcttttttttttttttttttgtttttttttttgcaaccacatgtgcacaggaatataatcgtaatgtagtcactcaaaacgcagcttacaagaatatatccatgttgggacatgcatgaatgaattctaactttatttataaatccttaccctccaaacaaggggtaaatgtgatctttcacttagataactcggtgtcagaatactcacgcagagcatttgccagttcttggacatgttggtctacaactcctaatttgtgtaacgcgtccctcgagtttgaacacatacccctttgttaaggccttttttccccccccaacaaaggaaaaggggggcggggggatttcttcccaaaaggtgctggaaacaaaataagtttttgattggccccccccgggtgaccgggggggggaaaatataccccctcccattttttcgaaaaaagcgtggttcctcttggggcgaaaaaaatacactcatatccaattttaaggggttaacctttttcctctacaataatatggttctcccccccgaaccttccatagaaaacccccaaaaggatttcttcccctttttcttttccctcccttttttttaccggaaaaaagaaacctccccccacttgttgtgttcccccccggggataggtgcgctctcaagctgtggggcgtagtcgcctccctcagtggataaaatgccag

SEQ ID NO: 9823 - DNA, 644 bp, Zea mays
  misc_feature: Ceres CLONE 455131-R
  misc_feature (452)..(452): n is a, c, t, g, unknown, or other
  misc_feature (459)..(459): n is a, c, t, g, unknown, or other
cgaattgggtaccgggccccccctcgaggtcgacggtatcgataagcttatttttttttttttttgataacaacagcaaaactgatagcataacatccaaggtatccaactacatgtctacagcacagccaaagcatcgtcaataagttccctgaaccaaaaagagatctctctctggtaagcagtcaagtccctcaaccaatacaccaatccaattcatgacgtgcagcctaacaacaacacacggcactgtctcctccctggccaggccagcgggctggcctagaacgcgccgaggtgcacggccacgagcccggcaaggcccaagccggcccacactgcggcgctgagcccggtggcgccagaggaggtggacttcttgtccggcggcgagaggaccgtcgtgtctgggctcttgggcgtgcggccgccggagctcgagggggacgtcnggggtcnacgggcgtggtgtccggggggcgtcctggggggggggggttccccccggcccggggggcccgggggcccccccgccttgggggggcccgggccccccccgggggggggggttccccccccccccctttttggtggccccaatatttccccccaaaaaaaaaaaaaaaatttttttttttgtgtgg

SEQ ID NO: 9824 - DNA, 646 bp, Zea mays
  misc_feature: Ceres CLONE 455186-R
ccgattgggtaccgggccccccctcgaggtcgacggtatcgataagcttttgtttttttttttttaatccatatctatgcatgtacaaattaaaccactgtatgtctcaagaatatcagcagcaatgtaaccatatacatagaagcactatatatggttcccacacgcatatattattattactgttcacatcgccgcagttatatataaaaacattactatctactagtgctttattccacataatactagtgctagtatcgcatcatgccctaacttttctttgccaaacattattgtttgcctcctggtcgtggtcctgggttggctccttgatgcgcatccatctactagtatactggaaaactggccactacaagggccgatgctgctcatggaagtatagccattggcgagcatgcgcggcacggcgatacctagacgcaccatctaaatggccggcccgccgccgggcacttgccggtggcaaggtagtaggtattttcctgtcttctttgattgtttttttttccgaattccgatcgaagggctgcggttcattcgacgtcgttgccattgttctgctttccggtggtgtcgatgaggcaggtctcgacgccgccggtcatccataggaaccacgcgt

SEQ ID NO: 9825 - DNA, 837 bp, Zea mays
  misc_feature: Ceres CLONE 455399-R
aaaacaatagaagatatagaagaaggtatgttaaaataagatcgttagagttaaattcaggtattttcctgcatagactatggttttttccgaatgggtacgggccccccctcgaggtcgacggtatcgataagcttttttttttttttttttggctgaaagtgccaaagtgcacaagagacttgacgatgttctataaacacttttcactcggttaataattgatctcttcccgcattttggagttgtgcacagggagaatgctgcgatgagcagctggcatatataaaactgaccgagcaagcagagatgggcagccggagcactattataccgacaataataaacgtacgaagtttgcaggctagcaaaagtaaaaaaaacacgcacacaccaattaagacacgatagccagactagtcgacctcctccatcttgctctcgccagcgtcatcctccagaggaggcatgtcggtgtcggcctccggagcctcgtcctcgtcgatgctgaggcccagcttgagcatgcggtggatgcggccgccgaaggtgttggggtcgtcaaggctgaagcccgaggtgagcagcgccgtctcgaacagaagcatgacaaggtccttgacagacttgtcggttcttgtccggccatccggcgcgctttgcgcagcttcctcccatgaatgggcgtttgtccccggggttggatcctccccatgggtctttctttgggagggaacatggttaccccaggaaacatggcctccgaaagttccccctggaaagacccccctgggtggcccccttttccaatggaataaccactccctttcccaaaac

SEQ ID NO: 9826 - DNA, 2231 bp, Zea mays
  misc_feature: Ceres CLONE 455561
  misc_feature: Encodes the peptide sequence at SEQ ID NO. 9827
ttccccaccggcccaccctcactcccttccactccacaccgcgccggcaccagacggcagacgctgagctcctctgccaatctccgaacccgagaaaaccgtgagaatcccaagtgcccggccaacaactccgacctccgtgcaggcaatgccggtccaggatccctcctccttgccctccgctgcaggcggcggcgcgcgggccaagcgcacgtcgtcggcgccgatccggtcggctgactacgcgcacagccccacgcaccactgcgtcgcgctgcgggacgccacggggctgcagaccatcctcgcaggcctcccgccgctcgcgcacccgtcactcgtccttaccgcctccgacgccgcccgggaggcccgtctcgcgctctccgtcgccgccgcgctcgaccgccgcgacgtcccgggcggggacaccgcgctgcacctcgcggtccggcttcggctgccctccttggcttccgcactcgccgccgcgggggcggaccccacgctgcagaaccacgccgggtggaccccgctccaggaggccctctgcctcgggtgcagggagattgcagcctgcctcctccgcgctcaccgcctcgccgcctgggctaagctccggcgccgggcgcccgccctctccgccgcgctgcgtggggtccaggatttctacctcgaggtggacttccacttcgagagctccgtcgtgccgctgctctcgcgcgctgcgccctccgacacctaccgcatttggaagcgcggagcgtaccttcgcgcggacaccacgctcgccggcttcgatggcctccgcatccgccgtgcggaccactcgttccttttcttcggcgaggagacaagtgccggcggccgccgcctgcctccgggttctctgctcgtgctccaccgcggccggcgcgaggtgcacgacgctttcgcggcggccgcggccgcgggcgacgaggacgctgccacctccgacgcggccgcctaccgcccggggctcaacatcacctccgcgaggctcgtgccgaggaccacctggctgcggaaggagaagacggagaacgtcggcgagtggaaggcgcgggtgttcgacgtccacaacgtcgtcttctccttccgcaccctcaaggccgcgagtgccggacgcaaggatttcaccttcgagctcgctggagacgaggacggcgacgaagacgacgacgagttcctgccactggagatccgggacgacgacgaggatggcgacttccttgtcgctgacatccctccgcccccagcgcggcgcagctgctacgttcccggcaggcgcagcgtggcggggccgccgtcgcacttgggaaccccgcagaggcggaggaacagcgtggacgtgccgcggcgattgccggcgtgcgcgtcggtggggcgcggcgaggacggcatcttcgcccggcacccaggtacgacgacgacgacgggtggagccaagtggaaggaggaggagacgattaagacactgcggccgtcggtgtggctgacggaggacttccccctgagcgtcgacgaattcctgccgctgctggacatcctggccagccgcgtgcgcgccgtgcgccggctccgcgagctgctcaccaccaagttcccaccagggactttccctgtaaaggttgcaatcccagtggtgccgacagtgagggtggtcatcactttcaccaagttcgtgcccctcacggagccagaggagttcttcaccccgatgtcgagccccagcctgctggcgagcccagggccagggagcatcacggcgaagcccgacgcccaaaagagcagctcgtacctgaggtggggctcgaagaactcgagaccgaaggccgtgaacctgtcgcaggtcgcggacaacgccgaccccttcacggtgcccagcgactacgcctgggtgaacagccttgggtccaagaaccacgacaagaagtcgtccaagtccaagaagggcaagagcaaggaaacctgaacaaactcatccggtccagcggtgtattcactcagcgagaaccttgtatgcgtaagccgtcatctgcccagaaacctgtaattaccaagttgcctgggacatgcctcgacgtttaggccggtcttgctcagcgacgataagcgtggcggttttagctgccggagacggaagagttcagagagtgttaaactaggcctccatttcaactgattgttcagcaaaaaaaaaaaaaaaa

SEQ ID NO: 9827 - protein, 615 aa, Zea mays
  misc_feature: Ceres CLONE 455561
  misc_feature (92)..(124): Pfam Name: Ank Pfam Description: Ankyrin repeat
MPVQDPSSLPSAAGGGARAKRTSSAPIRSADYAHSPTHHCVALRDATGLQTILAGLPPLAHPSLVLTASDAAREARLALSVAAALDRRDVPGGDTALHLAVRLRLPSLASALAAAGADPTLQNHAGWTPLQEALCLGCREIAACLLRAHRLAAWAKLRRRAPALSAALRGVQDFYLEVDFHFESSVVPLLSRAAPSDTYRIWKRGAYLRADTTLAGFDGLRIRRADHSFLFFGEETSAGGRRLPPGSLLVLHRGRREVHDAFAAAAAAGDEDAATSDAAAYRPGLNITSARLVPRTTWLRKEKTENVGEWKARVFDVHNVVFSFRTLKAASAGRKDFTFELAGDEDGDEDDDEFLPLEIRDDDEDGDFLVADIPPPPARRSCYVPGRRSVAGPPSHLGTPQRRRNSVDVPRRLPACASVGRGEDGIFARHPGTTTTTGGAKWKEEETIKTLRPSVWLTEDFPLSVDEFLPLLDILASRVRAVRRLRELLTTKFPPGTFPVKVAIPVVPTVRVVITFTKFVPLTEPEEFFTPMSSPSLLASPGPGSITAKPDAQKSSSYLRWGSKNSRPKAVNLSQVADNADPFTVPSDYAWVNSLGSKNHDKKSSKSKKGKSKET

SEQ ID NO: 9828 - DNA, 594 bp, Zea mays
  misc_feature: Ceres CLONE 455750-R
  misc_feature (119)..(119): n is a, c, t, g, unknown, or other
  misc_feature (137)..(137): n is a, c, t, g, unknown, or other
  misc_feature (155)..(155): n is a, c, t, g, unknown, or other
  misc_feature (184)..(184): n is a, c, t, g, unknown, or other
  misc_feature (185)..(185): n is a, c, t, g, unknown, or other
  misc_feature (200)..(200): n is a, c, t, g, unknown, or other
  misc_feature (201)..(201): n is a, c, t, g, unknown, or other
  misc_feature (363)..(363): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
caaattgggtaccgggccccccctcgaggtcgacggtatcgatattttttttttttttttttgcagaacaggactgtagcttttattcatataaaaggattcccaaagtccgcagagangagagagagagcgcgcgncgtacaagaacgaacagntcctggggctacatagcctctggcgacannacgttcaaaaaaccnnaaaacgacaaaagcccagcaaaaatttattttcaggcggcggccaagcccaccaggtggttaaaatttttttaaccggggcgcggggcaaaaaaaaaaaaattctggggggtttttccccaaaaaaaaaccgccccctcccccccccgggggagaaaaaaancccccccccaaaaaaaaaaaaggggggggcccccccccccccaaaggaccccccaaaaaggggggggggggttttttttttcccccccccccccccccccccggggaaaaaaaacaaggggggggannnnggggctcttttttctttcccaaaaaaaaaaagggggggggggggggggaaaaaacccccccccccccctttttttttggggggggggggggggccgcccct

SEQ ID NO: 9829 - DNA, 842 bp, Zea mays
  misc_feature: Ceres CLONE 455937
  misc_feature: Encodes the peptide sequence at SEQ ID NO. 9830
  misc_feature (575)..(575): n is a, c, t, g, unknown, or other
acggcagctctgaagcgagaaagagatcgatcgtattcgtatccgcggaacaagcagcgaaggatcggagcctatccaatggccgagggcaagagcagctccagcggcgacctgttctccagcggcaagctggtggcgggggccgccgtgtcggtgttccagcagaagagcgtggagaacgtcgacaagcaggaggtcgccggcgcggcggccgagctcctgcacgcggcgtccgcgtacggtaagctcgacgacaagccggccgggcagtacgtcgagaaggccgaggggtacctgaaggagttcagcgcgggacacgccaccgagcaggagcagcctgcggcggcagcaggcgacgacgcggcgcccaagtcaccggcgccggaggcgcccaaggagccggcggcggtgcctgcgccggccgcggaggaaggcagcaagtcgtcggaggggttcggcctcggcgacgtcatgaagggcgccgagcagctggtgggagggaataagcagggcggcggggaggagagcgccggcggcggtgggctgtttaagatggcccagggcttcctcaagtnagatattgtctggccaacgtatatacgaggtacgtaattagcttcaaaataatgttcccctcgcctttatttgctgttcaagtccctgtaataaccgagaacgttaattgtagcagtgtgttttttatatgattaaataagtactatgttgtataaggctagtgcagctgtgcaggttactctatattcttactctatatcactattgtagtctactcatcaattaataaatagattgcttgataatacaaaaaaaaaaaaaaaaaa

SEQ ID NO: 9830 - protein, 177 aa, Zea mays
  misc_feature: Ceres CLONE 455937
  misc_feature (166)..(166): Xaa is any aa, unknown, or other
MAEGKSSSSGDLFSSGKLVAGAAVSVFQQKSVENVDKQEVAGAAAELLHAASAYGKLDDKPAGQYVEKAEGYLKEFSAGHATEQEQPAAAAGDDAAPKSPAPEAPKEPAAVPAPAAEEGSKSSEGFGLGDVMKGAEQLVGGNKQGGGEESAGGGGLFKMAQGFLKXDIVWPTYIRGT

SEQ ID NO: 9831 - DNA, 1060 bp, Zea mays
  misc_feature: Ceres CLONE 455982-R
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (45)..(45): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (54)..(54): n is a, c, t, g, unknown, or other
  misc_feature (1024)..(1024): n is a, c, t, g, unknown, or other
  misc_feature (1060)..(1060): n is a, c, t, g, unknown, or other
attttnnnnnnaatgnnnnatgaaagggggagaaaaaaataaccncnnnncgcncagcattatatacatctttgtacaaaataaaagccaaaggtgaaaggtgcaacacaaaatcctactaaccagtagcatacacaatatgatgtccacaaaccagcccagagttcactttgtaccagacagaaagttccaccttagaaatagaaaagaacagttctaaactttcctgaacctccaaaaatcagggggaaaactcaatcccccttctttttttcgccgcttaagggcccagttgctcccggcttttccccacttcacaaaaaaacggctttccggtttttccctcgccccaaaaccgcagacggggtgtactgggacgggcccaatccccccatttcccctcccaaccgattgggccccccccggacaaggccaatataccctgtttaacacacggccgcccccggacccctttgggttttttccctatctaaccccgaccagctggccacctcaccctcctgcgtgcttttacccccaccatccattttctgtttggcgacttatccagcattttttttcccgcttcattccccccccaccacctagatccagcgcatcaactagagctattacctccacctagccccgcttccctcgcagcatccgtctttcccaccccccctccttcttcccccaccaataaaccctactccaccccctctctcgtgtctcccccttcactttctctccacatcgcgcaattgaccgcccctcctctactgctctctctatgggggccatgtttccacatctctcacctcccatcttctcttcctattcgcctcttcgccccccccccgctctccccccccgcccgcgccccacagctcgtacccacctgtatctcctgccacatagccactcctacctttactcagtcttattactacttcaccaattgacctctcatccctctcctcccatacctttatcttctcatgacacattccctgtcccgaanatctgtttcactgcttcagatagccaccgccacgcn

SEQ ID NO: 9832 - DNA, 493 bp, Zea mays
  misc_feature: Ceres CLONE 456083
  misc_feature: Encodes the peptide sequence at SEQ ID NO. 9833
atcccgaagtcaccgagctgagctccaaagaatctagcagctaggagcaggccgtgtatacgccatccaccacggcaacatgtgctccggctcctggtcctggagcagcagcaagaagcgcaagcgcccgtctcttgttgtcgtcaacctcaagcggcgccagctgcagaagacgccgccgccgacgccacctcgttcctcagttgctatcaggaggaagaggctgagactgaggaggttgcgagccggagcagaggccatggagatggtgaacctgaagctctacctggagaaccggtgcatcatcgcggagaacgagaagctgcgggagagggccagcgcgctccgccgtgtcggtgctctgctgtctgctcatacatcaccaggctcctggagctctcttgggtgctctgtgccatggtgtttgtacattatatataagtgcgcggattaactagattttcaaagcctgcacaaaaaaaaaaaaaaaaaa

SEQ ID NO: 9833 - protein, 124 aa, Zea mays
  misc_feature: Ceres CLONE 456083
MCSGSWSWSSSKKRKRPSLVVVNLKRRQLQKTPPPTPPRSSVAIRRKRLRLRRLRAGAEAMEMVNLKLYLENRCIIAENEKLRERASALRRVGALLSAHTSPGSWSSLGCSVPWCLYIIYKCAD

SEQ ID NO: 9834 - DNA, 655 bp, Zea mays
  misc_feature: Ceres CLONE 456134-R
ccaattgggtaccgggccccccctcgaggtcgacggtatcgatatttatctttgtgtgcaaactgaatccaacttccatgcagtgtgaatccaacttccatgcagtgtgacagatcaatacataaaggagagactataaaatagctcttcctttttttgtcatcaggtgcaagaacacaggggcagtccgacgcagagcccaccacagattcttgtcgtgcaacagtttgctgaaccaatgtcatcccactctctgctagtcacaaccaagattcagtaccattttcgcaagtcctgggcttcaatcttccaaacctgactcattcttgatgattactcatctgctgcctcctccgagtctgagagtggtagcagggtaccaagtccaataacatgcccattcaagcatacaaaatactcgacggaatcatcataggcacccagtctagcagaagcactccttggaatgatattttcctggaacatgttccatagcttcgccttacaataagagcacaactcccttggatgaaacctagcccgcttctcaatcaacatcttcttcactcttgaagtggcgaatgacttaaagatgcctcgaaagaaacctaagtcgccttcttccccttgatcaagatgctcacatggatctgac

SEQ ID NO: 9835 - DNA, 653 bp, Zea mays
  misc_feature: Ceres CLONE 456226-R
  misc_feature (1)..(1): n is a, c, t, g, unknown, or other
ncaattgggtaccgggccccccctcgaggtcgacggtatcgatattttttttttttttttttgccaaaaacaatcgatcatattgacaaaaagaatgacattgaagctacaaaaaaaaaacaccatcctagaatatggatggcaatgtaatgtttacaaacatatgaaagaatatgatcacacaaatctatctggtttcacgatctcgcattctcacacagacttttatatctttgcattcccacccaggttcggtaccctccccccctctctctctcctcctagcgggaggtgttccattatttcaacagaagattatactaggaaaagcaaacatggattacaacagtcaagtcagactaccgagacaaagctgctcacctgacctggccaaatctggttctggtcctcataaaccctcctctcgtgaccggatcagactccttggcactgcagttccagtaagcccccaccgtccccaggatcggcatgtcatcgggactcgggctcggggacctcgacctccgaggcgttgagttggcggacgacaccttgatgtcctccacggtgagggcgccgaggatcggccgttcgtcccggctgatcggcgagtaggaccggaccgagttgctctcgggcgtccccgaggaacc

SEQ ID NO: 9836 - DNA, 1793 bp, Zea mays
  misc_feature: Ceres CLONE 456306
  misc_feature: Encodes the peptide sequence at SEQ ID NO. 9837
atatgcaacgctgcgtttcgcgtcaggcgaggcggaaatcgtggcagcggcagcggcagcggcagccgagccgagcctgaacggctgccactgctgccacaccaccatcactcacctctcccacgcccccaccaccagaccagggcaaggaggagcgcaaccttcatgagttgatgtgattgataaataacgcgtcaggtcgcgctgtccacacctcccgcggctcgccaagctccgctcacacctcacagtcacagcagcatgactctgtagtccatctccctttgcagccgccgccgccgcctcgagtggctcccagatccgagccgacgccggagcagggacaagccgctgccagcggcaatggcggacgccgtgggggcgcttcctcctcctcctctgccgccgccgccagagtgcgaatccgggaggtcctcgccgtcccacgccgcgtcgccggagttcgagttctggatggtgggcaggaacccgtccccggcgctgctcaccgccgacgagctcttctccggcggcgtcgtgctcccgctccacaccctccaggcgccaggcgctccggacggcgacggcgcgcctcagctccaagccgacgcggacgcggacgccgcggcgctcccgctgcctgacgcgcaggcgcaggtggaaggggaggccgcgcagccgctcgcggagtccgccatcgcgccgacgccggacctccccgcggtcacgttcaagtggaaggacatcttcaaggcgggcgccggcgccggcgccgagggcaaggagcgcaagaaggtggaacggcgcgtgagcagcgtcagcgggaacgccgagctgattaacatcaacatatggcctttctccaggagccgctccgccggagcaggtgccggcaccttgagtagggccaagcccaatccgaatccaaacccaaacccaaaccccaacgtcgccgtcgccgccagcggcggcgccagcgctaacgccaacaccaccgccaatgccaccgccccgagcgcaccgccggccccggcgccggtcccgcgcaaggtgagcagcgcgccgtgctcccgtagcaactcccgcggggagtcctccgggcctgtgccgaccatccccaccgccactgcggctgcagcgccagaagcagcagccggagaagaagacgccgacgcggccacccaggttgaggcggcgccactgaccgccgccggcacatccagcgccacgtccatgttgaggaggtgggtgcccggacagggccgtaacaacaacgcagcagggcccggcggcatccgcgtggggcggcccagcgccgtgtggaagctgaggcgcaacaagctgcagcaaaccgccgccgagcagaagcaggtgggcggcaagaagaaggcggccccggcccaggaacccgccgcggccgcggacgcagatgcagccagcgacgacaaggcgtcgccgagcgtggccgcgccagctgccgggtgccggaacaacgtggagggcgccggcgaggaagggaacccgccgcaggtgctcttcgggctccggaccttcttctccaagaaggtgtactgatcagcagcaagccatggcattgtactttgtacatacaaattcgagctctaggctcgctcttccacattttcaccttacctgcccccttcttttctttttttttttgccttttttttattactctccttcctctgctctaattcgatcgagtagcttcgatatcctctgtactgtactagaacgaagctaggcctcatgcctcaaaaaaaaaaaaaaaa

SEQ ID NO: 9837 - protein, 403 aa, Zea mays
  misc_feature: Ceres CLONE 456306
MADAVGALPPPPLPPPPECESGRSSPSHAASPEFEFWMVGRNPSPALLTADELFSGGVVLPLHTLQAPGAPDGDGAPQLQADADADAAALPLPDAQAQVEGEAAQPLAESAIAPTPDLPAVTFKWKDIFKAGAGAGAEGKERKKVERRVSSVSGNAELININIWPFSRSRSAGAGAGTLSRAKPNPNPNPNPNPNVAVAASGGASANANTTANATAPSAPPAPAPVPRKVSSAPCSRSNSRGESSGPVPTIPTATAAAAPEAAAGEEDADAATQVEAAPLTAAGTSSATSMLRRWVPGQGRNNNAAGPGGIRVGRPSAVWKLRRNKLQQTAAEQKQVGGKKKAAPAQEPAAAADADAASDDKASPSVAAPAAGCRNNVEGAGEEGNPPQVLFGLRTFFSKKVY

SEQ ID NO: 9838 - DNA, 720 bp, Zea mays
  misc_feature: Ceres CLONE 456330-R
  misc_feature: SWISSPROT Homolog: EC 1.14.11.15 Gibberellin 3-beta-dioxygenase
  misc_feature (17)..(17): n is a, c, t, g, unknown, or other
  misc_feature (22)..(22): n is a, c, t, g, unknown, or other
  misc_feature (23)..(23): n is a, c, t, g, unknown, or other
cgattgggtaccggggnccccnntcgagtcgacggtatcgataagcttttttttttttttttttgaggaagaaagtaacactctctttaatattagatacggaagatatggatatgattggtgaagattgagattgattgatttatcgatatggtgggcaattatttttggatggaaggagcaactagatggctatatcctgaggctctggatgaaccctgtcccttgctccagcgcgttgaagttgcccttgatgtactcctccatctccatggacctgtagcgcgcgcgcgcgccctgctggtcgaggagcccccgcagcggcgccaccaggccccctacagacacctcctggaacaccacgacagtggtccgggccctctcggcgtccgggagcacccggtgccccacgccggtgtaggcgccgctggtgagtacccccccgatgtccgcgaccttgacaaccaaggcccccggcgcccgggtacggggaaccccctgccgcccccgctgatcttgcagccccggccgtcctcccacgtgcaccccacacccgggaggccccgcccctcccccgtggccggcgtggtggcccctcgacccgccccccccctggcggagaaggaagccccaaagggtcatgccccacccccacccctggcaacccctcccgcatgggagggggcgcccaggcgtgggccctcccccgggtggccccca

SEQ ID NO: 9839 - DNA, 780 bp, Zea mays
  misc_feature: Ceres CLONE 456396-R
  misc_feature (86)..(86): n is a, c, t, g, unknown, or other
gaaggatgtaaaaaaaaaaaaaaaaaaaaagaaagaaggaaaataaataaatgagaaaatagattattaatttttgggaaaaaaanttccaattgggtacgggccccccctcgagtcgacggtatcgatattttttttttttttttttggcaagaactccatttatttgaaattaccaagtctttaacataaagagcatgcggactcggcccagtggcccaaccattcctaaccgacacgcgtatacctcctagatctcgacaagctaacattacttcctaaactgacggcgcactaagtacatgaatgcagaaaacagacttctaagtttaatcaagccaccacggacgacagggtgatggcacaggcaaccaagagcacaagcccaactgcaacggacgacacgagcacgcgcctagacgcaccgctggcctgcggcagcgggctcgggctcgggctcgggctcggagaagtggaactggaaccggagccggagccgggcggcgaggtggccgggctgggcgcgcctgatctgccactgccactcgcggttggcggcgtcgccggcgccgccacaggggcgccgcgcggtgcggaggcgccgggcctgatgacccgcacgatcatccgctgtcccgcctcgcagtggcctgcggacgccggctgacgaaagtagacggggccggtagcgggtcccagcgcggaaactttggtggtcggcccgcccggttgaaaccgggccccaaagcgggcggtccttccggtggccttgcaactggc

SEQ ID NO: 9840 - DNA, 610 bp, Zea mays
  misc_feature: Ceres CLONE 456546-R
  misc_feature (591)..(591): n is a, c, t, g, unknown, or other
ccaattgggtaccgggccccccctcgaagtcgacggtatcgataagcttttttttttttttttttgcgccaaagacaacaacatatataataacagagtgtgtagagataaatgtcataataatcagagtatttattacatagcggaagtcttacaaaataaaatataaatataaaaggatctaaaatccatctttggcgccagaaagtcaactgggagacgccacctagatcgaatcgaactcctcgatacgtggctccacttgaaccacctgttcttctcccctccaatccaggaacagcagcacgagaagccgaggcagcaccgccgctactccgcctcgatgatcttcttgggctcgtgtaactcgggcggtcgggcatctttgccccaacccacgccgcgtgtagcctctaggtactggtccacgaggtggcggcacttctggtgagtggttgatcccctcgatgcggtagcaccagcggaggcgctcccggatgatcttggcgagtctcgatctgaatccacttctcccgcacaagggtgttctcggtactccagcataagcccaccgggtcccgcatatggggnttcttccgagtcgaaaatt

SEQ ID NO: 9841 - DNA, 1227 bp, Zea mays
  misc_feature: Ceres CLONE 456643
  misc_feature: Encodes the peptide sequence at SEQ ID NO. 9842
gatgaacaacaggttagataagcagagcgagaggagttcaaacaatcaaagagggaatttaaattgtaagatattgagatattggagtcaaacacaagatagcaatgtgatgcgattgtagagatccctcatgactcatgatgtcatgatcaataataaaaataattaaaatacgaacacaacatttaggattatgagaggcggtcagcaagtgtattctaactggctagacttaaagatcaccttcaacatgtgttttgaataggatgtaccatctatgtataaatgggggttgtgtctgtctcttgttatgatttttcactacacgacagtatagtagaagggatttctgtcaccattatttatggaccacgtaaacatacttttttagtttagattcttatgttgggcctctaaaaataataaagttattaatgactggacgaaaccaagaaataaccccttatgtgcgaaattatagaagatcccctttaagatcaaacaattgcatcgaattgattatgactgtatgtgtgatagcatctactatacgaggaatatcaatgaaccccattcttgcaattgctcaggataccctcttttagctgttaggtctatttcttagttcaagatccctctctactaactggaataaaagaattagtagatttgttccgcccaaaatgggaatgggtgctagggttatgaacttattatcatggtaccgactcgatcatcagattataagttctatttttagcgaccctaactaggtacaaactgttgattgctaaaatttatggaccgatggttggtcgctaaatacgtttgtagccacggtctgttggtcgctaaaagtctaaaaatataacaacttatagttggtcgctatagagatcattaggggctaatggtggtttgttatagatactccaccacaatctatagccatctagcccattaggtccaacgcggccaaaccctatccccatccggcttcccccacgctcgcagctcgaggcctccaactaagtcgcaacccggcttctcccacgcgatggctaccgacatgtaaaccccaaaatgggatgtctaagacattaattattcatgaaataatatcttttaattagtgtatggttcaccctttattagggttatgtgtgttgaagcattctactatttagagggataaaataataaataaatatatgttttgcatcgaaa

SEQ ID NO: 9842 - protein, 56 aa, Zea mays
  misc_feature: Ceres CLONE 456643
MTGRNQEITPYVRNYRRSPLRSNNCIELIMTVCVIASTIRGISMNPILAIAQDTLF

SEQ ID NO: 9843 - DNA, 1744 bp, Zea mays
  misc_feature: Ceres CLONE 456710
  misc_feature: Encodes the peptide sequence at SEQ ID NO. 9844
tatacacactgacacacctcacgcgagccgagacgcccagctcaccgccccaccgagtcccacagtctcagaggccacctcgagccccccctgccccgcaagccgcacccgccgctccctccgccatctgcgctgcgctgctctgctctgcggtgccaggctgccagccagtgccggcgcgcgcccgctgccgccccgacgggcccaccgttctcttctctccgcgctgcgcgccggctgggctgcaggtcagttaatgcgcccgtgacaggcggcgtcggggaggccaagggcggtgccgggttaatcccgccgtctctcgaggcggcgcccgcggaggaccaggcgggagggggagacggtgaggcgcggccatggggggcgccaaggcggaggacaaacccgccgccgccgctgcagaagattggtgctaccaatttggaaacaaggatgcatttgacttgaagcccccgaaaaaatcaccgatcgcgttgagaacggttgtcttcgctatgactatgttatgcgggatatctatttgctcaatgtgcatgaagcaactagggagtgatggctggtcaagagttgtcaagattgaagttgtggaacaaccatgtaataagtccattgctcctctttcggaggctcaatttgtgcgctatcctcaacctataacttacagcagggaggaatgcaagtgcaatgctgtccggtcctttgcaattatatcatcgcagcgatctggaagtggctggtttgaaacacttcttaacagccacatgaatgttagctccaatggtgaaattttctctagaaaagaaaggaggagtaacatttcctctataatagataccctggataaagtgtacaatttggactggaacagtagcgcttccaagaatgagtgcactgcagctattggcttcaagtggatgctaaatcagggcctcgtggcaaaccatgcggacgtagtcgactacttcaaccgaagaggagtctctgcgatatttcttttcagaaggaacctgctccgccagttggtatcacaggtagcgaacaaccacgacaggttacttaagcaactaaacggaacgcacaaggcccatgtccacacgaagcgtgaggcccatatactggcaagatacaggcccaggctcaacacgacgtcactgatatggcagctgaaacgagctgacgagtacactcgcgacgctcttgagaacctaaacaacacccggcacatgagcgtctactacgaggacgtcgtccgcaacagaacaaagctcttggatgtcctggatttcctcggagtgccgaggaggaagctggtgagccggcacgtgaagatacacacgaagccgctgtcggagcagatcgagaactgggacgaggtctacagcgccctcaacggtacccagtacgagggcttcctgaatgccgctgactatctagtataacatcacgtttctggatgtagatagtgtgcgtgtgattctttcgtttcttgtttgtttctggcagaaattttgatgcggggtaggcgccttttgccgtgcatggttgcattctcggtaacctgatgctcctgtaactaaccctccagcttctctgatctttgtatttgccttgggtgtttgctgatgttytttcaaactatttgaaaaaaaaaaaaaaaaaaaaaaaaaaaaaaaaaaaaaaaaaaaaaaaaaaaaaaaaaaaaaaaamcaaaaaaaaaaaaaaaaaa

SEQ ID NO: 9844 - protein, 360 aa, Zea mays
  misc_feature: Ceres CLONE 456710
MGGAKAEDKPAAAAAEDWCYQFGNKDAFDLKPPKKSPIALRTVVFAMTMLCGISICSMCMKQLGSDGWSRVVKIEVVEQPCNKSIAPLSEAQFVRYPQPITYSREECKCNAVRSFAIISSQRSGSGWFETLLNSHMNVSSNGEIFSRKERRSNISSIIDTLDKVYNLDWNSSASKNECTAAIGFKWMLNQGLVANHADVVDYFNRRGVSAIFLFRRNLLRQLVSQVANNHDRLLKQLNGTHKAHVHTKREAHILARYRPRLNTTSLIWQLKRADEYTRDALENLNNTRHMSVYYEDVVRNRTKLLDVLDFLGVPRRKLVSRHVKIHTKPLSEQIENWDEVYSALNGTQYEGFLNAADYLV

SEQ ID NO: 9845 - DNA, 1056 bp, Zea mays
  misc_feature: Ceres CLONE 457559-R
  misc_feature (78)..(78): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (809)..(809): n is a, c, t, g, unknown, or other
caccaatacccgccccccccccccccaagaagcagaaaagacccccccgccacgtgctccggcggcacagcgaaggtnagnnnnntcgattgggtaccgggccccccctcgaggtcgacggtatcgataagcttttttttttttttttttgtgcctaagttcatgcggggaaaagcgcacatttcaacatggatgtccataatacagagtagcctgtgactaatgagacaacatcgacctgacaaatacaatgcgcaattattgaactggttttattcgaaccattaccataagacaggctccacaagggcaaaggcctcctaaccaacagcttcagccgcaattttggatgtgtaggtgtaattgctccgtcaagggacatggacgcggatgattttggtcgagacagatgtaatgaggacacgttaaatgaagatatgtagtggatgtgggcgtgacttttaagaaagtctttgtagcgggacccatacggccgggcaggagcccccagcccttctcactataccagatacgcccaccaaagacacgctatacgccaagacccacaaaacagtaattctccaaatacccactcacatgagatagacgaaggtaaacatccgagtcgacaaaatggcagccagcttcttacacccacatcccacccccctctacaatcaatctcccacacccttcctccttcctacaacaacccgcgtacagacgcaagactactcacccacggacgcatcacgccttacgagcactcaagtatgtgaccacagtggggcaaaactacgcgccgaagntatgagtagacccgggggagctctgtggtcagagcgccgtggctggcgcgtgaaaacacctcatagagttgtgaagggtggggcggatgaacagcggcctgggatctttcgcctgctcatttgggctgtgatgtgagaggtgcgcgtggaagagcgcgtggggagagggaggcggggtgggcgggtggggcggtctgcggcggtgggataaatacaaggccagggcagagcccagctgggagctaga

SEQ ID NO: 9846 - DNA, 933 bp, Zea mays
  misc_feature: Ceres CLONE 457607-R
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (78)..(78): n is a, c, t, g, unknown, or other
  misc_feature (79)..(79): n is a, c, t, g, unknown, or other
cggcgagagggcgggggcggggggagggtggatgttccggctcccccttcgctgccgggggaggnnnnnttttttttnntttgctattgggtaccgggccccccctcgaggtcgacggtatcgataagcttttttttttttttttttcgcaactaaattgtcatcagttttatcattgtccatcaaaatcctccacacaccttgttcaaagaaactaagctacaacacttgacatggaacaccaacagaatcatctgattgattgggcaaacacatttcagatgaaaagtgcagcctacacgatcaatcaatcaccctgataatgtgtgcaaaacactgggcagaattacatagccgtataacacatggaaatgcaacatggggaaaccacaagcccactggacagaatcacgtagcacggcattgaagcaacaggtctcacgcattacatacaagacaacagtccaccataaacttatgctggctggtagcctctcccaagggagcagagggtacccccttcaagcttccttggggcaattcttcaagtcagttcaagcaacaccttggcaatcttgaaaagagtacaccatcggggaacttgttatgaaccgccggggtccccccaaaccaggggaaaaacccaggggagtccacccaatgccaggggccagaaaccttttgtgggcccttcgtgccggggaaaacctttatgtttcgaagggagaagggaaaggtgtcctttcgaaccgaaaaaggacgtcatccgcagggggtggggaaataactccccagaaaaaattgtccgccctgccccgccgcttttttttacccaccgattggaagaaaacaacccctttgtggtcgccctttttaggggggatctgcgaaaaaagagagagtgtacaggacgcaaaaaaccaagagtgggaa

SEQ ID NO: 9847 - DNA, 628 bp, Zea mays
  misc_feature: Ceres CLONE 457712-R
cgattgggtaccgggccccccctcgaggtcgacggtatcgataagcttttttttttttttttttggagactaactgtaattttcatggtagttcgctgtcggtaaacctagtagaggtcgtcaatggatcttcctcctgctatttatcgtaacaaaataaaagccacctatctaaatattcatcgtatacataaggccgttggccacccgttaatgagcgtgagatcacttttccaacctccaacacttcgaataacacgatcatagtactaagcatttacagtagtagatttctgacagaagaatccaaccaagacgactactagttccacaccacatcgcgcccttcacccagatattttccgctcagcgttcttcatcatgagaacgaactcatcgtagttcacctgaccgtcaccgtcggtgtctgcttccctgatcatctgttcaacctcctcgtcggtcatcttctccccgagactggtcatcaccgtcctcagcttcacacaccaagtcaccaacacgaaagcaaggatgaatggaaacagctagctagcatggtccgaggttgccgaggcacaaagagactacctcaaccggggagatgaagccgttctggtctttgtcc

SEQ ID NO: 9848 - DNA, 1983 bp, Zea mays
  misc_feature: Ceres CLONE 457965
  misc_feature: Encodes the peptide sequence at SEQ ID NO. 9849
atccctaccactgacaccatgtccgcccgcatcgacctcaacaacaacgccggatccgcctcccaaaccctggcggcacacaagcgcggccgcggccgcccccgcaagaaccccccgccccccgctcacccgcgccctccgcatcccgacacccccatggtcagcggcttcgctccgggcgacatggtctggggaaagaagctgaaccacgccgcctggccgggcctcatctactccgccggagggaacggcaccggccacgagggccagcttctcgtatcctactttggcgacaaggccttcgcctggtgcgacacagccgagctcaggccctatgaaccctacttccctgtcgccgagctctatgacgacggcggcgaggatttcgacgccgccgtcgaggcctccctcgacgagttctccagccgcgtcgagtccgccctcgcctccgccgcccgccctttcgcccccgccgatttccttgcctcgctccatgatctcgccgcggatcgcatgggcttcaccaatagggtgcaggccgccgtcgtcaaggcgcatctcagagccttcgacgccttcagggctctgccggacccacctcagtacaccttggagctcggtctactcccagacgtcccgctcccgctgcccaatcctaaagctgccacggatgccgccttcagctcctacaccacccccgcttccagtttcaggaggggcaggaagaggaaggaggaactcatcaaggacgatgactccgatgaggactgggaccctagcaagaggggtgccaccgacttggattctgatgtggactttgactgcaggagaggatccagaggcaggggcaggggcggcggcggcactggtgcgtcgcgtggcaggcctcgagggaggcccaggaaagcagatgcctgcatggacgaagatgagattcaagacaaactggagtatccgtcggctgctgagatgttgctgcagcttctgtccatcgccacggatcctgtaaatgtcaattatgactctgctcctgtgattgttagcttcttctcaaagcacaaggactccgatgtgcctagtttatatgaagacaaagaactgattgagaattttggtggcaagaagggtaagaaaaagtccatcggaagcttgggcccagctacaaagccagaagccagcgatgatactgtggatggtcagaggggccgtaggaagtctgctgggagcttgtactcagctagaaaggccgaagattcatattggtgtgatattatcatcagcgatttcgatgacggagacagtgactatgacagtcacaagaggaagcggccctgtaacaggagcaccaataagaagatgaagcaggaggagccacctcaaggagccccatcatcgaatgcaaaacctgcagatggtccagccgcccttattctacatttcagcagtccagaagctattccttctgttgatgacatcaatagcatattccgtattcatggacctattgtggagcgtgagactgtgatcactaagaagtcaaagattgcaaaagtagttttctctaagagtgttgatgcagagcaggcacatcacagttccggaaagcgtaatgcatttggtccatcgcttctcacatctgaaattaagtacttgccatcggcacctcaggtttcttaaatgccgcagtctggactggtggatacgccgtggaaatgcgccatgaagcttggagcaacggagcataagttggtgtcactgactttactgaccaggtcacagtagtcactgagttgagtgagcaaattttaggctttctgtggttacatgcatccatttgactgattgtcgacccggagtttgttgtttatgttgatagtagattagattatgtagcatgatgtgcttcctcttatgctagcaacttttttttggtattgcctagtaattgcacagctgtggatctctctaaaaaaaaaaaaaaaa

SEQ ID NO: 9849 - protein, 552 aa, Zea mays
  misc_feature: Ceres CLONE 457965
  misc_feature (50)..(121): Pfam Name: PWWP Pfam Description: PWWP domain
  misc_feature: SWISSPROT Homolog: EC 2.7.11.1 Non-specific serine/threonine protein kinase
MSARIDLNNNAGSASQTLAAHKRGRGRPRKNPPPPAHPRPPHPDTPMVSGFAPGDMVWGKKLNHAAWPGLIYSAGGNGTGHEGQLLVSYFGDKAFAWCDTAELRPYEPYFPVAELYDDGGEDFDAAVEASLDEFSSRVESALASAARPFAPADFLASLHDLAADRMGFTNRVQAAVVKAHLRAFDAFRALPDPPQYTLELGLLPDVPLPLPNPKAATDAAFSSYTTPASSFRRGRKRKEELIKDDDSDEDWDPSKRGATDLDSDVDFDCRRGSRGRGRGGGGTGASRGRPRGRPRKADACMDEDEIQDKLEYPSAAEMLLQLLSIATDPVNVNYDSAPVIVSFFSKHKDSDVPSLYEDKELIENFGGKKGKKKSIGSLGPATKPEASDDTVDGQRGRRKSAGSLYSARKAEDSYWCDIIISDFDDGDSDYDSHKRKRPCNRSTNKKMKQEEPPQGAPSSNAKPADGPAALILHFSSPEAIPSVDDINSIFRIHGPIVERETVITKKSKIAKVVFSKSVDAEQAHHSSGKRNAFGPSLLTSEIKYLPSAPQVS

SEQ ID NO: 9850 - DNA, 684 bp, Zea mays
  misc_feature: Ceres CLONE 458040-R
tcaattgggtaccgggccccccctcgaggtcgacggtatcgataagcttttttttttttttttttaatttttttttttttttttaggtaaactttatgcagacgatctatatcacttcgaagagttcagataaaaacaaatcatccctaatattcacatcctagcatgtctaagcttacgccactggtctgaaggcccaaacagaatgttcgcggaagcagagtgccatcgcaaaatgttcaggcgaatgctggtggaaggggatcaattgagaccgattggaacattcatcgggacgcgcactttttcgaccccctcatgcagcttcacgcccagctggcctctgacccctcctccgaagggacagacctccccccggagtccggggacgggaattttttcccggtggcccattttccgaggttcttccacgaacaagggcgtttgggggggctgaaattggcccgaaccttctttgttcaaaacccttgagggggagtcgaacaattcctcgggggggcgaggaaaatcggggttcctcccctccggcccctatcgtttccaaattggggaaggcccaagggatttcccccgggtacttcccaagggggaggaggaccttccccccctttttcttaggcgggacggaagaaaacaggcgtgtgtgaatgttgtcccccccgg

SEQ ID NO: 9851 - DNA, 668 bp, Zea mays
  misc_feature: Ceres CLONE 458104-R
  misc_feature (324)..(324): n is a, c, t, g, unknown, or other
  misc_feature (366)..(366): n is a, c, t, g, unknown, or other
  misc_feature (402)..(402): n is a, c, t, g, unknown, or other
  misc_feature (404)..(404): n is a, c, t, g, unknown, or other
  misc_feature (647)..(647): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
caattgggtacgggccccccctcgaggtcgacggtatcgatattttttttttttttttttcgatctcacggcaagaagcatcatatgctcttgaacgatttattacacaatgaacaatcgccaatgacgtagaggggccagtggcgtttatttattaaaaaattatgcagaaaccgaacacgtaggcttgagcaaaggccaccgccttaatttgcgatcgatcgacatcagaagggcgcctccgcggacggcgggcgctgcaactccttgaccctgacccaagagtcgcggcgggatacggtgtcccaccacttgctgacgttnctgcgcgactccatgaggcgtgcggaccgcgggtcgccggcnaagcggtcggcgttgggccaggtggggacaaggtcngncaagccttgaaacctgcctccgggccagggaaaggcctctcctcccccaaaggccccgcctccataaaatttccaaaaaattttttgcccaaaattggccctggcgggtttttttttccaaaaaaaggtgtgaaagaattttccccccccccccccttttttgtccccgggtgggcccccccgggggttttattttttttccccccgggggtgcccccccccccgggggggaggggggggtgncctcnnncgcccccccccctg

SEQ ID NO: 9852 - DNA, 802 bp, Zea mays
  misc_feature: Ceres CLONE 458178-R
caattgtgtaccgggcccccccctcgagtcgacggtatcgataagatttttttttttttttttgtaaaaatatctcaatctgacgcatcactagctcagaggtttcagaaggttctacaccgcagacaaattataacttaagggctagtgttgagtcagattgagatattttgtacaaaaaaaaaaaaaaaaatcttatcgatatcgtcgacctcaaaatatcaaaccttttaataaatccacaatgccaaatgtactcctttgctaccctaaaaatctaccaagaaaaaagcccaccggcgtccaaacatacatcacatgaaacacaatcaaatcccttaccaagagaaaacttttttacctacaggcaaaaaactatgaacaaatgattttttattttctcttgcacaaataaccatttactgtccccccccaccaacaaaacatagcccttcctgtgcaaataactcaatcacaaataccacctctttctttccataattagaaaaatttaacacttttgtttatcaatactataaaatatttcatactccgccatatattaaaacaaaatttgctaaaaataaacccacctaaatgcgcatgttggataccactataaatatccaaccacatacactcacccaatatggtaaagggatactcacacatttattcccaaacgctaaaactttattacttaccccttacctttcctcataaaatctgagaaggtataaaaattaaccgaaaaacagcagtaattgaaaacatacaataaataatcttagcgataatctcg

SEQ ID NO: 9853 - DNA, 629 bp, Zea mays
  misc_feature: Ceres CLONE 458207-R
  misc_feature (237)..(237): n is a, c, t, g, unknown, or other
cgaattgggtaccgggccccccctcgaggtcgacggtatcgatattttttttttttttttttcgatactaatgtgatacataaattatattctatgcataatatatctccatgccaagtatcttggaggactggcacagggggcagatgctcagcttgctctcgcactccttgcatagacaaagatgccgacacggcagcaagagcatgcatgcctcacttgatttacagaccctgncagccgttaaattcttcggttgtctgttctcctttggcatcagttgcaaattgacagcaccaccatagggacagggacgccgtgtcatctacctcgctatcaccgcaggctttccttgaaatcctttgctcttggtgagcacataccttggtcccaagttgtccctgaaaggcatttgatccgggcttctcattgtacttgggcccttttgctgcgcaaagaaccaactttccacttccccaaaagggttaaaaccgggcccccctccagttccaaaaattccctttttgttgaagggggttcccccttcccccccccccttttttcccccgaattttttctccaaaaaaattttgtgcccccccaacgtagaaggccccggggccccctaa

SEQ ID NO: 9854 - DNA, 668 bp, Zea mays
  misc_feature: Ceres CLONE 458823-R
  misc_feature: Encodes the peptide sequence at SEQ ID NO. 9855
  misc_feature (1)..(1): n is a, c, t, g, unknown, or other
  misc_feature (404)..(404): n is a, c, t, g, unknown, or other
  misc_feature (407)..(407): n is a, c, t, g, unknown, or other
  misc_feature (461)..(461): n is a, c, t, g, unknown, or other
  misc_feature (470)..(470): n is a, c, t, g, unknown, or other
  misc_feature (476)..(476): n is a, c, t, g, unknown, or other
  misc_feature (571)..(571): n is a, c, t, g, unknown, or other
ncgattgggtaccgggccccccctcgaggtcgacggtatcgataagcttttttttttttttttttgcccatccgtcgtccatggcagaaccggcagacggcagtaaccgcccaccattaaaagaagaagcagcagcagcagacagagagagagagagagagatcgcatgacacggccacgggctgggcagcagagcgctacatatacccaccacgccacgcgcttccttgtcagtaggacagtagtcagtcgagtcctcctccctcccccgcggccccgccgcccgtcacaccaaaccttccatccacctcttcctccggcctctcaccggcaccacacgcacctactctcagtcacctcacctctccgcgctttgtcggcgttccggcagggggacgatggcnaangcgaagcggcaagccgtgctagcagcgctgctagtgctgctgctgctggcggcntgcacggcngcggcngccgccgtgaccgtgtcgcgaaagcagcggcagcgggcaccaccccggcggggcgtcggcgtccgcggggcggtcctgcgaaccccttcccggcngcgggccctttgggtggaggaacgggtcttacccggttcacgaatcggggggctggccctctttcgtcggaaagaaagtccccgtgggcccgccctt

SEQ ID NO: 9855 - protein, 90 aa, Zea mays
  misc_feature: Ceres CLONE 458823-R
  misc_feature (3)..(3): Xaa is any aa, unknown, or other
  misc_feature (58)..(58): Xaa is any aa, unknown, or other
MAXAKRQAVLAALLVLLLLAACTAAAAAVTVSRKQRQRAPPRRGVGVRGAVLRTPSRXRALWVEERVLPGSRIGGLALFRRKESPRGPAL

SEQ ID NO: 9856 - DNA, 1059 bp, Zea mays
  misc_feature: Ceres CLONE 459250-R
  misc_feature (23)..(23): n is a, c, t, g, unknown, or other
  misc_feature (27)..(27): n is a, c, t, g, unknown, or other
  misc_feature (32)..(32): n is a, c, t, g, unknown, or other
  misc_feature (1059)..(1059): n is a, c, t, g, unknown, or other
tttttggttgttttttttttccnccgncgcgncgggagagaggggacacgacaaggaaaaacgagtataaaatatataaaattttacgattgggtacgggccccccctcgagtcgacggtatcgataagcttttttttttttttttttggtcaggacatatcattaatacaacctagaaccttgtgttgtaatcacagtatataatacatacaaaagcaatgaactgactaactccagacacaaccaagaaatgaatatcgaactgggggcggcaaagtgaagttgaatatgtaaaaggctgaaaaataaaactgagttctactggtaacgtgcatgaagaggggatagaacatgtcgcggctttaagggcaaaaatagagataagatacaagcctaaaggagcaactagaactgttcgactaaatttggatatcagttagaactaacctcagcttgaacgcgtcacccgaaacagagatctttattggggggagaatagtttaagatataacccccccccccccccccacagaagtgcaagaggcatgttgggtatgtctagtagtgattagataaggcagcaaattacaaatcgttgagggataaagccggtcaatgtggagaattagaaaagagggactctggaatactagatatactcaatacatacataatgcagactacggtagcgaacccgcggtgataaatagtgaaaagccgctgtatgatataaggcaggagaataccaatcttatatcactgtaagaatattggacatcttcaatccatataatgagataagaacaacaaagatgacaagatggagcctttgcttattcctggaaggaaacacgccgtttgcgagcaaatcgaaagacagaaaacagataatggaaaagaaagcgggtcagttcggaggggaaattagggtgggcagatccgcgattgggccgacgcgcgagtgttacatcgatagcaacccgatgttggtgtaatgagccgattaggtacaagtgcgctaggttactgaaaagatataaatataacattaatgaaan

SEQ ID NO: 9857 - DNA, 651 bp, Zea mays
  misc_feature: Ceres CLONE 459310-R
  misc_feature (467)..(467): n is a, c, t, g, unknown, or other
  misc_feature (608)..(608): n is a, c, t, g, unknown, or other
caattgggtaccgggccccccctcgaggtcgacggtatcgataagcttttttttttttttttttgaattatctcttcatacctttattatacagtcgccccagcccaaaggacgtgtgatgtatctcgatgtcattagtattgacaaccttgttgtacctacatttccctggattagattacatgcatacctacatatttacaccctcgacagagcaaccaaccaacggaattgactccctgatttctgttacatctgtgcttaaacatcaccagctggtgtcaaaaaactatgccatgagtaccggcaggtggacgagaagatcttatgattgctctccgaattcggacccgtatacacattcagatgtcgaagcgctacaaaaatgagggtgtccagacctgtggtggtgagagagctaggctcttcttccgactgttgaccgttcccgctactgtgggcaacgntcctcctaaacaaaaatccctagcccaggtgagttaggatgctataaatttgccagctgaatatacgggggcagcaacccttcccaaggatggatcagggccgtccttcaatttggtaaaaaaaacaaaaacctgcttagncccgatagaattcggttgatggaaacccttgtaataagtacca

SEQ ID NO: 9858 - DNA, 706 bp, Zea mays
  misc_feature: Ceres CLONE 459526
  misc_feature: Encodes the peptide sequence at SEQ ID NO. 9859
gtgtggccgcccgtgtcgtgtagtgtgtagtcgcagcagctagcgcccggccggccagtcgagtgagtccatcctccatcgccatccaatggccgccaccgccctgagcatgagcatcctccgcgcgccgccgccctgcttctcgtccccactcaggctcagggtcgcggttgccaagccgctggcggcccccatgcggcgccagctgctgcgcgcgcaggccacctacaacgtgaagctgatcacgccggagggggagatggagctgcaggtgcccgacgacgtctacatcctggacttcgccgaggaggaaggcatcgacctgcccttctcctgccgtgcggggtcctgctcctcctgcgccggcaaggtcgtctctggctccgtcgaccagtccgaccagagcttcctcaacgacaaccaggtcgccgacggttgggtgctcacctgcgctgcgtaccccacctccgacgtcgtcatcgagacgcacaaggaggatgacctcctataattctagctagctatacaccgccagggcccgtcgtcttgtgccaccacatgcagtaccgcccgcgcaggagatgagacgtgtcgtctcaataattctagctatatatatatatatgcatgcatgcatgtacttttccctgttccaaactgagtatattctaaattacaagatttaatcaaaaaaaaaaaaaaaaaa

SEQ ID NO: 9859 - protein, 140 aa, Zea mays
  misc_feature: Ceres CLONE 459526
  misc_feature (52)..(127): Pfam Name: Fer2 Pfam Description: 2Fe-2S iron-sulfur cluster binding domain
MAATALSMSILRAPPPCFSSPLRLRVAVAKPLAAPMRRQLLRAQATYNVKLITPEGEMELQVPDDVYILDFAEEEGIDLPFSCRAGSCSSCAGKVVSGSVDQSDQSFLNDNQVADGWVLTCAAYPTSDVVIETHKEDDLL

SEQ ID NO: 9860 - DNA, 646 bp, Zea mays
  misc_feature: Ceres CLONE 459568-R
acgattgggtaccgggccccccctcgaggtcgacggtatcgataagcttttttttttttttttttggccaggcattcaacctagagctgcagcccttctattgtaggagtgtcagataccagggccgttacaagtgcatttagaacatccatggccagcaaaagatcccggttctatgttcccttattcacccgacaacgataacccatcagaaattccaataacaaagttcaggaccagtagttgatctgtgtatcgtataataaaaatactaaataaatgccacttaagcatgatggaatcagttaaccgtccttctcttgagaggcatttagacgactcttgatccacgactcaagataaagtagctcttcctgcgaaagcgaatggcacagatctggatatgccttgaatccacagttaacacccgcgctttgcaaaaacggtggaccagcctggccagcttcaaacaatactactttgtcagccattccatgtgaccagaaaaacggggtcttcctcgcttcaggtgaaatcctctcagtgactgatgaactgaaaggcacccacccactgaacactgttcctccacctaacttcttcggataaagcaaaacgctagctaatgtcagagcacctccttgac

SEQ ID NO: 9861 - DNA, 623 bp, Zea mays
  misc_feature: Ceres CLONE 459832-R
  misc_feature: Translation starting site: 392
tcgaggtcgacggtatcgataagcttttttttttttttttttgaccataaaaatcttgaaatccgaaacccacgctaacattcagtaactaaaactgagattttactgataataaagtccgccgctagaactttttatatcagtatagtagtatcctagtgaaaaatgtaccataggttaaagagcccccaactgttgaaggacatcagcctccgtaacgccaggtccaaaggcggcaagctggcgctcgatctcctccagctcctgcacacgtggatccaccgcgtcctcctgctgctggaccaggaacctgctcatccgctcaagcagctgcacggccttcctcttccccctccccgtgccattcagtgccagctcccgcagcggggccatgatgccgcactcctgcgcccgagacagatgcgcggactgccgcacgctggcggacaggtgcaacatcacggcggcagcgttctccctgttcctcggcgacccacccgcgatcatctccacgatgacggggacaggctccgccgccccgatcgcggccttgccctcggagtggctggacagtatcgaccggatcgccatgacctcgtccaacaaagctccggtgggggttg

SEQ ID NO: 9862 - DNA, 653 bp, Zea mays
  misc_feature: Ceres CLONE 459940-R
  misc_feature: Pfam Name: MS_channel Pfam Description: Mechanosensitive ion channel
acgattggggaccgggccccccctcgaggtcgacggtatcgataagcttttttttttttttttttcattaccaagtgatgaaatcaattattcaataccatctgtaatagaatgacaagcatcaggtaatataactgagatgaactaaagatatctgagatggactaaagataactatggagtacttggaccaacaacacaataactacaggaaaaagctcaagtgatggctgcagcgacagcaaaacctgttgccgcctctcgtcagaacgctgtcacagctcaactcactcaggaactactacctctagcagcacaaatctcatctcatctcaataactaaacgtccatgtcgacggcatccttgaggactggatggcaggcgcgttccggacgttgatgtcgagcggcagcatccggtactcgatctcgaggtctctcaggaccttgatcatctcctggagcagcagctctctccgctcgaacctcatccccatgtcgtggaagttgatcgtctggcgacaccagatggaggccttcagcttgttcgtgtcgtccacgtcgcgcaggaccaccatggagccagggtaccagtgctccttcttgttgtcaaggtaatgcatcagtctctccttcatgagggacagtttctc

SEQ ID NO: 9863 - DNA, 950 bp, Zea mays
  misc_feature: Ceres CLONE 459957
  misc_feature: Encodes the peptide sequence at SEQ ID NO. 9864
acccgaaatcgaatcgaaagccaccatctatccatagaggtgcgaggccatggcggcccaggaggcggttccgatcgacgccatcggcagccagctggagataagtctcgtcgggctggagcacgcggtccttctcactaacaatctcgacctcgccggacagaccttcgtcgtcgaaaaagtccaggtgcgccaggcgccggccttgcttgaggtcatccagagggccgtctgccatcccaagaggaagtgggtggtccgcatacccaacaccttgaagttgcgccacatcgccaggatttcgaatgagatcgaggtggtcgttgccgtcgtgatccctcaactgctccgcgacaatgttgaccccaccggcgcgcgactcctacgccgctacgcttggtccatctgtcatgcggcgaggaaggtggatggcgcccccaggattcctggggtatctgtcagcgtccgcgggcctttgtggtccctggctgctgatgccgccaagccgctcctgcgatactccgcctatgttttcagcgcgaacaggagcaaggcgtggtatgaggccaacgtcaccaagctcgcccccgccatcaccgtccttctggactacgtcgtcaacattccgtacagcttcacagtcgacgcggctgacgacgatgacgacagcgacaacgatgacggcggtgacgacgacgacgagcacatggagtagtcgtatgccgtcatcgatcccctccccctcctcggctcccctcccccgtctagtaagtagtgtagtatgtttggaacaatatggagagagtgttacagttcgtctgtgatgtggcccatttgattactaccgaacatgatttggctgtgggcaattcacttgcatatcctctggcaataattcacttgcaaaaaaaaaaaaaaaaaaaaaaaaaaagaaaaaaaaaaaaaaaaaa

SEQ ID NO: 9864 - protein, 221 aa, Zea mays
  misc_feature: Ceres CLONE 459957
MAAQEAVPIDAIGSQLEISLVGLEHAVLLTNNLDLAGQTFVVEKVQVRQAPALLEVIQRAVCHPKRKWVVRIPNTLKLRHIARISNEIEVVVAVVIPQLLRDNVDPTGARLLRRYAWSICHAARKVDGAPRIPGVSVSVRGPLWSLAADAAKPLLRYSAYVFSANRSKAWYEANVTKLAPAITVLLDYVVNIPYSFTVDAADDDDDSDNDDGGDDDDEHME

SEQ ID NO: 9865 - DNA, 839 bp, Zea mays
  misc_feature: Ceres CLONE 460020-R
tatctcgaaacggataggatttgctgtttaaccagattgaccatggatgaacataacccatgacggagatgaaaaatgcattgtccagttggcttcctcaaccaattccacacttattagagaaaactaggaaagaaaaactaagaactcggcatgagagacgtcaatgttttgttgtcacgctggtgtgctcagtagaataggcatcactcgatgtggttcagctcttctggcctgagaccttgtcctcccaccagtagatgaacctgaggttggccccctgcttgtccatctcgtagagctggtaccagtggtccgccacctcggatcccagcacggcgccggtgatcgcgccgaagccggtcgccagcaggacgccgtgcggcgccttggagtacttgagcgcgacgccgccgagatcttcgtaggccctgaggccggcgaagatcttggcggcgatcgcgcggcgccggcgctccctgcggcggttgttctcgcgctccctccacgtgggcaccctggtgcccccgatcccggccgcggctcccccggcgccgctcgtcatcggcggcgcgccggatctcgcggatctgcacccctcccccacggctgcaagcctgcaacccccgcggtccctgttcccttgcggacgctgctcacctcctcgcttgctttgatttgtttattatttgagggggggtggaattttttttcgattaggatgttggtaatggtctcgtgcgaattcctgcagcccgggggatccactagttctagagcggccgccaccgcggtggagctcccagcttttgttccctttagtgaggtttatttgcgcg

SEQ ID NO: 9866 - DNA, 906 bp, Zea mays
  misc_feature: Ceres CLONE 460022-R2
  misc_feature (1)..(1): n is a, c, t, g, unknown, or other
  misc_feature (812)..(812): n is a, c, t, g, unknown, or other
nccaatgaacactgcttgttaggttatcatgtctcagttatacaggactgcgcctccgcacatataactcactatcgaaaacaaaccgcaatgcatcagtctggcaacacacgcaacatgttaaaacgctctaactgttgtatgcctgggaccctctaatcactcactcaatcctaaacacatactccgcctctagtgacgttactaccaccctaaagttgtcttgcgacaccacaggaatcactctaatcagctactacatccaagccacaaaagctatgcacatgatcccccctctgatgaaaaaactgatacgctcctacctgcaacccatccatgctgcactcaacaaggccccgggggtactcctcacccttatactagcacacaataagtcactcacggccaccccatccgtaagactcttttttctgacccctaacaactccacccagctgattctataccagtgaaccctagcaaatgattatgctctaagcatcgaggccatctcttgataacacagccatcaacccacataccttagaaagtcgctatgcattgagaaacatgtcttcgactgcgaaaacttctacatgaccgcatcatgtcttcatcataccctacgatctgatcccacatcctgctactcaagatgatctgtcaacaatcttcctagttatcatcactcgtagtcttgcaagagcctaccatagccatagcatgactgcactcaaaataggtgaataatggtcgactcatgatatcgtttaaataacccatacgtctaccacatgttcaatctttatgcnagccgagttctagtgctttcttagtctcatgcaccgcaaaacatactttcaatggactttatgagaaatggacccacatactggggttctgccg

SEQ ID NO: 9867 - DNA, 917 bp, Zea mays
  misc_feature: Ceres CLONE 460022-R3
  misc_feature (1)..(1): n is a, c, t, g, unknown, or other
nccgattgggtaccgggccccccctcgaggtcgacggtatcgataagcttttttttttttttttttgggaaaagaaacgactgcttgttaggttatcatgtctcagttatacaggactgcgcctccgcacatataactcactatcgaaaacaaaccgcaatgcatcagtctggcaacacacgcaacatgttaaaacgctctaactgttgtatgcctgggaacctctaagaagtcactgaacccgagatagattgcccgactctagtgacggcactaccaccctaaacgtggcttgcgacagcactagagccaccctaaccagggactagctgagggctcaataggtatgctgatgatcccccatgtgatgagataaccgagatagtgtgatctggcatccgattcatgctgcactcaacaaggttctcgggggtgctccctgttcgcttatagcgggcacacacattgggctacccatgggctcccacatccggaaggactgttgcttgcttgccccccgaaaaactgcaaccaagctgaattctggtccctgggtacccctctgaaaacgggttttggccgtaagccccccagggccggctccttgaaaaataaagcccttgaacccccccatgtcccttaaatatgtcgccccttcccttgggaaaaacctgttatttggggcgggggaaaattttgttaaagggacctgtcccaaagggtttaaaataaaacccctggaagtgtaattcccaaagcccggggaccccctataataaaagggggaaaaaaaattgttcttggttttaaatacacactggagaccttccgggaaggcccccaaaaaagcgaagggataaattggccccaaaaaaatagggtgtaaaatattggggccaccaacaaaataaaatttg

SEQ ID NO: 9868 - DNA, 830 bp, Zea mays
  misc_feature: Ceres CLONE 460022-R
  misc_feature (1)..(1): n is a, c, t, g, unknown, or other
  misc_feature (576)..(576): n is a, c, t, g, unknown, or other
  misc_feature (740)..(740): n is a, c, t, g, unknown, or other
  misc_feature (764)..(764): n is a, c, t, g, unknown, or other
nagaattgggtaccgggccccccctcgaggtcgacggtatcgataagcttttttttttttttttttgggaaacagaaacgactgcttgttaggttatcatgtctcagttatacaggactgcgcctccgcacatataactcactatcgaaaacaaaccgcaatgcatcagtctggcaacacacgcaacatgttaaaacgctctaactgttgtatgcctgggaacctctcatcgctcactgaaccctaaaaacatactccgccatctagtgacggtactaccaccctaaagttggcttgctacaccacaagaatcaccctaatcagctactacatcgaaggcacaaaacctatgctcatgctcccccctctgatgagaaagatgagaaggtcctacctgcaagccattcatgctgcactcaacaaggctctcggggtgctcctcaccctgataccggcacaccattagtcacccatggcctccacatccggaaggatgtttctcctgcacccgaacaaagtcacccagctcactctgacactgtgaaacccagcaatcggatatgctctaagcatcgnagtccactcttgaaacaaacgcgtcaaaccacataacctgaaatgtcgctctgcattgagaaacattcattcgacgcgagaactcgtcatggactgtacaagtcttcataaaagctagattgaagcagatccggcacccaaagaatgtaaaatttcttagtaancacctgatcttggaggctacatancaagcatactgctcaaaaagggataatggccaccagaaactttaaaccctatcctaactgttatct

SEQ ID NO: 9869 - DNA, 673 bp, Zea mays
  misc_feature: Ceres CLONE 460062-R
  misc_feature (264)..(264): n is a, c, t, g, unknown, or other
cgattgggtaccgggccccccctcgaggtcgacggtatcgataagcttttttttttttttttttgccaacgaaaatacatgcatcacaataaaagatggtcaaacacagaagattatactactaagaaccttgcctttatgtatccagaaatacacaattatatagctagcatagacaggacatgttacttagatgggtcttaaaaagattagggaaaaaaggtcctagtaatgacttcatctactatatgtataggggtatangtaaggggcatcatccattcatcctcgccttcctcttgaagggataggtagctgggtgcctcatggagtagtagtactctagtagtacatgagctgctgctgctgctggacggaagatgtgccggtggcagtattgatgccctggaagccgccatcatagatggactggctggctccgccgccaatccccaatgcagcgacctgcttcaaggcgtgctgacccattagggctgggttcgaggccatcttgctcagagtcaggcgctggtaggccagcaagtcggtggccgacactccagtggagaatggtgccagtgctgggggaggcagaggcaaggatgctgtcccttgtggagtcggcttgcttcccaggaacactttatctgcctcccgccaataagttggccat

SEQ ID NO: 9870 - DNA, 947 bp, Zea mays
  misc_feature: Ceres CLONE 460248
  misc_feature: Encodes the peptide sequence at SEQ ID NO. 9871
cacaccattacattacagcaaagcagagcagggcgaaagccgctgagaagctccgaggaccggcagcgacgacaggtcaggggaagcaagagccgcagcagcagcagcagaaacaatgaggccaggaggagcagggttcaacgcggcggtgaaggtcgcagccgcaccagcggtcgccggcgccggcagcgccgccgcgcattccgcgtggcactcgccggtgccgtaccttttcggcgggctggccgcgatgctgggcctcatagccttcgcgctcctcatcctcgcgtgctcctactggaagctctcagggtacctggagggtggcgccggcgagggaggttccggcgccggcgccggcggcgacaagccagcggcctcggacctgccgccgccggtctgggaggagaagatactggtgatcatggccggggacgtgaagccgacgtacctggccacgcccatgtccagcagggcctcctccttcggggaccgcagcagcagccagggtggcgagcaggaggaggaggagaagaagagcaaggtgcaacaacaagtcgccatggccagcgtcgtcaaggacgccgaactgaacggtgagcgcagcgagagccggcggagagaaggagaggagcgccatatccctgaggtgtgatccccacttctgaaagaagttagattaggtattgtctcgggttttccatcggtggagtggaatcgtgatggccagaacgtaacagggcagagcattttttttttcttcttcttcttcttggtttgctcagagaagctgagcgcttgcgcttttgtgacgctgtaaacccgtctccgagacaaaccccgacccaagcaaaattttgtgggggctgtaaaatttttgcattgatgaatcttaagaacgggactgacgcggccgtaattttgctcagacaaaaaaaaaaaaaaaa

SEQ ID NO: 9871 - protein, 179 aa, Zea mays
  misc_feature: Ceres CLONE 460248
MRPGGAGFNAAVKVAAAPAVAGAGSAAAHSAWHSPVPYLFGGLAAMLGLIAFALLILACSYWKLSGYLEGGAGEGGSGAGAGGDKPAASDLPPPVWEEKILVIMAGDVKPTYLATPMSSRASSFGDRSSSQGGEQEEEEKKSKVQQQVAMASVVKDAELNGERSESRRREGEERHIPEV

SEQ ID NO: 9872 - DNA, 1826 bp, Zea mays
  misc_feature: Ceres CLONE 460267
  misc_feature: Encodes the peptide sequence at SEQ ID NO. 9873
acttttacggaaacgcccacaccgccggctcgtcttctcccgaacccgaacccaccctccccgattcaaaccgtcgccgccgtcgccgagagagtcgtgactccccccagcggcggcctgcgaccacccgttacccagccgtcccttctccgcagacagcatttgcgcccaccccgtcccgtcccgtcccctctccctcgcggaggcccgagagctttgagctgcctcggttaagtcgtcgagtggtccacagggccgccgccgcggcggcggttacaaagcggggagggaattccggcgcgggatgccgcgatcccgctgcgatgcgcggatcagaatatgggtgtgacccaaccgggaagtagtggacactgctggtggaggactagggcctggagtgggagagagctgcggccgcgacgatgtacgtcgcgcgggagtctaccaagctgtggaggagggtgtgcgcggagacgacggcggagctgcagctcctgctccagaagtggcaactgctacttgctgggttggtatttcagtacatccatggattggctgctcgaggagtgcattacttgcatcagcccggaccactgctccaggacttgggatttatggcccttccagagcttggccaagagaaaggttatcttagtgaaagcgttttcactttcatcttcatttcctttctgttgtggagttttcacccttttatttatcataacaaacgtttctacactgttctactatggcgaagagtgctggcatttctagtggcttcgcagtttttaaggattatgacattctattccactcaacttcctggtcccaattatcactgccgtgagggctcaaaactggccactctcccaccaccaaataatgcacttgaagtgctcctgattaactttcctcgtggagtgctttttggttgtggtgatctgatattttcatctcacatgatcttcaccctggtttttgtgcgcacataccataaatatggctcaaacaggttgattaagctcctttcttggcttatggctgtaattcagagtcttcttataattgcttctcgcaagcactacactgtcgatgttgttgttgcttggtacactgttaatttggttgtattttttgttgataagaagctgccagaaatgccagaccgtacaaatggattgtctctgcttccagtaagcacaaaggataaagacggcagaatgaaggaagaactccataaacttgagaaggacgggaggatgatggatgagttccctaaattgttaaatggaaactctgtcgatgctacagattggcgacaacgagtgcagatgaatggaaagcacggagaagacacgacccacactgtcgctgatgccacctctgctgggacatgaccagcagcatttctctgtcatatcgtcttcaatatccacagagggaatctgcgagcaaaaagaaaattgtgtggtgtgctgcctctatcattgtgtgatgaaaggcttctcaggtacccgcgaggttgtgacattcataacagagcgttttgttgtgctttccatggcacgatgacagtaacggcggaatcaggaccttgcggcttttctatgaggccgcagctacagttttgcatccttcagacgtttcagtgtcgatgttagagagggagattgatgtttgatgtaaatattgattagattcaactagccctcactaaaaaaaaatcctatccatctgtggcaatgggtaatgaacgactaacttatgctgattggtaatttaacgtgagcagctgttctgaccaaaaaaaaaaaaaaaaaaaaaaa

SEQ ID NO: 9873 - protein, 324 aa, Zea mays
  misc_feature: Ceres CLONE 460267
  misc_feature: SWISSPROT Homolog: EC 2.7.8.27 Sphingomyelin synthase
MYVARESTKLWRRVCAETTAELQLLLQKWQLLLAGLVFQYIHGLAARGVHYLHQPGPLLQDLGFMALPELGQEKGYLSESVFTFIFISFLLWSFHPFIYHNKRFYTVLLWRRVLAFLVASQFLRIMTFYSTQLPGPNYHCREGSKLATLPPPNNALEVLLINFPRGVLFGCGDLIFSSHMIFTLVFVRTYHKYGSNRLIKLLSWLMAVIQSLLIIASRKHYTVDVVVAWYTVNLVVFFVDKKLPEMPDRTNGLSLLPVSTKDKDGRMKEELHKLEKDGRMMDEFPKLLNGNSVDATDWRQRVQMNGKHGEDTTHTVADATSAGT

SEQ ID NO: 9874 - DNA, 645 bp, Zea mays
  misc_feature: Ceres CLONE 460770-R
  misc_feature: Pfam Name: FmdA_AmdA Pfam Description: Acetamidase/Formamidase family
  misc_feature: SWISSPROT Homolog: EC 3.5.1.49 Formamidase
ccgaattgggaccgggccccccctcgaggtcgacggtatcgataagcttttttttttttttttttagtcgaggatcattcttgattattttttctaacggacggcaaaagctttatcgtaatttttattcgacgaagaaaataaaaaatgcaaacgcattcttgattatagccttggcacagttgcatgtcgattgatactgcatctgtttccatatactagggcgcgcttgtaccacttctgtcttgggaggcaggaaggcgtccatagtttgagcagcttagaagatctggaagtcttctcaactgtggtcctccaagtggtctccccttcacgcgttttggctttatatcctgatcaaatatcgccgtagggatggcaagagttgttacagcattaggagagtccactattccagatatcctaccctcgcatgggcagcatgatagtaaaagatacacctgctccttagagtacccgaacttggaaaggtactcaatggcgttcagaactgcacgcttgtaggccacggatgcgtcaagaaaatgttgcttcccagactcatctacgctgatgccctcaaacactaacttgagctcaaggaacccgctcatttcaattgctccacacagcgaaatctcgccg

SEQ ID NO: 9875 - DNA, 681 bp, Zea mays
  misc_feature: Ceres CLONE 460950-R
  misc_feature: SWISSPROT Homolog: EC 2.4.1.119 Dolichyl-diphosphooligosaccharide--protein glycotransferase
caattgggtaccgggccccccctcgaggtcgacggtatcgataagcttttttttttttttttttgaaaagaaaactagccatgcaattctgttgcggaaatagacaactttgtgaatacaaaaggttttgctgttgcaaatacaaactaggaactctctaaagatgtagataacgcgacagcttaatcggtatcgtcaacgaccttggtccccagccctttcaagccctcggcggggatctccgcgacggtgacaagggagtagagctcctccttggcatcctcctcgtcgttcctcttgctggaatccaacaaaacgaatctgcattgcaagcaacatcccaagcacatacatgcaattgtaggccacgtagagcctctgcgagtacctcccagtgacaagcaacacaagcacataaagcgggacgagattgatgatgaacacgtagcctccccatgccgacaccatatagaagtaaccgaacgccgaggcgagcgcccaggcgagcgacccagtgttaacggcgcgcacgaagaggtagaaggtgagcagcagcgcgaagatggcgacgccctcgttgtcgtaggaccccgcgacggagcgggagatgtagccagggacgatggcgatcagcgcagcggcgacgagccccgccccggagtcccatatctcgcggccgaa

SEQ ID NO: 9876 - DNA, 786 bp, Zea mays
  misc_feature: Ceres CLONE 461027
  misc_feature: Encodes the peptide sequence at SEQ ID NO. 9877
agccagccagtcaccaaacgcgcaacccgatcgagatcgagagatctgcatatgtcagagtccggcccggccgccgatggaggcgccgggggcgggccggctgacgctggcggggtgaggtccatggtgcagcggtggaagatggacggcgcgccggcgcgggcgcggctgctgctgcgggccctggcgtggctcttctccctcctcgccctcgtcgtcatggcgtccaaccagcacggcggcagccaggacttccgcgagtaccccgaatacaactactgcctgggcatctcgatcgtggcgtggctgtacgccacggcgcaggtcctgcgcgacgtccaccgcctcggctccgggcgggacctcatcgcggcgaggaaggcgtcggccgtcgtcgacttcgccggagaccaggtcgtcgcttacttcttgatatcggccatgtccgcggcggcbccggtgacggactacatgcgccaggcggcggataacctgttcacggactcggcggcggcggcgatcagcatggccttyttsgcgttcgtggccattggcctytckgctytcgtctccgggtwcaacctctccatgraggctcttgtatagcctgtgaatcmcaactctaccatytcatgtgtgatgtgtcacgttacccaacctcgacmctgttcatatagtattgcctccaattgttagttgagcatatttctttttctctctgataaaraagakggaatgtgtaactactgtttaatttacawagaccatacaaaaaaaaaaaaaaaa

SEQ ID NO: 9877 - protein, 184 aa, Zea mays
  misc_feature: Ceres CLONE 461027
  misc_feature (32)..(166): Pfam Name: DUF588 Pfam Description: Domain of unknown function (DUF588)
  misc_feature (135)..(135): Xaa is any aa, unknown, or other
  misc_feature (161)..(161): Xaa is any aa, unknown, or other
  misc_feature (162)..(162): Xaa is any aa, unknown, or other
  misc_feature (169)..(169): Xaa is any aa, unknown, or other
  misc_feature (170)..(170): Xaa is any aa, unknown, or other
  misc_feature (172)..(172): Xaa is any aa, unknown, or other
  misc_feature (176)..(176): Xaa is any aa, unknown, or other
  misc_feature (181)..(181): Xaa is any aa, unknown, or other
MSESGPAADGGAGGGPADAGGVRSMVQRWKMDGAPARARLLLRALAWLFSLLALVVMASNQHGGSQDFREYPEYNYCLGISIVAWLYATAQVLRDVHRLGSGRDLIAARKASAVVDFAGDQVVAYFLISAMSAAXPVTDYMRQAADNLFTDSAAAAISMAXXAFVAIGXXAXVSGXNLSMXALV

SEQ ID NO: 9878 - DNA, 921 bp, Zea mays
  misc_feature: Ceres CLONE 461098
  misc_feature: Encodes the peptide sequence at SEQ ID NO. 9879
gtatgagcgtgggtggtggcgtcgccggccggggatgagttgcaacgggtgccgcgtgctgcgcaaggggtgtagcgacgcgtgcgtgctgcggccgagcctgcagtggatcgacggcggcgccgaggcccagggccacgccaccgccttcgtcgccaagttcttcggccgcgccggcctcatgtccttgctcaccgccgtccccgagccgcagcgcccagcggtgttccagtcgctgctgtacgaggcggccgggaggaccatcgacccggtgagcggcgccgtggggctgctcggcgcggggagctggcacctgtgccaggcggcggtggagacggtgctgcggggcggagccatcgccccgctgcccgagtccgactccgacggggcccgccgcggcgcgtccgctgtggcggcgaggcgggccgtggggtgctcgacgttctcgacggcgaagcgcgcgccggcgagcgtgggggcgccgccggagccgtcgtgcgacctcgggctgtggctctgccccgggtcacccccggcgaccggggagcggcggcggcggcggaggcccggcacgccgtccatgacctccgaggagtccgtgacgacgacgagcggcggcggagggagggagcccgagctgctgaacctttttgtctgagactggccgacggtttggctaaaaagccagcgaccgatcgtgccgtgtgcccctcggcgcgcggtgtggtgtctggtatgcttgatcccggcgagaaaaaaaacgtttgtttgtctagctagcctctcgccggcgaggtagccgccgtcttgtacttcttcctttttgggccgcgcgtagaaaccatgggcgtgccggcggcagcagcgctctcccagccgccgtccgttagctagctgtttattccaaaaaaaaaaaaaaaa

SEQ ID NO: 9879 - protein, 207 aa, Zea mays
  misc_feature: Ceres CLONE 461098
  misc_feature (2)..(108): Pfam Name: DUF260 Pfam Description: Protein of unknown function DUF260
MSCNGCRVLRKGCSDACVLRPSLQWIDGGAEAQGHATAFVAKFFGRAGLMSLLTAVPEPQRPAVFQSLLYEAAGRTIDPVSGAVGLLGAGSWHLCQAAVETVLRGGAIAPLPESDSDGARRGASAVAARRAVGCSTFSTAKRAPASVGAPPEPSCDLGLWLCPGSPPATGERRRRRRPGTPSMTSEESVTTTSGGGGREPELLNLFV

SEQ ID NO: 9880 - DNA, 1123 bp, Zea mays
  misc_feature: Ceres CLONE 461157
  misc_feature: Encodes the peptide sequence at SEQ ID NO. 9881
agtccatctcgtctcgtcccagcaaagcaaaggcagccatgccccacagtctcttcctgctcgtcgtcctcctcgccgccgcgcaagccagcgcggccacgccgcggcagctgttcctcgtgagccggccgcccatcacgctcaccaaccaccacggccagctgctgacgggcaactactccgtcaacctgctctggtacgggcgtttcacgccggcgcagcgcgccgttgtggccgacttcatcctctccctctcggggacggggcaggggttggggtccgtggcggcgtggtgggccacgacgtcgcggtaccatcctggcgcagcacggctgtcgctggggcgacaggtgctggacccgtcgcgctccctaggccgccgcctctcggagtcgtcgctagcgtccctggcgacgcgcctggccccgcaccgcggctccgtggcggtcgtggtgacggcgccggacgtgctcgtggacgggttctgcctctcccgctgcggcctccacgcgtcgtccccgaccccgaacgccacccgcgggcgtggccgcgggcggtacgtgtacgcgtgggtggggaaccccgcggagcagtgcccgggggagtgcgcatggcccttccaccaaccgctctacggcccgcagccggcggcggcgccgctggtggccccgaacgcggacgtcgggatggacggcgcggtgatcacgctggccacgctgctggcgggcgcggtgaccaacccgtacggcggcggcttcttccagggccccgcggaggcgccgatggaggccgttacggcgtgcgcgggcgtgttcggggccggcgcctaccaggggtacccggggcagctgcgcgtggacgccgccacgggcgccagctacaacgccgtggggatcgccggccgacgcttcctgctgccggccatgtgggaccccgagacggcgcagtgctccacgccgctggactagatagatagatgcccgtgccgccgtgcattgcatgactgtggagtcgagtgtcggtgctgctgtttctttctcgtgtcccctcccctcccgtcccctcgcattgtggatataccactcagcaaccacttcgtttgtggctaaaaaaaaaaaaaaaa

SEQ ID NO: 9881 - protein, 309 aa, Zea mays
  misc_feature: Ceres CLONE 461157
  misc_feature (35)..(308): Pfam Name: Phi_1 Pfam Description: Phosphate-induced protein 1 conserved region
MPHSLFLLVVLLAAAQASAATPRQLFLVSRPPITLTNHHGQLLTGNYSVNLLWYGRFTPAQRAVVADFILSLSGTGQGLGSVAAWWATTSRYHPGAARLSLGRQVLDPSRSLGRRLSESSLASLATRLAPHRGSVAVVVTAPDVLVDGFCLSRCGLHASSPTPNATRGRGRGRYVYAWVGNPAEQCPGECAWPFHQPLYGPQPAAAPLVAPNADVGMDGAVITLATLLAGAVTNPYGGGFFQGPAEAPMEAVTACAGVFGAGAYQGYPGQLRVDAATGASYNAVGIAGRRFLLPAMWDPETAQCSTPLD

SEQ ID NO: 9882 - DNA, 2573 bp, Zea mays
  misc_feature: Ceres CLONE 461651
  misc_feature: Encodes the peptide sequence at SEQ ID NO. 9883
ctccgccgtctgttcccttcggaaactcaatggcgtcgcccgacgacgagtccgcgcagccaccatcgaagcggccccgacgcgatgccgaacctgaggtggacgccgctgagccatcaccgcgcgtggtgctcaacccagcggactgcgatctcgacttcgatgtaggcgggggcggtctccgggggagcgcgcttcacgagggcggcttcgcctactgctggtccggcgcgcgcgcgacggtgggcgccaggggcggcgggcggtactgcttcgggtgcagaatcgtcgctgagcagccggtggagatggatcccacgacctccggggagcgccacctctgccgcattggggtctcgagaggggatgatcccgtaggtgcgctcggggagtcccagcacagcttcgggttcgggggcacggggaagttctcccaccagcgcaggtttgtcaactacggcgtcaagttcggcgtcggcgacacggtcgtctgcgccgtggacctcgattccaagcccatggcgtcgatagggttcgcgagaaatggcgaatggcttggtattgcgaggcattttgatgcgggcgagaaagggcttggtctggttgacgctcctctgaggccgatgcgatggggatccgcactgtttccccatgtcctgctgaagaatgttatcgtggagatgcagttcagcagggaggatgggctgctgcctgttgatggttatgaaccctgggcctcagctttttctcaaaggaattcagtatttggcccttcgtttgagcaaaataaatgtgaggtcatgatgatggtcggtcttccggcctctggcaagtcaacatgggcagagaaatgggtcaaggagcatcaggagaaacgttatatccttctcggaactaaccttgtattggagcaaatgaaggtgccaggattattgcgtaagaataactatggtgagcgttttgaacgactgatggattatgctacatggattttcaacaaactgctgactagggctgcaaatacccctcgcaacttcattatcgatcaaacgaatgtttacaagaatgctcgcattcgcaagctgaggccatttgctaactaccgcaagactgctgtggtcatgttcccaactccaagtgaactgaaatccagggcagcgaagcgtttcaatgagatgggaaaggaaataccagctgaagcagttaacgaaatgacagccaattttgtcctaccactctcgaaggatatgcctcattcgaaggagccttttgacgaggtaatcttcacagagctttctagggatgaggctcagagaaccctagatgatatgcagcgtgtgttgccaagaaatgtgaccccaagctatggaaactctggcaaccaaaaacattatagttcaacatatgctgggactgctgctccacttgatcctagtgcaaggtcatcaatgccaggcttttatccaccaacggccaattcatatggagttggcgacctacgtagcagtgctgctactttcagcacaggtgtgcatactgaaggcaacacaacacatggacagacaccctgcagcgttcgaagtttccggagtccaacaggaaaccaacatggaatccattcaagctatccaagtgctccaaaccaatatcagatgccctcaagctacctgagtaactcaaaccaatatgaagtccgtgcaagctaccgaagtacaccacttccgggatatggacagagtacatatgcttcccgcaggaacccaagcccatacaattctgagatgcaccaaggtattcaggctcccatgagtagcaggaacctctaccgagcacctgggtcagccgaagcctatgtggcaccttgctatgcagctggaaatctgattgggaggccacatcaggtgttatcaccatcaacttttccagcacatggtccacaaccagctgctcagtgggtgccaaatcaaggtagttcccgctcatggagttctgacagttacaggccttactatggacaatagtctcatgatgtgcaccggccgtcgaatgctgctttggcaccacatcctagctatgctatcgtcacggttctgcaccaaactacatgaatcaatggcggagaccttggtagaattagctttgatggcagcttgtttattttctatataaataaggccatgtttggtttcaattagtcttaggactaaactttagtcctaggactaaactttagtccctacttgtttggttctagggactaaatagactcaaatgctcttggaatacactcatgtgggcttttagtctcttttagcacctatgtgaaggactaaagactaaatcattttagtccatattttagtcctagtgtttggcaaaaaagggactaaatgggactaaaaactagagactaatctttagtccctctaaccaaacaccccctaaaacgagaggtgtaaataacagtgctcaggttctactcgttctagggaaccttcgtgcgtctgttacgtacaaagctacgcatttagcaacacgtttgtgaattaccttcttcgaaaaaaaaaaaaaaa

SEQ ID NO: 9883 - protein, 663 aa, Zea mays
  misc_feature: Ceres CLONE 461651
  misc_feature (77)..(224): Pfam Name: SPRY Pfam Description: SPRY domain
MASPDDESAQPPSKRPRRDAEPEVDAAEPSPRVVLNPADCDLDFDVGGGGLRGSALHEGGFAYCWSGARATVGARGGGRYCFGCRIVAEQPVEMDPTTSGERHLCRIGVSRGDDPVGALGESQHSFGFGGTGKFSHQRRFVNYGVKFGVGDTVVCAVDLDSKPMASIGFARNGEWLGIARHFDAGEKGLGLVDAPLRPMRWGSALFPHVLLKNVIVEMQFSREDGLLPVDGYEPWASAFSQRNSVFGPSFEQNKCEVMMMVGLPASGKSTWAEKWVKEHQEKRYILLGTNLVLEQMKVPGLLRKNNYGERFERLMDYATWIFNKLLTRAANTPRNFIIDQTNVYKNARIRKLRPFANYRKTAVVMFPTPSELKSRAAKRFNEMGKEIPAEAVNEMTANFVLPLSKDMPHSKEPFDEVIFTELSRDEAQRTLDDMQRVLPRNVTPSYGNSGNQKHYSSTYAGTAAPLDPSARSSMPGFYPPTANSYGVGDLRSSAATFSTGVHTEGNTTHGQTPCSVRSFRSPTGNQHGIHSSYPSAPNQYQMPSSYLSNSNQYEVRASYRSTPLPGYGQSTYASRRNPSPYNSEMHQGIQAPMSSRNLYRAPGSAEAYVAPCYAAGNLIGRPHQVLSPSTFPAHGPQPAAQWVPNQGSSRSWSSDSYRPYYGQ

SEQ ID NO: 9884 - DNA, 2239 bp, Zea mays
  misc_feature: Ceres CLONE 462495
  misc_feature: Encodes the peptide sequence at SEQ ID NO. 9885
actgcttctagtactctccccacaagcatccccctccatgatagtgcttcctctgagctaaggctctctcacctaaacacccgctcaccccaagtccacgccggcgattgccgcaatgccggcgccggcagcgggcttgtccgtcctggtgctcttcgtcttcgccgccgccctgccggccctttctgccgatgacctcaacaccgacgcgcaggcgctgcaggcgctacgctcggcggtcggccgctccgcgctgccatcgtggaacagcagcacgcccacgtgccagtggcagggcgtcacctgcgagagcggccgcgtcgtcgagctccgcctccccggcgccgggctcatgggcaacctccctttgggcgtgctcggcaacctgtcggcgctccgcacgctctccctccggtacaacgcgctcacggggcccattccggacgacctctcccgcctgtccgagctcagggccatctacttccagcacaacagcttctccggcgaggtcccggcatcgctgttcgagctcaagaacctcgtgaggctggacatcgcggggaacaagttcagcggcaagatctcgcaagacttcaacaagctgatccgcctcggaacgctgtacctcgacgggaacagcttcaccggcgagatccccaagctgcagctgcctgcattggagcagttcaacgtgtcgtacaaccagctcaacgggtccatccccaacacgctccggaagatgcccaaagactcattcttaggcaacacgggcctctgcggcggtccactcggcctgtgccccggcgagtccgcgcccacgccggccggagcgccggagtcgcagccaggcgcgggcggtgcaggcgacgtcggtggcggcaagaagaagaagctctccggcggcgccatcgctggcattgccatcggctctgtgttcggcgtgctgctcttgctcgccctgcttttcttcctctgccggaagaggtccagcgcgccacggtcggcggcggcggcggcggagaaggggcgggaactcggcatggggccgatggatgtcgagccaaagggacagaacggctcagcaggcggccacaacggcgttgcggcggccgtcgcagttcctaccgccgccgctgccgccgctgtggctacggcggcagcaaagaccggcgggtcgaccgggtccaagaagctcatcttcttcggccccatggcggcggccccgccgttcgacctggaggacctgctgcgcgcctcggcggaggtgcttggcaagggcgcgttcgggacggcgtacaaggcggtgatggagaacgggtccgccgtggcggtgaagcggctcaaggacgtggacctcccggagccggagttccgggagcgcatcgcggccatcggcgccgtgcagcacgagctggtggtgcccctccgcgcctactacttcagcaaggacgagaagctcctcgtctacgactacatgtccatgggcagcctctccgcccttctgcacgggaaccgcgcctccggccggacgccgctggactgggagacgcggtcggcgatcgcgctggcggcggctcgcggcgtggcgcacatccactccacggggcccacggcgtcgcacggcaacatcaagtcctccaacgtccttctcaccaagaactacgaggcgcgcgtgtcggaccacggcctccccacgctcgtcggcccctccttctcgcccaccagggtgtccggctaccgcgcaccggaggtcaccgacatccgccgcgtctcgcagaaggccgacgtctacagcttcggcgtcctcctgctggagctgctcacggggaaggcgcccacgcacgccgtygtcaacgaggaggggctcgacctgccgcgctgggtgcagtccgtcgtgcgggaggagtggaccgccgaggtgttcgaccaggagctcctcaggtaccaaaacgtcgaggaggagatggtgcagctcctccagctcgccatcgactgctccgcgcagcaccccgacaggaggcccgccatgtccgaggtggccacgcggatcgacgagatccgccgctccagcctcggcgaccggcaggtggccgacagcgccgaaggcgacgagccatctctataaccgccgtagcagtagctcctcccctgatccaccaccacacgtactgtgtcaatctcagtgaatgaaaattgcttagttctttgcaaaaaaaaaaaaagaaaaaaaaaaaaaaaa

SEQ ID NO: 9885 - protein, 669 aa, Zea mays
  misc_feature: Ceres CLONE 462495
  misc_feature (378)..(645): Pfam Name: Pkinase_Tyr Pfam Description: Protein tyrosine kinase
  misc_feature (28)..(65): Pfam Name: LRRNT_2 Pfam Description: Leucine rich repeat N-terminal domain
  misc_feature: SWISSPROT Homolog: EC 2.7.11.1 Non-specific serine/threonine protein kinase
  misc_feature (578)..(578): Xaa is any aa, unknown, or other
MPAPAAGLSVLVLFVFAAALPALSADDLNTDAQALQALRSAVGRSALPSWNSSTPTCQWQGVTCESGRVVELRLPGAGLMGNLPLGVLGNLSALRTLSLRYNALTGPIPDDLSRLSELRAIYFQHNSFSGEVPASLFELKNLVRLDIAGNKFSGKISQDFNKLIRLGTLYLDGNSFTGEIPKLQLPALEQFNVSYNQLNGSIPNTLRKMPKDSFLGNTGLCGGPLGLCPGESAPTPAGAPESQPGAGGAGDVGGGKKKKLSGGAIAGIAIGSVFGVLLLLALLFFLCRKRSSAPRSAAAAAEKGRELGMGPMDVEPKGQNGSAGGHNGVAAAVAVPTAAAAAAVATAAAKTGGSTGSKKLIFFGPMAAAPPFDLEDLLRASAEVLGKGAFGTAYKAVMENGSAVAVKRLKDVDLPEPEFRERIAAIGAVQHELVVPLRAYYFSKDEKLLVYDYMSMGSLSALLHGNRASGRTPLDWETRSAIALAAARGVAHIHSTGPTASHGNIKSSNVLLTKNYEARVSDHGLPTLVGPSFSPTRVSGYRAPEVTDIRRVSQKADVYSFGVLLLELLTGKAPTHAXVNEEGLDLPRWVQSVVREEWTAEVFDQELLRYQNVEEEMVQLLQLAIDCSAQHPDRRPAMSEVATRIDEIRRSSLGDRQVADSAEGDEPSL

SEQ ID NO: 9886 - DNA, 801 bp, Zea mays
  misc_feature: Ceres CLONE 462564-R
  misc_feature (13)..(13): n is a, c, t, g, unknown, or other
  misc_feature (14)..(14): n is a, c, t, g, unknown, or other
  misc_feature (17)..(17): n is a, c, t, g, unknown, or other
  misc_feature (18)..(18): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (68)..(68): n is a, c, t, g, unknown, or other
  misc_feature (69)..(69): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (82)..(82): n is a, c, t, g, unknown, or other
  misc_feature (84)..(84): n is a, c, t, g, unknown, or other
  misc_feature (85)..(85): n is a, c, t, g, unknown, or other
  misc_feature (648)..(648): n is a, c, t, g, unknown, or other
  misc_feature (678)..(678): n is a, c, t, g, unknown, or other
  misc_feature (776)..(776): n is a, c, t, g, unknown, or other
aaaagatagaaannaannaaaaaatagaaaaaaagttaatttcaaaataaattatataatgnnnnngnngggtgaatnnnantnncaaatgggtaccgggccccccctcgagtcgacggtatcgataagcttttttttttttttttttccaacaaagaaaaaaatcctgccattcatgtctgtaccacaacatattacatattgcagacttctctctttgcgtaataaaacccaaagtatgatacaaacaaaagcagagattaatgctgcagcggaggtacgaaatatctctggaaggcctgttcttcttcaatccatttcataaatactggttgaattaaactatctatcaaggtagtcgatacttgcaaccacctgattccatcgagttcagaacttccagagatatttcttacctccatttccagaagctggaatgtgatcagaagaagccgcaatctgggaccagcatgaatggcaagcatactcaaaggatagtttttcctatcactcatgagtccatcctctcggctatccaaaagggcatcttgaacatgtgcttgtaaggctttggaaagtttagcactcacttcactcccacatatcgttggggtcaaatgcagcattcctttcaggcaagaactttangatccctacccagaatggagagggagcttnggctctgggaaaatatgttgaagaaaacatttctgaaatttctggacaacgaagggaagatgttctgggccccagaagggggtaccaaaactcccagncccaaaaataattggcaaaaaaaaa

SEQ ID NO: 9887 - DNA, 712 bp, Zea mays
  misc_feature: Ceres CLONE 462745-R
ccaattgggtaccgggccccccctcgaggtcgacggtatcgataagcttttttttttttttttttaaccaatagtaacagctcaatgacttgttcataatgtcttgacaagcattacgaaataacagaaaaacacgaccactataacttaacataatgtaacctatcaaaattacctctccggaagctaatgtgctgtttgggaagaagagaaatcttgggcccgagcagactgaaatgcccgagggaaaaacccaagacaatccccccttccaagcacgcttatcaaaccatcaaccctaacatattaaggcactgacttaattcacacgcagaaatcaacggtttgcaggaaatcgtccatgccgcggccgaggtcgcagccaggcatctccgggaagacgtcgttgatatcgtcgaggtcgaggtcgatctccagttcctcgtccccgaagtccccaagcagcagatcctgctcgtcgtccaggcagaagggcgcatcggagacgtccagagcgtcaagcccggcacggaagtccatcgggctgatgtctggcagctgcaggccgcgcagaaggtccttgtagaactccgggtcgtccggcagctccgcagactcatcggacggcaggacggggagttggtgtcgcgaccagctccggggactgcgggttcagcggcgcctccttggtggcgggtccaagcacggacga

SEQ ID NO: 9888 - DNA, 981 bp, Zea mays
  misc_feature: Ceres CLONE 462946-R
  misc_feature: SWISSPROT Homolog: EC 1.6.5.4 Monodehydroascorbate reductase (NADH)
  misc_feature (78)..(78): n is a, c, t, g, unknown, or other
ccggatcggggaaacagggacaccgtgggagagaaagtgaaaaaaaaagaaaagggaggggttaaagtacgaacaatnttttacaattgggtacgggccccccctcgaggtcgacggtatcgatattttttttttttttttttgaatcaaaaaacacataattaataaaaagatgcgtcaacgtcattggtgtaaatagacgacccatgcagtgtttctcagggaagaccatggtgaccctaatcttgttagtaaccaatgccgctgcacactccattccaatgtagccaccagcgatgacaacagcatttccaccaagacatgatttcatcacactcaccaacttatccgcgtcgtcgatgttgcgcaaataacatatgtttgaagcatctgaaccttgtattccaaaattcttgcagcttcaaaacccgagcacctggtcgcaaataattagaagtttttgtaagctgataaatttgcaccaagtgaccatggaacccccccccactttggaggcctcaacgtttaaacaggaaaatcgacttttttggtttcccaagaaaaaaaaagtttcaaataggccctttggtttctttttggtaacccaaatatttcgggggtggtgccagggataaaccccccaattccatttttagggccaccccaaaaccccgcaaagggtattttgaaaaaaaatctcccttgggggaaaagaacacgaagggcataggcccccccttttttcctgtgtggggaggttaaaaatataatgggccccttgttggcattttagaattgtgcacaggggaaacactttttcacttttaaagggaagggtgaaaaaaggggccctctcctttttcgggggagaaaaatataaatggccagaagagaatttctcttcccgcacgcgagagaagataaacctccatctcgcgccggggccgggggcatcaaaaactctctcaatagagggccggg

SEQ ID NO: 9889 - DNA, 663 bp, Zea mays
  misc_feature: Ceres CLONE 465249-R
caattggtgaccgggccccccctcgaggtcgacggtatcgataagcttttttttttttttttttgatccgcattttgtaacttagtttttcgcatcaaacaacgcattgcatattttttatcaaaatataaaaacatacgagtttctttctaattcgtcttctttctctacccgcgtccattcatacaattatattttcacgcacatattcacgccatcgactgaatcataaataaaaacgaaatcacaatttttctaaagcgaacaaccaggccgactcgtgtcgcgcatgtccgcatgctgtccatagcttggggctttcgtcgagcatggaatgcgcgaggcatgacgacaagggcatgggtcgacgacgacgcggctgctctcgccgagctggaacaagtcgtggcgatgtggttcttgctgcccgcgacaagcacggcatcgacggcaagcccaatactcgacgatagcaagctgcgggctgggacaaagctcgatccagcggctaggacagcaaggtgcctcaccaagggtcacaacgtcgcgttgggactgctgctgtggacaggcgccggcgaatgagcgccggcgaaggagctcgctgctgcgataaactgagacatggagctactgtgcatatcaccgaacaagtggtgcgcg

SEQ ID NO: 9890 - DNA, 765 bp, Zea mays
  misc_feature: Ceres CLONE 465253-R2
  misc_feature: SWISSPROT Homolog: EC 2.7.11.1 Non-specific serine/threonine protein kinase
caattgggtaccgggccccccctcgaggtcgacggtatcgataagcttttttttttttttttttgactcgacaactgcctcggcagcgcacaatcttgacttacaacaattcggagaacacataatctatgttacaacaatgtactaaaacatgaacaaaagcaataattaatgttgcttgcaattttacagcccagtttttttggtagacacctggtccttcaactagctccgtcaggggctctctacaacagtgctaccaccagctaatgcaaccgtggacaccagtgagctgctcggtgcaggagacatcgacggggataagctgaactgaaccggctctactgttctgactttcaggtccatgacgtccgtgatcaggccgggcctcatgatcctgtcactcacagcgcactcacccttcagcatcttggcgaccgttgacatggagggcctgatcttggggctatcctggatgcacagaagacctatcttcagcaaccggcgtgcttcctcggtgtcgaaatcgcgcttcagtgtcctgtcaatgatgctctcgagatcgtcggactcgtaaagtgtccagacctgacagaacagcagcagaagtttcagatgatttaaatcaaagtctaagatctgatagcaccataacttcaggcattttgaagctagcaagttagtaaaaatctgatagtttgatctgcttttacaagtaagtcaatctctcagaactcatcatttttttttggaacgaatcaactg

SEQ ID NO: 9891 - DNA, 752 bp, Zea mays
  misc_feature: Ceres CLONE 465253-R
  misc_feature: SWISSPROT Homolog: EC 2.7.11.1 Non-specific serine/threonine protein kinase
tgcctcggagcgcacaatcttgacttacacaattcggagaacacataatctatgttacaacaatgtactaaaacatgaacaaaagcaataattaatgttgcttgcaattttacagcccagtttttttggtagacacctggtccttcaactagctccgtcaggggctctctacaacagtgctaccaccagctaatgcaaccgtggacaccagtgagctgctcggtgcaggagacatcgacggggataagctgaactgaaccggctctactgttctgactttcaggtccatgacgtccgtgatcaggccgggcctcatgatcctgtcactcacagcgcactcacccttcagcatcttggcgaccgttgacatggagggcctgatcttggggctatcctggatgcacagaagacctatcttcagcaaccggcgtgcttcctcggtgtcgaaatcgcgcttcagtgtcctgtcaatgatgctctcgagatcgtcggactcgtaaagtgtccagacctgacagaacagcagcagaagtttcagatgatttaaatcaaagtctaagatctgatagcaccataacttcaggcattttgaagctagcaagttagtaaaaatctgatagtttgatctgcttttacaagtaagtcaatctctcagaactcatcatttttttttggaacgaatcaactgtattcataagaactggatcagtacctaaaaactaatctagtattgggattgctctttcaccttt

SEQ ID NO: 9892 - DNA, 763 bp, Zea mays
  misc_feature: Ceres CLONE 465311-R
  misc_feature: Pfam Name: UBX Pfam Description: UBX domain
  misc_feature (719)..(719): n is a, c, t, g, unknown, or other
tgtgtgagcctgtgatattggtggaagcgaattttagttcgtgacaaaagtacacaagaagcgtgcacctgtggtgtattaccatctggaaatccttaactgtcgctgaacaacttcgaaaaaggagcgtctgcactttagtttcggcttttctttagcttacagcatcattgttctatctcgataaacaagctcgcctgcagatgcaagcctgcttcctccagcgtcagggattgcttttctggaccatatgtaacgcgtgggaaattcgaaactagggtgtacttctccgctttcgtgcagtctagagaatcgacatagtcatagagggaagcgacggttgcagaactgtagaatctccgctctctgcgctctccaggtgggaatcttatgagaacccgagtaacacctggtcctttctcaggttcagctccaagagccatggtcttctcttgcctcctccttgcaagagcagcttccttctcagctgcttcgtgagatgcccttgatacagcttcctcctcttctttacgctttttctcagcctctgcagtctctctttcacgtcttttcagctcctctaacctttcacgttctctggcctgatcagcttcaagtgcagctctgtaagcagcatcttgttcctcacgcaatcggtgggtgtttagtctctcttcagcttcaatcctagcagcaacaagtgatgtagcacattcttncaacacacgttgaagatctgatatatctcttcaggagatttgcg

SEQ ID NO: 9893 - DNA, 660 bp, Zea mays
  misc_feature: Ceres CLONE 465456-R
cgattgggtaccgggccccccctcgaggtcgacggtatcgataagcttttttttttttttttttcggatcgaatgtcacatctttactatataataggagttctatacaaaataataaaataaataattacattataaggagacaacggtccagcaacccaaagttgactgggagacgacgacctagacctctcacgaacacatcgcagcatcctccacgcgcctcatcctgtggtacctgctcttgacctgtgggggggtgtgagacagcaagagtgagctcagacgttcatcgctcaacaagttgtggggaataatgtgcatgaactcgccaaaggtgggagctcacgtgaagtgtaaggcttaccaaagaggatggttagagctgagcattgcttttaaagttggtcaaattttattagcaattactaagtataagtaaataccagcccaattaaatggtagaacaaaagtaacaacatcacctgcgatgcaatgcatatgacaaattgaatttaagttccataaattaatcatgtgagggtccgagctgctcatgaccgtgagcacggctagtataccagttttacactctgcagaggttgcgcatctttacccacaagtcatgttacccatctggccaagggatcgcgacttccc

SEQ ID NO: 9894 - DNA, 651 bp, Zea mays
  misc_feature: Ceres CLONE 465802-R
ccgattgggtaccgggccccccctcgaggtcgacggtatcgataagcttttttttttttttttttgaaaatacagtattaaatgtattattatcaataacagtatccagaacttatcctaccagctctagaactttttacagatgctttcgttcctgggatataaagtggctctagaactttttacaattggtttcactcacgggatatagagtagtgagatgaaaacagccacctccatttggcagcaatcagccatcacaaattgatcataaccgtgataaatcttaccatggttatgcgcccggtgaggagtttatggtatccgagcatcatgcattagacagtcgaaaccttcaccgccgtgcttcttttcctgttacatgcagcagccacaccacacagcaaagacatggttggtttgctgcatttgcccaccagagaacaccaccagacatgatctgtacatgtactacgagcacgaccattgttagctgccccaatgttcctcaccggtgaagcaatacatgccttgtcatgccgagagaaatggcacaatcagaaagatactcagcaccagtaagagggtgatccgaatagaacggccaaactgaatgctctgttgttggccttgaatatgaagcccacccgt

SEQ ID NO: 9895 - DNA, 1556 bp, Zea mays
  misc_feature: Ceres CLONE 465864
  misc_feature: Encodes the peptide sequence at SEQ ID NO. 9896
acgggccacggccgcggccgaattgaattaatggcgtgacgcggagtcgcgaaaaccagacttattacgtgacgacgaccaacgatgcagctcgatagacttatgggcgcctccgtggtcctcgccgtcgttgtttccctcgccgccgtcctccctattgctcgcgctgagatcaagacgacgcctgttgtctccgactcgcgctccgtcatcctgttcgaggagttcggcttcaggcgcggcggccacgccagtatctcagccaccggcatctcgtggagggtccccgaggggtctcagctgcaagccgtggacacgacgctcatgggtttcttcctcatctccaactcccttttctacgagatcaacaatgagtccgactacgccgaggccaccggcggcgccttctgcccgctcacaagcaagtacgtgcagcggctcttcctgttcaaggaggtggcgcccgacggcacggggaggggctccctgaccatcgactccgacgaccagtacacggtgctgttcagcagctgccaagagggcgtggaggtcaccatggacgtgcgcaccgagatgtacaacctgcggcgctccggcaccagggagtacctccccgtcggcctgctgccgctgccgtggatcttcgcggccgcggccgcggtgcacttcgcgttcctgggcacgtgggtggtcgtctgcgtcaaacaccgcaggacggcggagcgcatccacgccgtgatgggcgcgctgctgctgttcaaggcgctcaagctcgcgtgcgccgccgaggaccagtggttcgtggagcgcacgggcacgccgcatgggtgggacgtcgccttctacgtgttcggcttcttcaagggcatcctgctcttcaccgtcatcgtgctcatcggcaccggctggtccttcttgaaaccttacctccaggagcgcgagaagaacgtgctgatggtcgtcatacccctgcaagtgatcgagaacatcgcgtcggcggtgataggggagacggggccggcggggagggactggctggcgtggaaccagatcttcctcctggtggacgtcatctgctgttgcgcggtgttcttccccatcatatggtccatccgcaacctgcgggaggcgtccaagaccgacggcaaggcagcacggaacctccagaagctcacgctcttcaagcagttctacctggtggtggtgtgctacctctacttcacgcggatcgccgcgtcggccgtcgccgccgtgctcagctacaagtaccagtgggccgtcaatgtctccatcgagatgaccagccttgcgttctatgtgttcgtgttctataacttccagcccgtggagaaaaacccttacctgtacgtgggtgacgatgaggaggaagccgcgggtgggcagcttgagatggagagcacatttgagatctgacgagacattttctttagattatatgagatctgatgagacacgcatgcatgtactcccagttttgtatagttatacagtgctacaaacaacctgatatggttttcacaaaaaaaaaaaaaaaa

SEQ ID NO: 9896 - protein, 449 aa, Zea mays
  misc_feature: Ceres CLONE 465864
  misc_feature (137)..(425): Pfam Name: Lung_7-TM_R Pfam Description: Lung seven transmembrane receptor
MQLDRLMGASVVLAVVVSLAAVLPIARAEIKTTPVVSDSRSVILFEEFGFRRGGHASISATGISWRVPEGSQLQAVDTTLMGFFLISNSLFYEINNESDYAEATGGAFCPLTSKYVQRLFLFKEVAPDGTGRGSLTIDSDDQYTVLFSSCQEGVEVTMDVRTEMYNLRRSGTREYLPVGLLPLPWIFAAAAAVHFAFLGTWVVVCVKHRRTAERIHAVMGALLLFKALKLACAAEDQWFVERTGTPHGWDVAFYVFGFFKGILLFTVIVLIGTGWSFLKPYLQEREKNVLMVVIPLQVIENIASAVIGETGPAGRDWLAWNQIFLLVDVICCCAVFFPIIWSIRNLREASKTDGKAARNLQKLTLFKQFYLVVVCYLYFTRIAASAVAAVLSYKYQWAVNVSIEMTSLAFYVFVFYNFQPVEKNPYLYVGDDEEEAAGGQLEMESTFEI

SEQ ID NO: 9897 - DNA, 1912 bp, Zea mays
  misc_feature: Ceres CLONE 465887
  misc_feature: Encodes the peptide sequence at SEQ ID NO. 9898
gtcttctttctcggcttctcgcttccttctccttttcttcctctcctccccactctcaattccttcctcgttcggttgttccttcccacttcctctctctcgcgcgcctgtactacttttgaagccgcaaggtcagaagagaggatccacctctcagttcgattttcggtggctgaagtccttctacctcggggggtttgagcgttttccttgataaatttgtgtttcttcgagagtttattttttgtgttttctcttgagagattcgtgcgaaggacgtcgtcttcggtccattttcttgggtagtcgaattgctcttatacagcgtcaaagcatccaactttgacttctccgtggtggcttcttctactactctgtgttgtcgaggagacaatttaatctttatttaattgggttggatgcttgttcaagttgcagttgaaaaggtagcagaagacaccattaatcctsrtgattttggtgcttatctgctgaataattgagggtcraagtaaccatttgcagttcttacttcycgttttcttgggaagatttggtgaatttcgttgcaggacagagcttccttcaatcctccctccttgtttttatgcatttgggtggttggggatatcttcactttatcctcgctgcaaaaagactataaacttgggagttcctatgatatccatttcttgtgaggatttgatcttgattctgttggttcttggtgaggtggttgagatgaaaggagtactatgctaactcatcgaggaaagaacagcacagtcagtactgttctaaggaaaagctgacatttctgtgcttttctttggaggactgcggtctgttcctgcaagaatttgtgtaaaaagggtggtaattctagatttctacaatttttgcacaggagaagctcgattccaccttgcagatccaatggcgcaacctgaaattcctgcatttggggattgggaaaccactggaaacacaccttacacacaaaagttcgaggatgcacggaagaacaagaaaacaggaattcttgcacaaccaaatgatccaaggagggatctggaacctcctcgcaagtcgcctttgcacccaacggtctacaaaactaatcctcaagaccaaggtccaaggaacccaccacatcgaccaagacctgaacttgacaaccaacgacactctgaccggcctactcaccgtgagtctgcaccacgaagacattcaaatcttcagagagaacaagggagtaatgctgggacaccaagaagcccctacagaacagctgctgggtctgcttcaccaatgcagccaaacaaccaatcaaagccaaagcacaggtcaactggaatgcagactccagagaggagggcatcttcagaggggcttggccagcatacacctggaaggagcaggatgaagccgggtggctatgagcctgaagaagtggctgtaccaccctttggcgaatgggatgatgcaaatgcagcatcaggtgaaaagtacactggtatcttcaacagggtgagggatgataggttgtcacctacctcttctgctaggcaaccgtctactactcgtagtgaagagaataaggtgcaacagaaatgttcttgctgcatactttgagaaaataaggacaggatctcgaagagttctagacaacttcctatgctgctcctgtgatgagatccctatcttgtaactcttcctgtgctagttgtcatgtttgttattgttggtgtgattatgtatctgtagatggattgtttcatttgagctcttcaattattacaaggaacatatatatgatacctagaattgtaaagtatggagtgagcaatttctttgcaacaataaaaggtttatcgaatgggctctggaattccacaaaaaaaaaaaaaaa

SEQ ID NO: 9898 - protein, 232 aa, Zea mays
  misc_feature: Ceres CLONE 465887
  misc_feature: SWISSPROT Homolog: EC 2.7.7.6 DNA-directed RNA polymerase
MAQPEIPAFGDWETTGNTPYTQKFEDARKNKKTGILAQPNDPRRDLEPPRKSPLHPTVYKTNPQDQGPRNPPHRPRPELDNQRHSDRPTHRESAPRRHSNLQREQGSNAGTPRSPYRTAAGSASPMQPNNQSKPKHRSTGMQTPERRASSEGLGQHTPGRSRMKPGGYEPEEVAVPPFGEWDDANAASGEKYTGIFNRVRDDRLSPTSSARQPSTTRSEENKVQQKCSCCIL

SEQ ID NO: 9899 - DNA, 912 bp, Zea mays
  misc_feature: Ceres CLONE 466162-R
  misc_feature: Pfam Name: CMAS Pfam Description: Cyclopropane-fatty-acyl-phospholipid synthase
  misc_feature (623)..(623): n is a, c, t, g, unknown, or other
  misc_feature (653)..(653): n is a, c, t, g, unknown, or other
  misc_feature (656)..(656): n is a, c, t, g, unknown, or other
  misc_feature (734)..(734): n is a, c, t, g, unknown, or other
  misc_feature (767)..(767): n is a, c, t, g, unknown, or other
  misc_feature (788)..(788): n is a, c, t, g, unknown, or other
  misc_feature (827)..(827): n is a, c, t, g, unknown, or other
  misc_feature (864)..(864): n is a, c, t, g, unknown, or other
cgattggggaccgggccccccctcgaggtcgacggtatcgataagcttttttttttttttttttgacaacagggattccagattttgtttttgaaaccactacgaagtcggtacgagatacaactacgtgccagaaaaggagttgttcgtcagtgtacatgacaaaattactgaaaacattgatttttgattgggtacttccaagcagtagcctctacttctttcggaacaagtaatgggcaaccatccattcatctccattgttgtatccaaaaagttcagctaccgagatgaagaacgtccgccaataagctatccatttggtagtcgattccttcccataagtttcctcgaagatcagccttactgaagtgatgctcttgtccatacgttttagccactcctcgctagttctagcataatgcgtgccactgacaagccaatgatctaccacagatacatcctcctgaaagtatagaagtaggtttgcagatggcattgttcctccagtgaagaaatacctcgtgatccagtcatcatcgtttttatcctcaaagggatatggaaattgcttttgtggcagaagagggtgaacgaatagtaaggcatcctctttcatccanctgggatatcttccttaagaagtgacttgnagntttttcatggtgctcaaacatctctatagataacgatcctgtcaaaagaagcgctccatctcaaaacttgctgatgtncggctacaataatcctcaaatttgacagctcgntaatccctacattgctctccnaataaaagccttctggggaggaaagttgcatattcctgntaccctgcagttccttatattcctttgccatggaaanggaaaagggatccccatcccaatccaattctaggaaactttggccatc

SEQ ID NO: 9900 - DNA, 1008 bp, Zea mays
  misc_feature: Ceres CLONE 466196-R
  misc_feature: Pfam Name: Glyco_hydro_35 Pfam Description: Glycosyl hydrolases family 35
  misc_feature: SWISSPROT Homolog: EC 3.2.1.23 Beta-galactosidase
  misc_feature (6)..(6): n is a, c, t, g, unknown, or other
  misc_feature (7)..(7): n is a, c, t, g, unknown, or other
  misc_feature (12)..(12): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
attttnnagccngnnngnnnnggcccccgcccaaacccccccgcccctgtgttagtacgaattgggtaccggggccccccctcgaggtcgattgtatcgataatcttttttttttttttttttccttttattactatgcttagtatttttatttctcccttatataatttatggttttttgcttacatgatacactatggcaaattacgtaccattattccttacatgagaggaggtggatgcaaactgtataaggcatgccttttaccaaagcagaatgtgtccagctcaccacatttatcaataggagcatcacatacgaaactagttgaaatgaatggaccaccatctgtgctcccacaattcgttccaccatgatacactgtactaattaacaaaagagccacacttctgaataagcttggcctcaccatatgctacatcctctactgctctatgtggaactggaataccaaatcccgtctaacaacatgcccaagccccccctcaccttcgtacccttgggaggccccgcacgggaggaaccacacacacctaaaccccttgggaagcttaaataattgcgatcccggaccatcatcacctttgccccctgaccactggccccactcgagtccttacccgccaccgcctggttccgctgccccactgacgccaaacgaccctggccgcgccccctcccatgatccacaattcaaagacgccccccacgtcacgcctccactcttggccaaacaaactatttggcccccccccctcccaatttacaaaaaaccccccccgcctcttcgtttatggctcaaccggcacctttatgaagagtaaaatgtcggcaataacgcagtaattgccatcgcgtctccattactcacccccactaaaagcgctaagcgcgcccgctcacacatcactcttacacccccctgcccggctaatcctgcacccctgaacatctcgcaacctcggccgcccgctcaccctcccagg

SEQ ID NO: 9901 - DNA, 653 bp, Zea mays
  misc_feature: Ceres CLONE 466221-R
  misc_feature: Pfam Name: TFIIS_M Pfam Description: Transcription factor S-II (TFIIS), central domain
  misc_feature: SWISSPROT Homolog: EC 2.7.7.6 DNA-directed RNA polymerase
ccgattgggtaccgggccccccctcgaggtcgacggtatcgataagcttttttttttttttttttaagcgcacagcaccactaatccatcagcatcgtctgacttggcaccattctattctaactccacccaagaacattcacagctggtgacgatgcgatcaagtcaacaacattcacgcgttcgactagtacaatctgaatgaatcaggaggctgcctgacagaggaagaggataactgctcctagtttacggggggtaaaaaaggggaaaaaaggtgagttgttcagcctgctctgtcgaacttacagtcacaactaacagagcacacacatcacagcaggatagtgtgctcagcagtcagcacaactaagtaaacactttagcaaggctgaacactcagcagaacttccagtgattgttgcagttcacgcatgtgacgaacgtcgtcatcggttcatcagcactccgagtctgcagctggtagtaggtcgtcttccgctgcccacatctggcacacttgaactggtccgtcgtcgcctttggtgccgctccacgctcgcagtcgaacagagccttctccttgatctgcatgttctcttgcttccttgcgtcgctagccatctcatcgggggatacgtctggaagcctca

SEQ ID NO: 9902 - DNA, 1215 bp, Zea mays
  misc_feature: Ceres CLONE 466310
  misc_feature: Encodes the peptide sequence at SEQ ID NO. 9903
aggatagacaggcgacagctgcacttcagcgattcacccagcgcgccgctctcgtgcgacaattgggcgtcccgcgtccgccgtcgccctgcccagcccttcgccggtcctttcccaggccttcgacgcgtccttcgccgtcgaagagtccccagcagtgtagcaccatgcccttttctcggcccgccgttggtttcttagttagactggttggggtccggccaagctgctgtcctccttcccgtgcatttgcagctgtcagagctcaaaagattcagcttcccaagaaaaaaaggcgattagatgaagtgtgcttagaaaggtttcaacaatacagtagaacatacatccagtcatggattcttcaaggcaaagtcatcgtggatggaagagttgtgaataaagctggaacacaagtatctgacaagtctgtcatcgaaatcaaggctgaaatcccaaaatatgtatgtagagcaggacataagcttgaggcagctatcaaaggatttgatattgattgtgatggaaagatagcccttgattcaggattatccacaggtggctttactgactgtttacttcagcatggagcatcacatgtttatggtgtagatgttggctatggacaggtggctgaaaaaattcgcacacatgaacgtgtttcagtgatcgaacgcacaaatttaagatatctatctcaactgccagaaccagttgacttggtgacactagacctatcatttatctccattctcttggtcatgcctgctgttatcaaagtaatgaaaacggattctacattgataacacttatcaagcctcaatttgaagcacgtagatcacaggtaggaggtggtgggattgttcgagatcctttggttcatcaagaggtactggatagaataatttcaggcgtggaagaatttggattctgcaataagggttggatcgaatctcctataaagggtgcagaagggaataaggagtttcttgcttgcttcaacaggatcccaatatcagagtcacagccagaggcagaggcaaaggaacctgtaacctaggatgtcagcagaaattactcaaagtgcgtcatcattgatcaggacaccctcataaagtatctggaagctatattgattatcaaccataacctctgatattcctgacattcttagttgtgtgataaaatttgtccagtcaaaaaaaaaaaaaaaa

SEQ ID NO: 9903 - protein, 297 aa, Zea mays
  misc_feature: Ceres CLONE 466310
  misc_feature (99)..(282): Pfam Name: FtsJ Pfam Description: FtsJ-like methyltransferase
  misc_feature (43)..(90): Pfam Name: S4 Pfam Description: S4 domain
MPFSRPAVGFLVRLVGVRPSCCPPSRAFAAVRAQKIQLPKKKRRLDEVCLERFQQYSRTYIQSWILQGKVIVDGRVVNKAGTQVSDKSVIEIKAEIPKYVCRAGHKLEAAIKGFDIDCDGKIALDSGLSTGGFTDCLLQHGASHVYGVDVGYGQVAEKIRTHERVSVIERTNLRYLSQLPEPVDLVTLDLSFISILLVMPAVIKVMKTDSTLITLIKPQFEARRSQVGGGGIVRDPLVHQEVLDRIISGVEEFGFCNKGWIESPIKGAEGNKEFLACFNRIPISESQPEAEAKEPVT

SEQ ID NO: 9904 - DNA, 566 bp, Zea mays
  misc_feature: Ceres CLONE 466850-R
  misc_feature (153)..(153): n is a, c, t, g, unknown, or other
  misc_feature (154)..(154): n is a, c, t, g, unknown, or other
tcgaggtcgacggtatcgataagcttttttttttttttttttaaaataatgttcgcttcccatataaatgaatggtgcgtgcgcacaataaccacccttgtcacattaacatacatctctttcacataaacagaatacaatgtcgtatatttnntctctattgtgagtaccatttcagaaactaagcttcctgcatagagccccatgtattgagaaaaactatctgatactacaaatcttgaccatggggtgattaatgattagtttttacaatccgaaaaatccccccatggtttgaactaaaaaagtgaaccttgggagggggttaaaattcaaaaaaccccataaacgtatttaaaaatttcggttcgtttcctcccccctaaaaattttcacttttttctcctttttaaaaaacctttatgaattttcttttggcgtcattttgctccttattaattcttccggttcgataaattggttttaatataaaattgtagattcggtatgttatgctgcgctgtgtaatactaattaactcagtacacattaccctttttttacgg

SEQ ID NO: 9905 - DNA, 935 bp, Zea mays
  misc_feature: Ceres CLONE 466875
  misc_feature: Encodes the peptide sequence at SEQ ID NO. 9906
gctgttcgacccaacaccggactcctcccaccccgatcctctacccgccgcacaccccaatggcgaccgccaccgcgtccgtggcgccgccctccacctccacctcctcggtcctcctgcaccgccgtctcccttccccggcgcccgcgcccgcgtccgccgccttcccccggctctccggcccggccccgccgccgcgccgcgcgcgcctgctcctccgggtcgcgctcaccaacgaggtggcctcggacgacgtggcggccgaggaggccgcggccgcgcccaagatcggcaggcgggtgcgcgtcacagcgccgctccgcgtctaccacgtcctcaaggcgcccgacctggacatccagggcatggagggcgtcgtcaagcagtacgtctgcgtgtggaagggcaagcgcgtcacggccaacttccccttcaaggtcgagttcgagctcgccgtcgagggccagcccaagcccgtccggttcttcgcccacctccgtgaggacgagttcgagttcgtcgacggagagtgacagcgtcgagtgcgttcgggtaagcggcgacggcgagcgccgttcttatagaataatcaaggccgcggcggtcgctggtttatactgttccggtgcaggagctcgcgaggcaaggcatgtcaagtgtttgcttactcactgtctgtgctgctcaggcttcttcctcgttcggttcagcatcggtttttcagctgtggggaattaattgttcggatgctgtgcaccatcgatagtttataatagtggtaatttggccgctgttcgttggctatgctctgcgcttagttattttgctggctcttccaagagattcgtttgtctgattggtacacattgcattgaaacccgggattgtttccttggattataaaatctggctattgtaaaaaaaaaaaaaaaaaa

SEQ ID NO: 9906 - protein, 157 aa, Zea mays
  misc_feature: Ceres CLONE 466875
  misc_feature (77)..(150): Pfam Name: FeThRed_A Pfam Description: Ferredoxin thioredoxin reductase variable alpha chain
MATATASVAPPSTSTSSVLLHRRLPSPAPAPASAAFPRLSGPAPPPRRARLLLRVALTNEVASDDVAAEEAAAAPKIGRRVRVTAPLRVYHVLKAPDLDIQGMEGVVKQYVCVWKGKRVTANFPFKVEFELAVEGQPKPVRFFAHLREDEFEFVDGE

SEQ ID NO: 9907 - DNA, 1808 bp, Zea mays
  misc_feature: Ceres CLONE 469569
  misc_feature: Encodes the peptide sequence at SEQ ID NO. 9908
acttcattcgagccctaccactaccagtggcaggcgagcgagaggcggttgaggaggagcggacggaaccgtcgcctgctgcgtctgcctgcgagatctaggcgagcgcggccatgggtgctcgctgctccaagctctccgtctgctggtggcctccccacttcaaatcgccaatgctcgagaatggcgccgccggagatgatggcagcggcgtgccggtgttcgccgagtacagcttcgacgacctccgggtggccaccgacggcttcgcccccgatcgcatcgtgtcggagcacggggagaaggcacccaacgtggtctaccgtggcacgctcttcagctccggccgcaccgtcgccattaagcgcttcggccgctccgcctggccggactcacgccagttcctggaggaggcgagggctgttgggcagctgcgtagtggcaggctggccaatctgatcggttgctgctgcgagagcggcgagcgtctcctcgtcgcagagttcatgccgcacgagaccttggcaaagcatctcttccactgggagacaaatccattgagttgggcaatgaggatgagggctgcgctttatgtggcacaagcgttggactactgcagtagcaaagggagggcactctatcatgacctgcatgcatacagggttgtctttgatgtggatggtaacccaagattatcgtgttttggtctgatgaagaacagccgagatggaaagagctacagtactaatttggccttcacgcctcctgaatatcttaagacaggcagagtaagtcctgagagtgttgtttacagttttggcactgtcttgcttgatctcctgagtggaaagcacattccaccaagtcatgcactcgaccttataagaggaaagaactttctagtgctgatggattcttgcttagaaggtcatgtatccaactcggacggaacagacttgatgcgattagcatcccgttgcctgcaatatgaagcacgtgaccgtccaaatctgaaaactgtggtatctggtctcacaagtctccagaaagatgcttatactccttcgcacactttgcttgggattcaacatgataagaacaactcaggtcaagtttccttatctgctattgggaaagcttttgccagagcagacctgaatgaagtgcatgaaatattgctgcatgatggatataatgaggacgacgaggctaatgctgagctatctctccagtcatggaatggtgatatatctgagagctttgttgttaagaggcgtgcagacaatgcctttaggtctaaggaatacacgactgcaatcgagtgttactcaaggttcctcgactcaggtgcagtggtggctccaaccatgctgggacggagatgcttcgcacatgtggtggccggcaacccacaggaaggcctcgaggatgcaaagagagccgagattattgcatcggactggccgatgggacactacctgcaggccctggcacttcataagctgggtagggaggctgaaagccaagaagcactgaagaatggcactgccttggaagctgcaaggaatagtagagctagaactgtatagccctgaatttgtgataccatgcccttcctgcttgtacctagatcgcctgcatttcgggtgcctacctccaatccaatgctttgccaccagtagggttgtttttggtattccctaacttgtatcgttatttcccgtggttttacaagtcgaagaactcctaggtcagctgttattacacctccaatatatccatgaatacaggtaaaaaaaaaaaaaaaa

SEQ ID NO: 9908 - protein, 491 aa, Zea mays
  misc_feature: Ceres CLONE 469569
  misc_feature (68)..(307): Pfam Name: Pkinase_Tyr Pfam Description: Protein tyrosine kinase
  misc_feature: SWISSPROT Homolog: EC 2.7.11.1 Non-specific serine/threonine protein kinase
MGARCSKLSVCWWPPHFKSPMLENGAAGDDGSGVPVFAEYSFDDLRVATDGFAPDRIVSEHGEKAPNVVYRGTLFSSGRTVAIKRFGRSAWPDSRQFLEEARAVGQLRSGRLANLIGCCCESGERLLVAEFMPHETLAKHLFHWETNPLSWAMRMRAALYVAQALDYCSSKGRALYHDLHAYRVVFDVDGNPRLSCFGLMKNSRDGKSYSTNLAFTPPEYLKTGRVSPESVVYSFGTVLLDLLSGKHIPPSHALDLIRGKNFLVLMDSCLEGHVSNSDGTDLMRLASRCLQYEARDRPNLKTVVSGLTSLQKDAYTPSHTLLGIQHDKNNSGQVSLSAIGKAFARADLNEVHEILLHDGYNEDDEANAELSLQSWNGDISESFVVKRRADNAFRSKEYTTAIECYSRFLDSGAVVAPTMLGRRCFAHVVAGNPQEGLEDAKRAEIIASDWPMGHYLQALALHKLGREAESQEALKNGTALEAARNSRARTV

SEQ ID NO: 9909 - DNA, 1663 bp, Zea mays
  misc_feature: Ceres CLONE 469847
  misc_feature: Encodes the peptide sequence at SEQ ID NO. 9910
cgaccagagccagtccgctccgctccaccccttgctcacctccgcgacccgcaccaatggcgacgcccacggctccatcccgcttacccctcgccaccgcctccgcgtccacctccttctccgaccgcttcctccgcacgccgtgcgcgctccggccccgctcttggccccgcctgcgggcgggctccgtcaaggagtggcgcgagttcgaggacgacgcgggcgccgtcaaggagtggcgggagttcgaggacgccgtcaggaggaaggacctcccccgcgcgctccaattcctgcagtccgtggagcccgcggcggtgcaggtcgcggtccccgtgccgccggggcgggactgggaggtgctcgacgcctgcgtcgacgccgacgacatgcgcctcgtcggccgggcgtaccagttcctcgtcgaccgcggggtcctcgccagcttcggcaagtgcaagaacatcgttctggaagggccaagagaagtgacaccaacggttttgaaggagatgaccggtttggaagctgaaaaacttgcgccgaagaaatggggtctgtcgggaagttcaccgtatgttctcattggatttcttggaggcgtatcctttctactaacacaaggggtcgatctacggcctaaactgagtgctgtattgggattagcagcagccgatgcaatgttgctcggtggtacttgtcttgctcaaatctcatgtttctggcctccgtataaacgtcggatccttgtacacgaagcaggccatcttcttactgcttatctaatgggctgcccgatacgaggagtcattttggatccatttgtggcattgcgaatgggcatccagggccaggcagggactcaattctgggatgaaaagatggaaaaagaactagctgagggccatctatcaagcacagcgtttgacaggtactgcatgattatgttcgccggaattgctgctgaggcacttgtttacggggaggcagaaggtggagaaaacgacgagaacttattcaggagtctgtgcattctactgaacccaccccctgctgttgcacagatggcgaaccgagctcgatggtctgtcatgcagtcttacaacctcctgaagtggcacaagaaagctcatagagccgcggtcaaggcgctggaagacgggcacagtctcagcgttgtgatcagaaggatagaagaagccatcgcttctgacagcaaataaatatgaccgttgatcctttacatgtgttcctgtcaaccgatctttgttggcagcttccacaggacgcggaaggagagctttcataattcgcgcgaagagttagtgtgtgttggaacatgagtggcgcttttcaaagaaagaaaggcagaagatccttggagctggagggaatagcggagaccacgaccagggcgtctgacggacggactagatcgaatgatacatccgttggagattttaaggaagtcaaaaggctgttgtgaacttgtgattagtgtcgatgccagatatggcagatgtgcatagggagatatgaatatatgatgtcttgatgagtatgcagacatgagctattttgtaatggatggaaaagtaccgttggtacttgaggcacttctattgtttattatttatttatttgcagaaaaaaaaaaaaaaaa

SEQ ID NO: 9910 - protein, 388 aa, Zea mays
  misc_feature: Ceres CLONE 469847
MATPTAPSRLPLATASASTSFSDRFLRTPCALRPRSWPRLRAGSVKEWREFEDDAGAVKEWREFEDAVRRKDLPRALQFLQSVEPAAVQVAVPVPPGRDWEVLDACVDADDMRLVGRAYQFLVDRGVLASFGKCKNIVLEGPREVTPTVLKEMTGLEAEKLAPKKWGLSGSSPYVLIGFLGGVSFLLTQGVDLRPKLSAVLGLAAADAMLLGGTCLAQISCFWPPYKRRILVHEAGHLLTAYLMGCPIRGVILDPFVALRMGIQGQAGTQFWDEKMEKELAEGHLSSTAFDRYCMIMFAGIAAEALVYGEAEGGENDENLFRSLCILLNPPPAVAQMANRARWSVMQSYNLLKWHKKAHRAAVKALEDGHSLSVVIRRIEEAIASDSK

SEQ ID NO: 9911 - DNA, 703 bp, Zea mays
  misc_feature: Ceres CLONE 469858-R
  misc_feature (306)..(306): n is a, c, t, g, unknown, or other
  misc_feature (395)..(395): n is a, c, t, g, unknown, or other
cgggcccgccctcgaggtcgacggtatcgataagcttttttttttttttttttgcaaaaacagtcagcttgataaacttatcgagaaggcaacaccggtgcccaagtactggttgaaatacagagcagacattgaagtgccaaagaggggggtaaattaggcatcttccatagcccattaagcattaagctatgcaaaactgcaaaaagctaaactacaagaccaggggctcgagtctagaagcagttcatcagtggcgatcatcaaaacgacctcctcccctgctagggcgatcatatggcccangcctgtccctgtaacttcccccatcatagcgtgcaggtcctcccacaccataacgatcagcaccaccaccgcttggggcacccctgacntagccaccaccattgcgcctccagggccatccctggcataacttccccacccccttgggccattccataaaagcccccgccgccccgaatcccaatctctccgaagcttctttccccgtccccccccaaaaccatttggggcggaccaatcccgggccaccccataactgtgttcccgcaaaaggaaccccccccccggggagaaccgaaaatttgggaaaaaaaatttctggcccccccaaaaattgggcccttgggtcaaaattggtaccggggccccccaaaaccccccccccctatacaatatt

SEQ ID NO: 9912 - DNA, 1028 bp, Zea mays
  misc_feature: Ceres CLONE 472577-R
  misc_feature (39)..(39): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (79)..(79): n is a, c, t, g, unknown, or other
  misc_feature (913)..(913): n is a, c, t, g, unknown, or other
aaattattattaaaaaaaacaaacaaacaacaatatatnaaaaacaactcgatccatcaaaaaaannnttgagaataangggcaattgggtacgggccccccctccagtcgacggtatcgatattttttttttttttttttgttttttttttttttttttttttttttttttttgggccaatacgtttatactcatccattcagtcaatcatggagagtagcagtggttttacaatgtacaaatggggcgagtcaacaatcttgggtaccttctccatgaaatcaaacatctcctcgtaactctccgcctgctcggggaaatttgccatgttaacattttccctaccggaaaactctgcttatgccctcttaaagatcaattttcaaaaatttcaatacgcccgatttcttcgtgcgttcgtagggcgtcccccgtcgaaatccccggcttcaaaaaggggggggttttttcaattatagaaatttctataggtaaatggccccccttccaagatttcctttcaagccccggggggaaacacccataattttttataaagacaggcccaccaaacccccggggtggggaagattctccccccctttttttttttttccccctcttttaaagtgagaccggagtttaataaaaatttgcgccatcacccctattttggagcgcgaataaactacccaatgaggatgacctaaaaaaaagagacatgtggttattttccccccgccagttgttgagacaaaaaatatatatgttttaatgtcctccccccgctccgacactataaatagtttcgaaccgccgcctaacaccattttatcgctatcgaattgcgaaaaaaaaatgtcctttaaacaaattggtgtatataaagagccccctcgttgcgggtgtgcncccctcattattagtagaggtgaagaacactaaaacaccctcacaaataattttatatatatttttgttcatatacatagcaattaacattatgctcacacatgcattattacaa

SEQ ID NO: 9913 - DNA, 794 bp, Zea mays
  misc_feature: Ceres CLONE 472605-R
  misc_feature (52)..(52): n is a, c, t, g, unknown, or other
  misc_feature (225)..(225): n is a, c, t, g, unknown, or other
  misc_feature (226)..(226): n is a, c, t, g, unknown, or other
caattggggtacgggccccccctcgaggtcgacggtatcgaaaagctttttnttttttttttttaagcgcacagcaccactaatccatcagcatcgtctgacttggcaccattctattctaactccacccaagaacattcacagctggtgacgatgcgatcaagtcaacaacattcacgcgttcgactagtacaatctgaatgaatcaggagggtgcctgacagnngcggaaaaattgggggggggttaacggggggggggcccccccccccccccccctttccgggaggggggttttcgaaaaagggggggttttttttccgggaaatttaaaaggtttttggggcgtggtttttgttgtctttggggtggggtattacttttttgggggggggggggccctttggggggaaaaaaagaaggggggcccacattttttttttttttacgggcgggtaaacaccacccgggggggggtgtggggggtttttttttttaaaaaaaattttttttaaaaaaaagttttttttcggaaaaaaaaaagggagggggttttttttctccccgggcgcggggggggaagaaggtcttttgtcttctctgtgttaagaaaaaatattgtttattccaaacctccgcggggggggggggggggggggcggatatatataaaaaaaaaataattttttttttcccctcgggggggggggggggggaggagggaaacccagcccctttgtggggggggagaaaaaaaaaaaaattatatttttttggggggggggggggggggg

SEQ ID NO: 9914 - DNA, 665 bp, Zea mays
  misc_feature: Ceres CLONE 472616-R
cgaattgggtaccgggccccccctcgaggtcgacggtatcgataagcttttttttttttttttttgacattcacacgatgccactatgtagtatttcaaacagtccaatttgacactgtttcgaagacagtacgttgtagctcgaaagaaaaactgctaatttatattactccatatatgtttgtagcacacagcgtgaatacagaatgctcattatgcccatggtgcacaacaaactactgggattagccatgacatggtcaaaaaatagcatatcggagcagatacaaatgggacgattcaccaccatcaacaaaatctcactatggctctacactagcaaaacagcattgatacagccatcgttctccgggttgtttgtaacttgagcatatttcccccaaacaacttttccagcgggagttaccagaccaagctcactgacatttacctcaatgatcgttccccttgtcataacaccaaagagaagtgtacattgggacattttgggttttttcctttcacagaaaataggtcaagggttgaaaagtgcactttcaacctctgggggtgagtcacaatggaaccctttgggtggaaaacccccaaaaccaatttttgggcccaaaaagaaaccgcgccaaaaccttgggggggggttcccc

SEQ ID NO: 9915 - DNA, 1185 bp, Zea mays
  misc_feature: Ceres CLONE 472687
  misc_feature: Encodes the peptide sequence at SEQ ID NO. 9916
gagggagcggggataagcgagggaggagggggaaaccgaagatgctcctgctgcgcggcgccagggcggcgtcggcgtgggcggcatccaccgcggtgtccgcaggcgccagcagcagcaggtccatatccattcggctggcccccgtcgccgcattgtcctcgggcggaaggaagaggaagggccagcggcggggcgaggccaagcccccgagcccgccgccgccgccgcccctgcctcggcagggcgagaccccgagcagcaagaagaagtccggcgcgaggccgtcgggcgagggaaagaagagccgcttggtggagctggaagaagcgcgcggcccgcggaggccggagggcggcgaggcgaggaaggggaatacgcagcagcagcagcagcaggaggagaaggcgaaggcgaaaaggctggtgaagtggaagtgcgcgagcgggtgcggtgcgtgttgcaagctagacaaggggcccgacttccctattcccgacgagatcttcgccgaccatcccgatgacctccagctgtacaggagtatgatcggctctgatggatggtgcattaactacgacaaggccacccgcacctgcaacatctaccaagaccgaccttccttctgcagggtggaaccaaagatttttgatgaattatttggcgtgccacgcagcagatttgaccgggaagcttgcagtgcttgtgtggataccatcaagatggtgtatggtgatgactctgctgaactcagtaatttcaagcgtgtgataagggaggaaagtaacaagctggaaagcaagaaccaagatacattgttggatgcatagatcctgcatggatctgcaatagaatctacagcacaccacattatatgcgaaggtaaaattgagaagtgaacaatgctcttaggttaaggtggaaaatggaacatcttgagggaaatactcagtgcaagcttcagttctgaacacgtccttgattcttttagtcaagcttggtgtgttcagaagtctgtggtgttttttttgtatatatagaaaattgttagcaggcaagagcatttcagttgattttgttggtcccagacttatcatttgattgcggtcctagtacttgaatttttgctgcgtgcctaaagtcgtatgcctatttcatctgtactatctaaaaaaaaaaaaaaaa

SEQ ID NO: 9916 - protein, 262 aa, Zea mays
  misc_feature: Ceres CLONE 472687
  misc_feature (132)..(223): Pfam Name: UPF0153 Pfam Description: Uncharacterised protein family (UPF0153)
MLLLRGARAASAWAASTAVSAGASSSRSISIRLAPVAALSSGGRKRKGQRRGEAKPPSPPPPPPLPRQGETPSSKKKSGARPSGEGKKSRLVELEEARGPRRPEGGEARKGNTQQQQQQEEKAKAKRLVKWKCASGCGACCKLDKGPDFPIPDEIFADHPDDLQLYRSMIGSDGWCINYDKATRTCNIYQDRPSFCRVEPKIFDELFGVPRSRFDREACSACVDTIKMVYGDDSAELSNFKRVIREESNKLESKNQDTLLDA

SEQ ID NO: 9917 - DNA, 650 bp, Zea mays
  misc_feature: Ceres CLONE 472827-R
  misc_feature: Pfam Name: DNA_primase_lrg Pfam Description: Eukaryotic and archaeal DNA primase, large subunit
  misc_feature (1)..(1): n is a, c, t, g, unknown, or other
ncgattgggtaccgggccccccctcgaggtcgacggtatcgataagcttttttttttttttttttgagagcaagcacagctgatcctacattaaatgcagaatagtctgggttctttcgagaattacatgtagagagtctacagacgccttgacctgctgatgttcgcagcactaggtaacaattctagtatagagtgtggtgccagtgccatcacttgttgggtatgactatgacagctagcagctggagcctggaggttttcgtttaggccaactggccaagccagcagctgggatttggaaacaccagggagcaacaatattccaggtaagcgccaaaggtacagccagtgacgataacataattggcatcaaggatgaattttgcttcagtgcttacctgctggtaagttttttgaaaatgtatagtttctccagctgctgacacaatttaggttgctgattgcgattggctctccattgtttggtttttggctcgcagaactttctggctttcgctgaaatattgatttggatggttgattccagaatcacaggagacaccgtgtgtggcctcaaaggttaatgtgcaagctacctggtaatgcctgttcttcactttatccattacctcttccaatgcatgccc

SEQ ID NO: 9918 - DNA, 859 bp, Zea mays
  misc_feature: Ceres CLONE 475192-R
  misc_feature (27)..(27): n is a, c, t, g, unknown, or other
  misc_feature (28)..(28): n is a, c, t, g, unknown, or other
  misc_feature (59)..(59): n is a, c, t, g, unknown, or other
  misc_feature (72)..(72): n is a, c, t, g, unknown, or other
  misc_feature (74)..(74): n is a, c, t, g, unknown, or other
  misc_feature (224)..(224): n is a, c, t, g, unknown, or other
  misc_feature (236)..(236): n is a, c, t, g, unknown, or other
ttcttttctttcccacaaacacttctnnaaaaaattaaggttttggatggtttctattntttttttaaaaantntcctttgggtcgggcccccctcgagtcgacggtatcgataagcttttttttgttttttttattttttttttttcaacagcaacagaagaaccattttatcaagctgccggcaacaattgattacatatacaaggcacaactgtattcccngcgtgatccggntcccagtcttttaccacttgtatccgaccacaactggaagtttgatcacttacaccgtttttctctccgatttaattgcttctaaattgacaactcttgaattctctctgcagatctctatcttttgattttggcagatgcacttcatcgctttttgttctaaaagaggcttcacttcttgatctgtatttggggtccctccgggatctgttcaagaacttaaaaaatggcatttagggatccccacattgggaaaaaaccccctagggccccctgcccgggggttgtttaactcccccccccccaatttttttaaggggttccgcgggaagggagaaaaaaaattttttttgggttttttggcccaaatattaaacaaattactcttccccccgaggggggattgttttttattttgtttcccccccccgaaaagaaggggggggcctttttttctcccccccccacaggtttttttttataaaaccccgcggccaaaaaattatttattcccccccccccctcggggtgaaaaaaaaaacacccccggaaatatagcccctttttttctttttaaaaacaccccctcttggtggtgccccccccaaaaatttcgcgggggg

SEQ ID NO: 9919 - DNA, 628 bp, Zea mays
  misc_feature: Ceres CLONE 475218-R
  misc_feature: Pfam Name: FYVE Pfam Description: FYVE zinc finger
cgattgggtaccgggccccccctcgaggtcgacggtatcgatattttttttttttttttttgacgcactacagtctcacaagatctagtaaatttgtcacaaaccctgcggttgaaagcactgaaatctgctgcacatgctgtgcacttgctgacagcttcatctgggacccagtgatctttctcctcattcataggcttcattaaattcctccaatcaaggaaatttttcttcctctcattttgctgctcagcaggcttggatgcatcagcaattgctctacttcttgaaatgctgctttcacccatctccttgaactgcacagtcgcagctgtgacagtgtcaagaatggtgttggatgtatagctgtttgatttcagccttattctttttccttcaacatccactgaactcttggaccaaaaggcaaaaatagaggaatctaatacatcgcatctagttacagtttcaaggggatatattcttagtgtcctaccagtgttgggatcaagcatccgaattccatccagaccaacctgacagagcacatccatggggctcccagcgccctccggcagcagcttgaccctgaacttctgcaccccacccctgacgtcctctgacgtct

SEQ ID NO: 9920 - DNA, 700 bp, Zea mays
  misc_feature: Ceres CLONE 475245-R
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (17)..(17): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (41)..(41): n is a, c, t, g, unknown, or other
  misc_feature (42)..(42): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (64)..(64): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (560)..(560): n is a, c, t, g, unknown, or other
nnnnnnnnnaaaaaaanaaagannnnnnnnnnannnnaagnnagggaaagnnnnnnnnnnnggnggnnnnnnnnnnnnnnnnnnnnnnnnnnnccaattgggtacgggccccccctcaaggtcgacggtatcgataagcttttttttttttttttttgtaggctttggaaatctagttaatccgcgcacttatatataatgtacaaacaccatggacacagagcacccatagagagctccagagagtcctgtgtgaatgtatgtagcagacagcagagcacagacatggcggagcagccaagcagatagatacctaggagtccgctgtcctgcccacgcaaactaagcacaaagcgcccagcgaggggtgaaaaacccccaaaggctaaagtcttaggcttaatcccatggctcaggccaccttcagcccaggaaagggaaaagccaaatttttcaaagcaaaattttcccgggtttccgggggcctttttttgggggaaaaaaagggggggggggggggtttttttttggaaaaaaaaggaggggcccccggggggggnaaaaaaaaaaaaccccccccccggggggggggggttttttctctcccccccccccggcggggggaaaaaaaaaaaaccccccccctttcttgggggtgggggccacccacttattctttttttttttttgtgtggccgcg

SEQ ID NO: 9921 - DNA, 599 bp, Zea mays
  misc_feature: Ceres CLONE 475265-R
tcgattgggtaccgggccccccctcgaggtcgacggtatcgataagctttttttttttttttttgcagttaaatcacatatatgtattatttattattattactactacaattgttcatcataatatcatatgtatatcatacatacatcatacatacggtatctttctctacgaagatgtcacgataactcgtgttacctgaacacagagtcacaaattcacagtatacatacataatagagggttcccacgcagaataagtttagggaaatatggcacttggcacgccacaagtaacgccagcacatgcctcatgccgaggagaagcgaagcgaggggaggggagcttcttcctccctgcttccctccggcaatcagtgggatgtcccagcctactctcaggtgccgatccatcccatacacaactactactcgtctgcttttagagccgagagatgagcagcgggacagacacagggctgtcctcgcccatggcagggtggcacatctccagcatgtcgagctccctgaaccgctccagaacccgcatcttgcactcctcggccgccatgacacccgtggagaaggcgccgtgcac

SEQ ID NO: 9922 - DNA, 626 bp, Zea mays
  misc_feature: Ceres CLONE 475452-R
  misc_feature: Encodes the peptide sequence at SEQ ID NO. 9923
tcgaggtcgacggtatcgataagcttttttttttttttttttcacaatgctatagcatgtctcgctttattggaggtgctgagcatgagcatacgtcagtcaagatattgcatggaaaatacagcagaggaaatacgataaaggaactgcctgaaaccattggacaaatgacaatcatgattcattctctttagcttgggccagtaactctgcctgcattctctttatctccagctccctttccatcctttctttcttctcgtcctggtgaagggcgatccagacgtggaccctgtccatggactgccagaagaggaacgccccgaaggtcatcgcgaagtaggtcgccacccgcaccatcttcttccccttctccgatctctctggctgcgcccctctctccggctctctcctctccattacgagcaggtatatccatttcctccccacattatacaccctttactatactgtaaaaaactccccagtcgcctccaaacgattatttaacgcgaattataccctttccgtaacccttcacccttttaacaccttctctttaccctcccctatctcccgtctccccccccccctccttttgccctcatcctatctcccttcccccc

SEQ ID NO: 9923 - protein, 63 aa, Zea mays
  misc_feature: Ceres CLONE 475452-R
EVDGIDKLFFFFFSQCYSMSRFIGGAEHEHTSVKILHGKYSRGNTIKELPETIGQMTIMIHSL

SEQ ID NO: 9924 - DNA, 1039 bp, Zea mays
  misc_feature: Ceres CLONE 475562-R
  misc_feature (28)..(28): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (1039)..(1039): n is a, c, t, g, unknown, or other
atgtatgagtagtaaaaagaaaaagggnaaaaaattggaagaagaggggggnnnntttctgtaaataaaacaattgaggtacgggccccccctcgaggtcttcctatcgacatttttttttataagttttcaagcagacgccacgatcgggtttcgagcctccaagggccgctggacccgggagcaagcagcgaacgaacgctctctcctttggagacagcgcctgtctgtgtgtacctggtggctggcactctgtgcccgcttccagactcaactcatcctcatgagcatcacacatgttcgatgcctacgtactatgatggccctgaaccacctcctcacactagctacgactacgataagataaaaaccaaaccatacgaaggttgcctgcgtctgcatacagggaaaacaaaaaataaaacactctgcgactgactgattcctcggttttggaacgggcccacagggcaagtgccccccccccccaaaaaacgtggggccccagtcgccgcggaggggtcccctccccttctccctaaacctaaaataaaaagcctggaaagtttgaagccacgaaggggtaaaggtggcccttgggccgatccaggtttcctgggggatattaaggtagaccgggcccggagaaggcgtctttcccgcggcggaaaaagacggggtgtggaaaccctcctacggtaaagaaaagggggctccccaagtataacgggggtacacccgccccccgatgccaacccgagttttgtgccctcccccaaaatggggtggcggaattggtttccaatcccaccttcactccaataagttaggtgacttcttgtatccttctacatatgagcactgtagattcttcattacactccagaaggaggataatccatgcaagaattgagggtgatttctcacgaccatatagacgggagcgctcctctattaaaataaagaatcacacgcgcgcgtcacaagaactggcctcgtgagaaaggtgccacaggatatatacaaactaggacgctcn

SEQ ID NO: 9925 - DNA, 791 bp, Zea mays
  misc_feature: Ceres CLONE 475585-R
  misc_feature (21)..(21): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (37)..(37): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
ttttttttgtggtggggtgtnttgtnnngnnnnnatncctnnnaaacgattgggtacgggccccccctcgaggtcgacggtatcgatattttttttttttttttttggcgagaacaaggaggcaatcactttcttattctacggattctatctgggtacattctcacgagaatcagagacaaactagcttctcacaagcaatcagagggcagcatcgcatcaggaggggtttttggccttgattctgagcttccgcgcaacggccgcagctcttgggtgggcagtcttcctgccgctgctgtcgccgctgctctgctccatctccacccagttgatcacccgcagcatcaacgactgcgggcaacagcagctgctttgcttccgcccgtcccccatggaagacgccttggtcttctttagaccggtctccagcgcggcctccaagaagtccatgaaccagccccccgcttcggcctgtatcttcttagccagcttcagcgaggagcccagagcaaagtgcgcagtggtggtggtggcagaggaaggaccagaagaagatgatctcttctcgtcgccaccgtcttcgccgatctttgtccgtggcgaggcacttcctggtgggactcgagcctccggatgggcttgccgcctccatcgtcctgcttccgggtccaacggggccgggcccgaacgaacattgatttgggaacggctcccccaggccgatggcctttccgaagcaccaccgtgtctggtttcgggctaatctcccgggaaggaccgggcgggcg

SEQ ID NO: 9926 - DNA, 857 bp, Zea mays
  misc_feature: Ceres CLONE 483000-R
  misc_feature: Pfam Name: Bac_surface_Ag Pfam Description: Surface antigen
ggagctcaccgcggtggcggccgctctagaactagtggatcccccgggctgcaggaattcttttttttttttttttttgcttaacaataaataataagaagaatgcatcttgtggatcccaactatacaccttttgaatgccagcacgtagtacaaacaataagattctgctggcatgtccggaacacacactgtcaagaaaaagaactccccttctatgtccacaaaaaagaatcgaattgaattgccagtctatgttaagtgagatctatgtctttcataacctaacagccaccgctactgttgattccaaaatagatggttttgcggttaaatgcattcatagcgtagtcgacacggatctgacctaggtcagtgttgaagtgaagtccgtatccaaatccaataccaaatcctggtttcccctgccgcagagctggattaccagggacatgacgagcagaccctaagtcactcccacagtccatgaaaatagaaccctccagatgcttcaccaagggaatcgtatattcgcagttagcaattagacatagtcttcctgaaccaacagcgccctcaccatagcctcggacactaccaagtccacctatgtcaaaagcttgataaggtgccatgtccccaacaatggatccgcctgtcaaactagtacccaaaaatgtccgacccactttaatgccttttgaaactgcccatttaactctattgaagggcaatgacttaaggacaattggcaatccttgttccctttgaaagttaacttttaaaaacctattggcattgaaatccacctaaccagattcctgcctcaagaatgacatgttgtcctgggaagctac

SEQ ID NO: 9927 - DNA, 605 bp, Zea mays
  misc_feature: Ceres CLONE 483207-R
gcggtggcggccgctctagaactagtggatcccccgggctgcaggaattcttttttttttttttttttatttgtttcgaaaaagatatcgtccgattctccttctattgattcttttccgatcgagatgtatggatccatgtgtctacatacctagattctgttcatggattaacgaaaatgtgcaagagctctatttgcctctgccattctatgagtcgcttcctttttgcgtatggcacccccactccctttggcagcatctactaattcggaacttattttgaagccatatttcgaccccgacgcttttgggatgcttctaataaccacgaattggcagtgctccttccctgtttaaaacccatttcaatcagaactttccccgccaatactttttaataaccccttggttttaacccccaatttgggaggtaccccacctttttgtttgcgcaaaaaccaaaaagggaatttgttttccggcctttttgtggaaaatttttttcccggccccttgagaaaaattttttaaacccccagagtttttttttccccccttttaaaaaaaggggggagacccccctgttttatataaattttatg

SEQ ID NO: 9928 - DNA, 652 bp, Zea mays
  misc_feature: Ceres CLONE 483287-R
  misc_feature: Translation starting site: 292
cgattggggaccgggccccccctcgaggtcgacggtatcgataagcttttttttttttttttttaggtttcaaatttattttggatagcgttcaaaaataacagctcagaggagcaacaataagcataataaaaatcatcagctcatatcaccatatctcaaattcatacaatctcaagttcccatctgagcacatggacaacaaaaccgaatctacagaaggttcttcctctgcttgcgaacaacgaaactagtaccatcaagagcataagcatacggagagcaggaaggatgaggaaccggtacgagccgagcggcgcctacttctcggaggagttgggcccgcgcttcttgccgaagccgacgacggcggtgacgaagcggcggttgtactgcatcctcttgtgcgcgcggccgcggggcttcttcttcttgtcctgcttcgccaccttgggggtctgcccgcggaccttcccggcgcgcgccaacgatccgtgcaccttacccatggcaacgagacggaaacggtgatggaggagctgtcggacgacgccgcgccgatcgacaaggcctccgacagcgcctcttcctccctccccgccgccgccgcctcaccgccacgctcttcctcttccttctcacgttcttggac

SEQ ID NO: 9929 - DNA, 2302 bp, Zea mays
  misc_feature: Ceres CLONE 483514
  misc_feature: Encodes the peptide sequence at SEQ ID NO. 9930
gagattcgccgtctcaccccttccctgcctgctccctcgtctaagaaaagcgggcagagcagagacggcggcggcaggccatcgcggactcccgctcaccctcgtctgccaccgcctcccaggtcaggggccgacggcgacgggtggggaggggcggcagaggtagtccgaggggaggctgtggagcggagggcggagagaggccacgccgtccggagtctccagttccgtcgccacagcttcctgccgcgcctgggccgaggtaaacgagagggatcgaggaagaagtatcccccggagccccttcccccgaacccgaaggctccggaatggcgcactgggttagcgacagtgatggcagtgacaactttgaatgggatagtgatggcaatggggaggagccagcgaacttcaatgctgctggtgccggttcatcagctctgagatcaacgaacactgatgctccaggtccatcaacacgggttgctaatggcaatgggaaggctgggccatctgcctccttggttcaaaagtatatggacatgggtttcacggaagagattgttcggaaggccatgaaggacaatggggataatggagcagattcattagttgagcttcttcttacttaccaggaactaggcaatgacctcaaagtggataacggcttcgcttctggttgtgccccccaaactgttgatgatagtgatgatgacgacattctagaaaactgggatgatgaggatgctgatggtgggagaagcaccagggttgctaactctattgatgattctgaagacgaggatttcttaaatgagatgtcacagaaggacaagaaagttgattccttagttaaaatggggtttcctgaagacgaggctgcactggctattactagatgcgggcaggatgcatctatttctgttctggtggattccatatatgcttcacagaccgcaggagatggttactgtggcaatttgtctgactacgagggtaattccaatggagggagaaacaaaggaaggttcatggacgggaacaaaaaaaagagaaaaagatatggaggtcaagcacagggaaatagaggcccattagatggtagctgtgaagaacccatgcctctcccaaatccaatggttggatttaatttgccggaccattggacaagaccagtagacagatcgctgcctacacaagctattggaccaccatacttctactacgagaatgttgctcttgctccaaagggtgtctggactaccatatctagattcttgtacgatattcagccggagtttgtggactccaagtacttctgcgctgctgccaggaaaagaggctacatacacaatctaccacttgagagaaggtcgcctctcctccccatacctccaaagacaatattcgaagcatttcctcgtaccaagaggtggtggccttcatgggacccaaggcggcagttcaattgcctccagacttgtacgtctagcgcaaaactgttagagaggattcgtgtaacccttgcaaacagttcggatccacctcctccattagttcagaagtttgtgctggaggagtgtaggaaatggaatctggcttgggttggcctaaacaaggttgctcctctagagcctgatgagatggagttcctgcttggctttcccaaggatcacaccagaggtatcagcaggacagagaggtaccgatctcttggaaactcgtttcaggttgacactgttgcttaccatctctcagtcctcaaggataggtacccacaaggcatgaacgtgctgtctctattcactggcatcggaggagccgaggtggctctccataggctcggcatacgcatgaacacagtcatttcagtagagaagtctgaggtgaacaggacaattttgaagagctggtgggatcagacgcagatcggtaccttgattgagatcaatgatgtgcagacgctgacagctgataggatcgaggcatatattagacgaattggcggctttgatctcgtgatcggtggaagcccatgcaacaatctcgctgggagcaaccgccaccacagagatggcttggagggcgaacattcttccttgttctaccattattttaggatcttggactccgtcaagtccatcatggagcgcctgtagtttttagaaacttttgatgttctggttcgtagaattgtagccgtctttccccgtgatcaaacttgtgaatgatttgaaggtcgactggtgtaatattcatgtcactctaatttaggctactttcgaaaaaaaaaaaaaaaaaa

SEQ ID NO: 9930 - protein, 609 aa, Zea mays
  misc_feature: Ceres CLONE 483514
  misc_feature: SWISSPROT Homolog: EC 2.1.1.37 DNA (cytosine-5-)-methyltransferase
MAHWVSDSDGSDNFEWDSDGNGEEPANFNAAGAGSSALRSTNTDAPGPSTRVANGNGKAGPSASLVQKYMDMGFTEEIVRKAMKDNGDNGADSLVELLLTYQELGNDLKVDNGFASGCAPQTVDDSDDDDILENWDDEDADGGRSTRVANSIDDSEDEDFLNEMSQKDKKVDSLVKMGFPEDEAALAITRCGQDASISVLVDSIYASQTAGDGYCGNLSDYEGNSNGGRNKGRFMDGNKKKRKRYGGQAQGNRGPLDGSCEEPMPLPNPMVGFNLPDHWTRPVDRSLPTQAIGPPYFYYENVALAPKGVWTTISRFLYDIQPEFVDSKYFCAAARKRGYIHNLPLERRSPLLPIPPKTIFEAFPRTKRWWPSWDPRRQFNCLQTCTSSAKLLERIRVTLANSSDPPPPLVQKFVLEECRKWNLAWVGLNKVAPLEPDEMEFLLGFPKDHTRGISRTERYRSLGNSFQVDTVAYHLSVLKDRYPQGMNVLSLFTGIGGAEVALHRLGIRMNTVISVEKSEVNRTILKSWWDQTQIGTLIEINDVQTLTADRIEAYIRRIGGFDLVIGGSPCNNLAGSNRHHRDGLEGEHSSLFYHYFRILDSVKSIMERL

SEQ ID NO: 9931 - DNA, 1407 bp, Zea mays
  misc_feature: Ceres CLONE 483599
  misc_feature: Encodes the peptide sequence at SEQ ID NO. 9932
acgagccttacgacatcagcaacaaaccaaacaaaaggacacttcgtgagagaacacgtcggtggctcggtgtcagcagcgagccagcgacggagccccaccagacaccgcagtaccgcaccgcactgcccatggacgcacgcctcccggcgcgcccaccccgcccgcgtgcgcgtgcccctgtccgcctcccgtttgccgcctccaccgcaacgcggcgcgcggggtggtggtgccctcgcgatcctcgtgtcgatcccagcggcaggggtgcctgtgcctttgcttctcctggccgttgcccgcgcctcgcggtcgcgcacctgaaccggagccccgcgtcaaatctagggttgcatccgcgccgccccctcctcccgagactcccagcggctggaaccagaacgagggtgacaggcgacgaaagctgcgacggacgccccctcgtcgaatgcactggcgaccgttccgtcgaggagcagccggagcacgcaggagttgagggaaaagctttgaaaatgtcatccaccgtgccgaagtcatcaaatatcttctggcatgattgtccagttggcaagactgatcgccagaagctactcaagcagaaaggctgtgttgtctggattacaggccttagtggttcaggtaaaagtaccttggcatgtacattaggccgtgagctccacacaagagggaagcttgcatatgtccttgacggtgataacttaaggcatggtctgaacaaggatcttggcttcaaagctgaagaccgtgctgaaaatataaggagagttggtgaagtagcaaagttatttgcagatgcgggccttgtatgtattgcaagtttgatatctccatataggagagaccgtgaatcttgccgtgcattgttgtctgatagtagcttcattgaagttttcttgaacatgtccttggaattatgtgaagcaagagatccaaagggcctctataagcttgctcgtgcaggaaaaataaagggttttacaggaatagatgacccttatgaagcaccactgaattgtgagattgagatcaaagaggtagatggtgtatgccctccgcctgctgagatggcagggcaagttgttacttaccttgaggagaaaggcttcctgcacgagtaggctgaatccaagcaacatctggggaagatttcagtaagactagcgcagaataagtcaaaggcgctggcagttacggtatagcagttgcatagattggcctcaatgccttagtattttctttccgtacttcctctgccacaggctccatgcaatttcattcagatgagcctggatggttcctaatttctttgacctctagagtagattacttgtaatgcaactctgataaccacttggggcagtatcaaaaaaaaaaaaaaaa

SEQ ID NO: 9932 - protein, 337 aa, Zea mays
  misc_feature: Ceres CLONE 483599
  misc_feature (159)..(314): Pfam Name: APS_kinase Pfam Description: Adenylylsulphate kinase
  misc_feature: SWISSPROT Homolog: EC 2.7.1.25 Adenylyl-sulfate kinase
MDARLPARPPRPRARAPVRLPFAASTATRRAGWWCPRDPRVDPSGRGACAFASPGRCPRLAVAHLNRSPASNLGLHPRRPLLPRLPAAGTRTRVTGDESCDGRPLVECTGDRSVEEQPEHAGVEGKALKMSSTVPKSSNIFWHDCPVGKTDRQKLLKQKGCVVWITGLSGSGKSTLACTLGRELHTRGKLAYVLDGDNLRHGLNKDLGFKAEDRAENIRRVGEVAKLFADAGLVCIASLISPYRRDRESCRALLSDSSFIEVFLNMSLELCEARDPKGLYKLARAGKIKGFTGIDDPYEAPLNCEIEIKEVDGVCPPPAEMAGQVVTYLEEKGFLHE

SEQ ID NO: 9933 - DNA, 648 bp, Zea mays
  misc_feature: Ceres CLONE 483921-R
  misc_feature: SWISSPROT Homolog: EC 3.1.3.16 Phosphoprotein phosphatase
ccgggccccccctcgaggtcgacggtatcgataagcttttttttttttttttttgcaccgctgaaacacatgtaatttgataaaagcactaaacgtgtgtaactcactgataagcaagacaggaaatgacgatttagcaattttacaagtaaactaaaatctaatgatctaagactttacggatagttacaagaatcacaactcgtgcacaaaaatggatgtaccatccaagtaaatcgacagttgaatcccttgcatcatttgatttgttgtacaagggagcatatacttaaacctagcaagaaatgtgaattgggagctgacaaacaacagactcatctgataaaaattgctaaacaatgttgttatattctgtcattgaacatcctgaggaagtatttgcatatgccatcggctttcacatcaggatgtgcacagctgagaaagtacaatatctggtttcatttctggagctgtgaagcgaataaatgcacccttgttgcccatctggtcacaattattaggccgcaaagagaactgttataacttttcatcctgttcaattttctggcccttcatcctttacttcttgaaaccggaaaaaaaaatcaaggttttttcctgggaaaaacttcttagcccctttgg

SEQ ID NO: 9934 - DNA, 1109 bp, Zea mays
  misc_feature: Ceres CLONE 484003
  misc_feature: Encodes the peptide sequence at SEQ ID NO. 9935
aacccatttgtatttccttccgcatccttcacactccggctaccaccatctctcaccccccgccgccgccggctccaactcccagcgccccgccgcccccgccgctgtctccatcggagctccctaccgactgccccgaaccatggcagccgcatcagcgacgcgccgcggcctctcctctctcctcctctccccttcctcccgcgcgctccgccgccacctgggccccctcgccgccgcggccgcctcaccgcacgtcgccccgtggccccttctcgcgccgcgcggggccaggaccgcgtcgtccggcgggtccgggcactccccgctgaacgacccgtccccgaactggagcaaccggccgcccaaggagacgatccttctcgacggctgtgactacgagcactggctcatcgtcatggagttccccaccgaccccaagccgtcggaggaggagatggtcgcggcctacgtcaagaccctcgcggccgtcctcggaagtgaggaggaagcaaagaagaagatctactcagtgtgcacttcaacatacacaggatttggtgcattaatttcagaggagttatcatacaaagttaaaggattgccgggagttctatgggtgttacctgattcgtatctggatgttcctaacaaggactacggaggtgatctattcgtagatggtaaggtcatacacagacctcagttccgattcaatgagaggcagcaggtaaggagcaggcctcgtcctcgttacgacagacgacgcgagattgcccaagtggagccgagggagacgatgcaaagaggcccttcgacgacgcagcaacagaggctggggttccgccggcagtcatgcacgtcgtcgccgtcgtgaggtctcacgacgtcggcatggcgggatcggagtggaggccagtaattactccagagtccagtccacgtaacgctccaaattccaattccaaaagctggctgcttgatcttttgttagtgctcgtgtactgctaataaaaactaaatttactgtcatctactactactattaagttattgaaagacgtggcttgctttgggtttaaaaaaaaaaaaaaaaaaaaaaaaaaaaa

SEQ ID NO: 9935 - protein, 244 aa, Zea mays
  misc_feature: Ceres CLONE 484003
MAAASATRRGLSSLLLSPSSRALRRHLGPLAAAAASPHVAPWPLLAPRGARTASSGGSGHSPLNDPSPNWSNRPPKETILLDGCDYEHWLIVMEFPTDPKPSEEEMVAAYVKTLAAVLGSEEEAKKKIYSVCTSTYTGFGALISEELSYKVKGLPGVLWVLPDSYLDVPNKDYGGDLFVDGKVIHRPQFRFNERQQVRSRPRPRYDRRREIAQVEPRETMQRGPSTTQQQRLGFRRQSCTSSPS

SEQ ID NO: 9936 - DNA, 1199 bp, Zea mays
  misc_feature: Ceres CLONE 484011
  misc_feature: Encodes the peptide sequence at SEQ ID NO. 9937
  misc_feature (942)..(942): n is a, c, t, g, unknown, or other
  misc_feature (945)..(945): n is a, c, t, g, unknown, or other
  misc_feature (1002)..(1002): n is a, c, t, g, unknown, or other
  misc_feature (1021)..(1021): n is a, c, t, g, unknown, or other
  misc_feature (1064)..(1064): n is a, c, t, g, unknown, or other
  misc_feature (1073)..(1073): n is a, c, t, g, unknown, or other
  misc_feature (1093)..(1093): n is a, c, t, g, unknown, or other
  misc_feature (1094)..(1094): n is a, c, t, g, unknown, or other
  misc_feature (1129)..(1129): n is a, c, t, g, unknown, or other
  misc_feature (1135)..(1135): n is a, c, t, g, unknown, or other
  misc_feature (1153)..(1153): n is a, c, t, g, unknown, or other
  misc_feature (1154)..(1154): n is a, c, t, g, unknown, or other
  misc_feature (1190)..(1190): n is a, c, t, g, unknown, or other
cgagaagaaaggcagggtggtgggcgaagagaccccagccagtggatcgttaatcaaagaagaaaaaaagcagcagcttatatcaacaacaaggccaccccacccgttggacgacatggcccgcctcggagccggcgccgtgttgacgctcctgctggctgtcgcggcggcggccgcgttcctcgcggtgccggcctcggccaaggtcggggacctgagcgcggtggagttcgtggcggcgcggggcggcagcaagtgctcgggcgccgtgggcgagtgcggcgtggacgaggaggaggagctcgggctgagcggcggcggcatcggcgccggcgacgcgctgcggcggacgcttgcgcagcgcaagccgaccaaccggtacatcagctacgcggcgctgcgcgcggaccaggtgccgtgcaacaagcgcggccggtcctactacaccaactgcgcggcgcagacggccgccaacccctaccgccgcggctgctccgccatcacgcgctgcgcccgcagcatgaactgagcgccaaggcggcggccggcggtctgatctgcctgctggctggctgggcaaagggcacgcagctggcctggctcgatcgcacaccatgcattgacgtcgtcgcggccggccgccgtgccgttggacggtggggtcggacgatgacggaggaggaggcggcggcgcgacgatagtatatacaaacaccaatgaccaaccatactaccagttctattgtcgctgtggcgtagcttctctataaataatatctaactccaacaagatatgtttgattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaanaanaaaaaaaaaaaaaaaaaaaaaaaaaaaaaaaaaaaaaaaaaaaaaaaaaaaaaaaanaaaaaaaaaaaaaaaaaanaaaaaaaaaaaaaaaaaaaaaaaaaaaaaaaaaaaaaaaaaanaaaaaaaanaaaaaaaaaaaaaaaaaaannaaaaaaaaaaaaaaaaaaaaaaaaaaaaaaaaaanaaaaanaaaaaaaaaaaaaaaaannaaaaaaaaaaaaaaaaaaaaaaaaaaaaaaaaaaanaaaaaaaaa

SEQ ID NO: 9937 - protein, 137 aa, Zea mays
  misc_feature: Ceres CLONE 484011
  misc_feature (58)..(134): Pfam Name: RALF Pfam Description: Rapid ALkalinization Factor (RALF)
MARLGAGAVLTLLLAVAAAAAFLAVPASAKVGDLSAVEFVAARGGSKCSGAVGECGVDEEEELGLSGGGIGAGDALRRTLAQRKPTNRYISYAALRADQVPCNKRGRSYYTNCAAQTAANPYRRGCSAITRCARSMN

SEQ ID NO: 9938 - DNA, 683 bp, Zea mays
  misc_feature: Ceres CLONE 484325-R
  misc_feature: Pfam Name: Steroid_dh Pfam Description: 3-oxo-5-alpha-steroid 4-dehydrogenase
  misc_feature: SWISSPROT Homolog: EC 1.3.99.5 3-oxo-5-alpha-steroid 4-dehydrogenase
  misc_feature (1)..(1): n is a, c, t, g, unknown, or other
ncaattgggtaccgggccccccctcgaggtcgacggtatcgatattttttttttttttttttatctaaatgcatagcgaaaccatgtatctaaaagtgccagaatctcttacaatttagattggagggagtacttgataagtctatagtcctggaggactttattttcaatgctagaaagtgttaattaatcctattgtacatcaaatgtctgtctaattgtctattacaatctacatatacaaacataaaattataagtacattcagaatgatcggaactacttaagttaaacattgcagcgcttcaattggtacagtcacatttacatgaatatctgtttgcatgtcggacttgtgcaagcggatgaaaacagcaacagatgcttttggcatttctggacacgtctagcatacaaatggaatgattgcgtaacgagaacgagggtaatcttcaaatttccgaagataccatttatgtgtttgtaccgctgcaaaggacaagtttgttatcacaaaaaggtataggaaccacaccgaaatgtctgatccaccgctagctatcaacatgccaaaatatattactagttcagcaaggtaatgagggcacgacacacgactaaaccagtcgccgcaaggaattacatattcatcagaatctttgtgttcacgcaatgatccaaga

SEQ ID NO: 9939 - DNA, 630 bp, Zea mays
  misc_feature: Ceres CLONE 484848-R
  misc_feature (1)..(1): n is a, c, t, g, unknown, or other
  misc_feature (630)..(630): n is a, c, t, g, unknown, or other
ncgattgggtaccgggccccccctcgaggtcgacggtatcgatattttttttttttttttttagatcaactgcgccagtaggcaatggctacctacttatttcagcttatattatatgaactctcgaaaatactccattatcttagtaccaaggtgaaaaggttaaatagatgtcggccatggattcttccctccaagcgctttttcctatctagatggaccgggaaactagaaaaccactctaccataaggtaaactagaaaaagaagcggaaatagagaaacaactaggttaaagacagtaagacactgactatcctataattgctaacgtttcacttcacgctgaacggaattggcttcagtttgtctggtggtggtagtgccgaatcagctgagcactttcgccttcctaggtcctagaatgacatttgatgccatcatgcttcctccagtgtagatggaccatccattccttccggtgaaccagaaccatcctcctacgatgcatcagcaagtgctttgagcatgtttaagacctcgttagtgtcatccaaatagtatatggccttgcttggtttctgcccgaccgtgcaggcatacatcgaggtttggggatcaaccatgctcn

SEQ ID NO: 9940 - DNA, 2406 bp, Zea mays
  misc_feature: Ceres CLONE 485413
  misc_feature: Encodes the peptide sequence at SEQ ID NO. 9941
atctttggtaaagcccgctagggcgggggttccgttggcctgcatgttttacatgacatttcgcccttctttttttttcattttgtttgcctcaggtgtgcgaagcggcgcaacggcggaggcggcgctagcatcaccggccgacggtcctcctccttctcacgaaaggcactagaggagcggcggcggcggcggcgcatcaagcaccgcaccgatgggcccactggagccgcgctaccgtccaggcggcgcccccgaggacacgactaagagaagggcctccaagagcaagagtttcaaagacgccgagaatttcgaagtcctcgtccttgagaagagctgcggttgcaagttcaagtctttgaggatcttgctcatagccatcatctccgcgacagtccttacccttgtaaccccgaccttatacgagcgccagttgcagtcagcctcccggtacgtggatgtcgggtggatgtgggacagagcgagttccgatccgcggtacgcatcttctgccgatgttaggtgggaggatgtgtacaaagcactgggaaacctaagaagcggtaaccgccagagtcatctcagagttgggctcttgaatttcaacagcaccgagtacggctcctggacacagttgctcccagctgacagccacgttatctccaccgtaaggctcgagcacgccaaggacagcgtcacctggcagacgctgtaccctgagtggatcgacgaggaggaagagacggagataccctcttgcccgtcgctgccggagcctaacgtgccaagaggtgcgcgctttgacgtcgtcgccgtgaagcttccctgcacccgtgtggcgggctggtcgagagacgtcgcgcggctccatctgcagctctcggcagccaaactggctgtggcgtcctcgaagcgcaaccacgacgacgtccatgttctcttcgtcactgactgcttcccgatcccgaacctcttcccttgcaagaaccttgtgacacgtgaaggcagcgcctggttgtacagtcctgactccaaagcgttgagggaaaagctcaggcttccagtcgggtcctgtgagcttgccgttccactcaaagccaaatcgaggcttttctcggtagatcgacgaagagaagcgtacgcgacgatactgcattcagcgagcgaatacgtctgcggcgcaatctcggcagcgcaaagcatccgccaggcaggatccaccagggacctggtcatccttgtggacgagaccataagcgaccaccaccggagaggcttggaggcggcggggtggaaggtcagagtgatccagaggatcaggaaccccaaggcggagcgcgacgcgtacaacgagtggaactacagcaagttcaggctgtggcagctgaccgactacgacaaggtcatcttcatagacgccgacctcctcatcctgaggaacgtcgacttcctgttcgccatgccggagatcgccgcgacgggcaacaacgccacgctcttcaactccggcgtcatggtcgtcgagccctccaactgcacgttccgcctgctcatggaccacatcgacgagattacctcgtacaacggcggggaccaggggtacctcaacgagatattcacgtggtggcaccgcgtccccaggcacatgaacttcctcaagcacttctgggagggcgacagcgaggccatgaaggcgaagaagacacagctgttcggcgcggacccgccggtcctctacgtcctccactaccttggcctcaagccgtggctgtgcttcagagactacgactgcaactggaacaacgccgggatgcgcgagttcgccagcgacgtcgcgcatgcccggtggtggaaggtgcacgacaggatgccccggaagctccagtcctactgcctgctgaggtcgcggcagaaggccaggctggagtgggaccggaggcaggccgagaaggccaactctcaagatggccactggcgcctcaacgtcacggacaccaggctcaagacgtgctttgagaagttctgcttctgggagagcatgctctggcattggggcgagaacagtaacaggaccaagagcgtccccatggcagccacgacggcaaggtcgtgatctgtagatatacgaacaccccatccccatatggcaaccatacatgcatagcaatagcttgtataggtagctatgctttagttcttcgctatatatacagaatacaccactcgatccctgttgttgtcaaggctgcagctytatgtcgctgccggcctgccmccatggctaacgattcttttgggttggctgctgtaataagtttcaggtacatgtaaatttccctgctgaaattacgtgaccgcgtgtgagaaatgaatttgtacagggcgtcaaaaaaaaaaaaaaaa

SEQ ID NO: 9941 - protein, 633 aa, Zea mays
  misc_feature: Ceres CLONE 485413
  misc_feature (311)..(523): Pfam Name: Glyco_transf_8 Pfam Description: Glycosyl transferase family 8
  misc_feature: SWISSPROT Homolog: EC 2.4.1.186 Glycogenin glucosyltransferase
MGPLEPRYRPGGAPEDTTKRRASKSKSFKDAENFEVLVLEKSCGCKFKSLRILLIAIISATVLTLVTPTLYERQLQSASRYVDVGWMWDRASSDPRYASSADVRWEDVYKALGNLRSGNRQSHLRVGLLNFNSTEYGSWTQLLPADSHVISTVRLEHAKDSVTWQTLYPEWIDEEEETEIPSCPSLPEPNVPRGARFDVVAVKLPCTRVAGWSRDVARLHLQLSAAKLAVASSKRNHDDVHVLFVTDCFPIPNLFPCKNLVTREGSAWLYSPDSKALREKLRLPVGSCELAVPLKAKSRLFSVDRRREAYATILHSASEYVCGAISAAQSIRQAGSTRDLVILVDETISDHHRRGLEAAGWKVRVIQRIRNPKAERDAYNEWNYSKFRLWQLTDYDKVIFIDADLLILRNVDFLFAMPEIAATGNNATLFNSGVMVVEPSNCTFRLLMDHIDEITSYNGGDQGYLNEIFTWWHRVPRHMNFLKHFWEGDSEAMKAKKTQLFGADPPVLYVLHYLGLKPWLCFRDYDCNWNNAGMREFASDVAHARWWKVHDRMPRKLQSYCLLRSRQKARLEWDRRQAEKANSQDGHWRLNVTDTRLKTCFEKFCFWESMLWHWGENSNRTKSVPMAATTARS

SEQ ID NO: 9942 - DNA, 933 bp, Zea mays
  misc_feature: Ceres CLONE 485580-R2
ttggggtccgggccccccctcgaggtcgacggtatcgataagcttttttttttttttttttagaaacagtggcagattatcattggctctgaaacggcgtagaagacacttttgagtgctatggacagacggtgcccaaagtcgacacgcttccccagaagcagagagctacacagaactaccgaagtacttgtacagaaggactacctgcacctgacgcgaaaaaaagcatgagatccctaagctgtcaataaaacagagttcatgtacaccaacggacgtgtcagcttcgcaaagagcacttcttttgagaaatgcccaaagaaagatggcatcggccacactggacgatccgctttcggcgcttcatggtcctcgatctttagaaatcttcatccttggggcgagccaggaaagccttccggaattttttgggggcggggcccaagcacccaattccccccttgtctgaacggcaccctttggaaccccggggagaacaaaatcgttttccaagggggctcccccgtccccggggaaccgggaaatatattgggctggggggaagaaaaggtttttccccggggtcctcttcttcccccactgggagaggaaggttccctcccgccatttatagagggggggggggggttctttcccccccccctttgagaaaaaaaaaccgcgggggggcggggggaaattttgggcgccattgggggaatgccgcccgaaaaattttttggccacttggggcgggggcccccggagcaggataaccctcgggccttggggggggggcccaccacaagggtgggggggtttcccctctcccaacaataaaaaacatattgttcgaaaatctctcccccctggtgtgttttgtcccccaaaagggaacattgattaaatacatggtggggaggagacttg

SEQ ID NO: 9943 - DNA, 1004 bp, Zea mays
  misc_feature: Ceres CLONE 485580-R
gagaggggggtaaaagaattagatgagtgctatggacagacggtgcccaaagtcgacacgcttccccagaagcagagagctacacagaactaccgaagtacttgtacagaaggactacctgcacctgacgcgaaaaaaagcatgggatccctaagctgtcaataaaacagagttggtgtacaccaactgacgtgtcaccttcccaaagaggactttttttgagaatgcctaagaaaagggatgggaaaaaaaagaacaatccggttattgccctttctgtctctcgcatctttcgaacattatcaaaatgaaatagccaaaaaggaatcatgaaaatgtggcgggcaaaacaccacacttagtagtgtgtggatcggatcttgggaagtttttcacccccccgcgtaccggaggggggtgctggcgcgcggggtataagataaaacatgaccgtggcgacgtgagggtgggtgggggcatcaacttcaggcccaggtaggttcctgagattgttcactatgcatattactcactgacaccacccaccagcagcatgagggagtaagtaagtgtgatggtaggttgtatttagtgacctcttagtgagagattatgggcagttatgtatggtcggcgtccccacacggcacgccgtgaatgccggcaacaaccaatatacaatttcgaggcgcgcacgccaggtatggtgggcagggatctcccacccgccccaatcgtaggcgaaatcttggacaggaacgcggggagaggagtgtaggctaggatggtcaagaagaccacagatgactaagaaagtactggcccgcggggcgtggaaggtaggggagtggggcagaggggattgctgtatttatgacggagatcgagctatggtaggcagcccatgataggagcgagcgcaagacacaaaaagaagagtggtgtgtgctactgtaacgcgtagcaagctggagcaggcgacgctggcgagaggtgcgagcaac

SEQ ID NO: 9944 - DNA, 648 bp, Zea mays
  misc_feature: Ceres CLONE 485628-R
  misc_feature (103)..(103): n is a, c, t, g, unknown, or other
  misc_feature (185)..(185): n is a, c, t, g, unknown, or other
  misc_feature (249)..(249): n is a, c, t, g, unknown, or other
  misc_feature (311)..(311): n is a, c, t, g, unknown, or other
  misc_feature (341)..(341): n is a, c, t, g, unknown, or other
  misc_feature (362)..(362): n is a, c, t, g, unknown, or other
  misc_feature (443)..(443): n is a, c, t, g, unknown, or other
  misc_feature (551)..(551): n is a, c, t, g, unknown, or other
  misc_feature (594)..(594): n is a, c, t, g, unknown, or other
  misc_feature (620)..(620): n is a, c, t, g, unknown, or other
caattgggtaccgggccccccctcgaggtcgacggtatcgataagcttttttttttttttttttcttttttttttttttttttttttttttgaacgccaaagntctaaaccatataatgcttgcactagttttgccaacaatataatgcaatagctagttaattgaagatgctaagactaacaantgaggaaacaggtagctgccatacactttgggtggtaacatgatcttccacaaaaattcttcancatcccctaaataaactcttcgttcaaaaaaaattggaaagcctgcggtcaattgacagcanctgtgtcccaaaatgctgattatcctccancaggcggccatattcagtcancaagccttcggattgtttttggatagcaagtgccttgtcctctgaaacatggacctcttctgtcttttcttggacttgtancttcagtttcttcatctccttgttcaaagtggcaatctcttcctggtatttctttgcctcctccaagtttccatgttttgcctcctccaacattttattatgcttacntacagcctctaagtcctttttaaaccggcgcaaatctctaatntattggtggagccggtcaatcactanagcaagaataaggagtaccccgtgaggg

SEQ ID NO: 9945 - DNA, 792 bp, Zea mays
  misc_feature: Ceres CLONE 486162-R
  misc_feature (20)..(20): n is a, c, t, g, unknown, or other
  misc_feature (38)..(38): n is a, c, t, g, unknown, or other
  misc_feature (52)..(52): n is a, c, t, g, unknown, or other
ggtgtgtcgggggggtggcnctctagacccccagaagngaaaaatgggtttntccacatgggtgcgggccccccctcgagggcgacggtatcgataagcttttttttttttttttttgtagagaaaagatcctgctacctgccagctacttgccgcgcgcagaagaagctattatcgtgaagcaacaatgaggttcatctttggagcggagcatgagtcgttttgtctcacccggcagtctagctgatattcagtttctttcatgaaaacgcagctagcacacgagtgtcaagtaatcaagcagaagcaccctgcgcgtgccaatcccatatcactctaaattacagctgacttaaaaatctcgcaccgctactgttgccaaggaaaaggatccgggagggtagagaagaccttaccttgcctccacaacaaacaacctccactatagaaaagctctatctgaaacccaaaccccccaccccaaccaaggttcagttcgaatgcgatcgccatggatctcgactctggtgcaccacgtgaagcacacaaacataggagtgccatccagtaccaccgtacatcccgatgccccggcggggggaaacgaagagagaccgtccggcggaccgaaccgcgtgaaagggcgcccgtgtccccgccccaaggattcccgggacaccccattttggtgcggcaacaaaggaaggacaccagggccccggattggaaaaactcctaccccctcgcatgctggatccccggagtaacctcgccacccaaaacagcacccca

SEQ ID NO: 9946 - DNA, 900 bp, Zea mays
  misc_feature: Ceres CLONE 486291
  misc_feature: Encodes the peptide sequence at SEQ ID NO. 9947
aattttcccgagagcagggtagggtagccacatccacgcaagctataaacaatgctatgcaaagtttatttgagtgctttaacagtgtagccattgtctattagcatcacatattcacatgccattgtctattagctctcacatagccagctagccctccttgccttgcccaggcacagcaaagcggccgggagaggagatcgagcagtcatcgatctgatggggggcgaccagcagctcgttccggcggcggcccgcgtcaccccgcgtcggccgatgatgtccttccgggtgccgcggagactggtggccagcagagcggcgggtggagcgtcgccgtcgccgccggtgccggtgccggcggggctaaagaaaaagaagaagaaggtggcggtggcgaggctcggtgggaagaggaggctcttcggcacgatccggcggctccggatgcggtggctggccgtgctgtacaggcgcacgctgcggcggctgcgcgcctactacgccacggcgatcaacgacctcctcgagggcgccgccgccatcggctccctccgcgggccggccggtgccgccgactgcgccttcggcaccgcgttcgcgccggtcgtcgccgtcggcctctgatgagagctcgcactcgcacgcccgccgtctgcatgcactccatacggcgagcccgtatggtggtctgcttgtatagaggacaatctcgatcgctatcgttttctcgtccatctgcatcgtctctaccgtatggcatcttttttctggatcgatctctcaatcaagaattagaaaagagtacacaaagaaagaaagaaatacaactcctcgattcagatttgcttggtactaataagtataataatgcattttcccaaaaaaaaaaaaaaaaaa

SEQ ID NO: 9947 - protein, 135 aa, Zea mays
  misc_feature: Ceres CLONE 486291
MGGDQQLVPAAARVTPRRPMMSFRVPRRLVASRAAGGASPSPPVPVPAGLKKKKKKVAVARLGGKRRLFGTIRRLRMRWLAVLYRRTLRRLRAYYATAINDLLEGAAAIGSLRGPAGAADCAFGTAFAPVVAVGL

SEQ ID NO: 9948 - DNA, 681 bp, Zea mays
  misc_feature: Ceres CLONE 486450-R
  misc_feature (1)..(1): n is a, c, t, g, unknown, or other
ncgattgggtaccgggccccccctcgaggtcgacggtatcgataagcttttttttttttttttttgggatgaagataaatcaattgcttgagcctagagatagtctaaggtataagctagacacagcatcgtccactttaagataagacgggtctcatcatcccgtagttcaaagtaggtataaaaatagcccatcttttacgactttcattgccgacttttttttgggcggggggtagggtgtccgaggcctggatagatctttcaacaaacaactaggatgcagcgaaatttggagacaatcggatatgacttcaagttcgcaataatcaattggcttgcgataagcaaacttccctcagatactctatcgcaagctgtggcagccaacttccgccaggttgtcattgccgtaatgattgataggagagtgacctgtgaggatccacccgccatcatacacaatgacagaacccagctcctcctagatgcggagcaaaaccggaaacgagcgccccacgaatgccaacaaaatagaacgcgcccaagataacataggcgcctaaatgcgtgccaaccacagcctctagaaaacctgaaaggactccttggatgttgtcaggaataaatgagatccaaagcaactgaaccaatctggtgacataatttacgacctcctcc

SEQ ID NO: 9949 - DNA, 703 bp, Zea mays
  misc_feature: Ceres CLONE 486720
  misc_feature: Encodes the peptide sequence at SEQ ID NO. 9950
actcacggtgccgcggaacagcgaagcaaacgaccagacgtaggaggagatggcggacggagagccagggcataagctgtcgccggcggactcccgggcggtgacgctggcattcttccgcgccctaggcgccgacgcgcgcctcccggcctcggccgaccagcccgacgcctactccgctctcgtccgcgcaatcctctcctctgttgccgtctccgcctccccgaccccgcggatctcttgcaccatcaccgtctcgcacgccgtgactaacacgtacaacacgctccacggcggcgcggtggcggccgtagccgaggccgtcgggatggcgtgcgcgcgggcagccgccggggatcgagagatgttcctcggcgagcttagcatcgcgtacctcgctgcagcgcgatgcgattctgaagtggacgttgaagcgcagatactgaggaagggcagatcagtcgtggttaccacaatcgatttcagacttaaggacaccaaaaagctctgctacacatctcgagccaccttttacatcatgcccgtggcaagcctataagcccaagtttttatatggacaattccttctgtttacaggaccagtttgtgttgtgtatatttaacttagaataccatatatcagcaatctgttgtattgataatgaagcagaagtcatattgattgaaaaaaaaaaaaaaaaaa

SEQ ID NO: 9950 - protein, 169 aa, Zea mays
  misc_feature: Ceres CLONE 486720
  misc_feature (77)..(154): Pfam Name: 4HBT Pfam Description: Thioesterase superfamily
MADGEPGHKLSPADSRAVTLAFFRALGADARLPASADQPDAYSALVRAILSSVAVSASPTPRISCTITVSHAVTNTYNTLHGGAVAAVAEAVGMACARAAAGDREMFLGELSIAYLAAARCDSEVDVEAQILRKGRSVVVTTIDFRLKDTKKLCYTSRATFYIMPVASL

SEQ ID NO: 9951 - DNA, 632 bp, Zea mays
  misc_feature: Ceres CLONE 486977-R
cgattgggtaccgggccccccctcgaggtcgacggtactgataagcttttttttttttttttttgaaacgatcagacaactgcattggattgcgcgagcgcggcgaggagacacgggatacaccgccggagccacaccactccggccaccacccaccaatactaacgtagagactacacagacaccaacaaaccggcgaccaccaccgcctaagttgcctccattcatattcctgcccccctaccctccccggattagacaggaacacacgaactgagacgagacccgcatcagacagacgagaggtggaacgggggcggaatgggaggttggggcagctcgggcgcggcccctgggcgagggacggggcaacagcggcacgccggcgggcgccggaagcacgggggttgaggagcgagcgtagggtgacggagcagggtggagggccggggcggggggcgcccagatgctcgggaagaacatggggccggccggcggcgagggcgggccgggcgggcggcgggcgggggtggcaggggcggggggggtgggtggcgcgcccgcgagcccctaggggcctccgaatggaaggatggagatccccctgcctcgcctgtggttctcggcggcgc

SEQ ID NO: 9952 - DNA, 657 bp, Zea mays
  misc_feature: Ceres CLONE 486989-R
cgattgggtaccgggccccccctcgaggtcgacggtatcgataagcttttttttttttttttttagttacgccatccatttatcttattattacttcctccgttcaaaattacaaagccacatagagcacatccgaggtacatacatactacagagagtttgcagatacatagatattccataatgcaacataacacgtaagattcttaggagcttcagatctacagtcttcctcctctcctttcttgttcacatgtagcctccatatacaaagatatcctctgtagttctactctgcccttagtctccacttctcttgatacaattaactcccgtgctgggggactatccagcatacttattagtactaggtgaggccggaaatttcttctcgtgcagagaacaggctcaattatcggtaacccaagcttagttgtcgtcatcagctcctctttgactcttagcagagtaaaccagagagatctcctctgccatcgggcacagcagcaccggatctggtcgcgccgagctccagatctgccagtctgtccacgccggcaagctaaaacaaccgaggcgacagctaaaatgggcggagagtggaaagagaaaaggccaagaaattagggatttagagaaacaccctagttgggcccg

SEQ ID NO: 9953 - DNA, 680 bp, Zea mays
  misc_feature: Ceres CLONE 487349-R
  misc_feature: SWISSPROT Homolog: EC 1.14.11.13 Gibberellin 2-beta-dioxygenase
  misc_feature (459)..(459): n is a, c, t, g, unknown, or other
  misc_feature (462)..(462): n is a, c, t, g, unknown, or other
  misc_feature (464)..(464): n is a, c, t, g, unknown, or other
  misc_feature (680)..(680): n is a, c, t, g, unknown, or other
cgattgggtaccgggccccccctcgaggtcgacggtatcgataagcttttttttttttttttttgcaccaaaacaggccatattagcaacttgcggaaaccctgctccctgcacccagctacccaccaccaccacaaaaaaaaatctagctactagagtggtcgctccccagctgtacacatcatcatcgtctctaccttgttcttcttcttcttcttcttcttcgccatcatttctcgcaagcagactcgctcgtcctcgttcgtcatggttgttgctgttgtcgtcctgtaaagcagctggtgtgtgctcagcttgaccggccgcgggccgccctgctagctagcttagatgctacacctctgaaactgggccagcctgttgtcgccgagcctcgtcttgtacgcggccgtcttgtactcgccccacgtgaactccctgtacagggctctctcgccntcngncagcagctgcgccaggcgcgcgattccgctgctccagcgccggttcccccgaataaataaaggaaaccctccaacttgaggcttttggcacaaccgcgggggtcacgcttctcgaaacccccgttggtcaacccctggaacaaattccccccaatttaaaaaaaaaaggtccccgttccaaaggaaagaaaaaccccattgggcccctggcggggn

SEQ ID NO: 9954 - DNA, 670 bp, Zea mays
  misc_feature: Ceres CLONE 487378-R
  misc_feature (118)..(118): n is a, c, t, g, unknown, or other
cctattgtgtactgggccccccctcgaagtcgacggtatcgataagcttttttttttttttttttcgtgtgcaaaacagaagatccattgccataatgcagaacaagaacatacgtgngagataaagaatactcaggttttccatctaaataccatccagtgatgtactacatacagtgatacaaagaatgtgacgcccgccgcagggaggcagccaacgcggaacgcgcgcgcgccccaccgcgtcacgagctcagacgttgtcaggcaggtcgaagtgctggacgccgagcacctgcagcgcggcgttctggacgaagagcacgaggccgcacttggtggcgcgaaagccgtcccagagcgggaagtggacggtgcccgacacggtcttcttcggcgaggcgccctcccgcacggcggccaccttctcgaggcggcgcaccacgtggtcgttgagcagcgacttgcccttgttctcgccgcgcccgcagtcggtcaccagcccgctctcgtacagcgccaccagcacgctcgcgccgcctgggccctccacgcggctgcgcagggtgcccgtgaacgacgcctgcagtgttgcggggctcggccgctggaactgaccttgatgggggcgcggggggttaaacccgggggccttccccgaacggccagc

SEQ ID NO: 9955 - DNA, 795 bp, Zea mays
  misc_feature: Ceres CLONE 487391
  misc_feature: Encodes the peptide sequence at SEQ ID NO. 9956
gtcaattcccctactccaaggcaaccgtgattccgtgaactgtccctctacctctctaagtttgccaagaactgccacacagcctcacacctctgacgatctgagcttactgaagccatgaggccggcaccaagtgtttccaggcccaggcccacgtcaacgtcgacgacttcgccggcagcgccaccaccggcagccgcgaagctggcgtcctcgccgtggcactcaacggtgccctacctgttcggagggctagccgcaatgctgggcctcatcacgctggcgctcctcatccttgcctgctcgtaccggaagctcaacgactacctcagcaccggcgacgcttccccttccccctccagacccgaagccacggatggcaacggcttcaagtcgccggcggccactgccccggcctctccagcgaccttcgccgacctcgttgccgtcgtcatggccggggaaaaaatccccacattcttggccgcgccgatcgtccgacgaacgcacggtaacgacagcgctgccacagccaccggagaagggtctccggagacggaggaggagctggagagccgcggcaaggcaggggagcgggagtgccgtgtgatcgccgacgccgaacgggaacgccatctgagtcacgtgtgaagtgaaccactattggacgaaagagaaagcttcagggcggtttctgctcgaactcttcatccaaattttgtttgcttattaataatttgtagctcgtgtcaggataaaaaatttgcgattcgtgacctaaaaaaaaaaaaaaaa

SEQ ID NO: 9956 - protein, 177 aa, Zea mays
  misc_feature: Ceres CLONE 487391
MRPAPSVSRPRPTSTSTTSPAAPPPAAAKLASSPWHSTVPYLFGGLAAMLGLITLALLILACSYRKLNDYLSTGDASPSPSRPEATDGNGFKSPAATAPASPATFADLVAVVMAGEKIPTFLAAPIVRRTHGNDSAATATGEGSPETEEELESRGKAGERECRVIADAERERHLSHV

SEQ ID NO: 9957 - DNA, 1074 bp, Zea mays
  misc_feature: Ceres CLONE 487473
  misc_feature: Encodes the peptide sequence at SEQ ID NO. 9958
attttccccatgtccactatccctccttatcaccaaccatccagtcataactcacggcaggcagagacgcgcaccaccagaccagcagcagaacgaaagagatctccggtccccgggccccggctcctcccctcccgattccaatctggtctcgccggacgccgggcctggcggcgagggagagatggggaagaaccaggcgtacaaggcgatgcagcgggcgcggctggggtcctcgtccggcgcgccgggcgccgccgacgcccccgaagacggcatgacggacggttcattccattctccagagtggcatgcggcgcgcctggccagccttaacaagacgcacaccctcacctgggaggagttcaagaagaagcagaaggaagaggaactgaaaaggggcgagctggaggctgacaaagacaaaatgatgagagagtatagagctcaactggatgctgaaagagctcaaaagctagcaaacggaagaaatcactcaaggtcaaactcaaaatcatcatcttccaagaaagagaggaaggataaggacgcaaagaaaagaagtaaaaagaggagaaagcacaaaagttcatcagagtcaagttccagctcatcttcagaatcttcaagcagcgacgatgaggataggggttcaaggaagtccagatcacggtcgagatcaaagagaacaaggaaggaaaagaagagccggtcaaggtccaagcgcagaggcagtgaaagcgaggaggaaggcctggtacgcctctctaaattcttcgggaagtaaggagtagacgctgctgtacccaagacgcctttttcattttgaaacgtagattggtgggtttggatgtatcattcaacacaaattacttctaaaggttgagcgagccgtttaccatggtgttctcaatatgatgctcagctgttaagagggtctggtcaagttgtgtagcttccaaaaactttgtaagcaactggtaagtcattgttaaatcgctgtaccttggaggatttgatgccatatatttgagacattgaactgctatatttatgttaaaaaaaaaaaaaaaa

SEQ ID NO: 9958 - protein, 200 aa, Zea mays
  misc_feature: Ceres CLONE 487473
MGKNQAYKAMQRARLGSSSGAPGAADAPEDGMTDGSFHSPEWHAARLASLNKTHTLTWEEFKKKQKEEELKRGELEADKDKMMREYRAQLDAERAQKLANGRNHSRSNSKSSSSKKERKDKDAKKRSKKRRKHKSSSESSSSSSSESSSSDDEDRGSRKSRSRSRSKRTRKEKKSRSRSKRRGSESEEEGLVRLSKFFGK

SEQ ID NO: 9959 - DNA, 633 bp, Zea mays
  misc_feature: Ceres CLONE 487677-R
  misc_feature (494)..(494): n is a, c, t, g, unknown, or other
  misc_feature (495)..(495): n is a, c, t, g, unknown, or other
  misc_feature (500)..(500): n is a, c, t, g, unknown, or other
cgattgggtaccgggccccccctcgaggtcgacggtatcgatattttttttttttttttttagatattaatattggttctgtttctatgaacacatgtctactaatcatggctttggagagccttcagtactcaaaaatgaaaatgccagcagttatgttgcctattacaaaaaaatgctataccgtacccatagacacccaccagaatgcaacgatccgttacaaggtagaccataagatatgtaatattgtcttctaacaaagttctcttcccaaaaattctgaagcagcaatcctcagttactctagctcttgcctatgttgtgaagaaacatactttctacccactgcatgtgcaggatcaatccatttcaagcttaccaaaacccctgcaaaggcaggaacggggtcaatgtgacgggccccattcatcctctgcccctgcccctgcctcgtcctccacctcttcctcgaccgcctccaccctctgcanncacgnctctaccctctgcacgatttccgcccaacatatagaactcggcttttccctgcttttcagccagcggctgcacagctctctttttgacacccttgggttcatcgtcgctagacgactctttcctgtgccttct

SEQ ID NO: 9960 - DNA, 635 bp, Zea mays
  misc_feature: Ceres CLONE 487808-R
cgattgggtaccgggccccccctcgaggtcgacggtctcgatatgttttttttttttttttgctcttttgggagatcttgcttcaaaaaacgagaatgaacttgtcccatgggtctagaacaattgtggtcacgctaccgagtgtcagactgccagtacagaagaaccgaaccgagccgagccatggaataaagatcagaacaccacaggactgcgatctatctactgccgcctcacgccggcgcgatggacaccctgtcgacctgcacgatgtactcgagcgtcgcgccgggcgggacctggacgtgctcctccccgaagtcggcgccgtcgtcgccgaacccgaggcccggcgggacgaccacccgccgcttgccgccggccctcatggagcgcagcgcgtaatcgacgccctcgcacatgcccctggtgtacggccgggagcccatcaccagcgccagcggccgcttgccgtcgacgaacgtgtccacgaacgcctccccgccgccgccactgccgggcacccggccctgcaggtcgatcaccaccaggtcgcccggccgcgggacgtctccgccgccgacgcgcatctcgtagtaccggaccccgttgggcaagacgacctcctgctcctg

SEQ ID NO: 9961 - DNA, 683 bp, Zea mays
  misc_feature: Ceres CLONE 487837-R
  misc_feature (93)..(93): n is a, c, t, g, unknown, or other
ccgggccccccctcgaggtcgacggtatcgataagcttttttttttttttttttgaaaaagtagtgaatagattaaaattgcacctaaaatgngtggtatggatgagaatctcttgaagaactcattcaaatctaaaccaactcacacgaaacccagtcacaagcaatctactttgcaccatttaattagcattattaccacaagggggcaaatgcaagattttaaaagcgcgccttctttttttcacataaaattcgaatgcgaatcctgaacaaccaaggaagtagaagaaaaaaaattacaaacaaacagttactacgctcagcacggctattggcagagcagcaccaagattagtaataagtattgtccgccgctaaacaccgttacaaaaattggctcggctcccggcactccacgtcaccaccaccatctacaacatctacagctcgtcgtggtcgtcgtcaacaccgccgtcagcgtcaccgccagggcgccgcccgaccgctggtacacgccgacaccatggggtggcaacacggcctccactccttgagcttcccccccgaaaccccctttctcggcgaaaatggttttttttaaaccattccagggcctcccttgaggggcttcttcaacacttttcctttttcttccccccccaggtttggccccaaggttt

SEQ ID NO: 9962 - DNA, 1387 bp, Zea mays
  misc_feature: Ceres CLONE 488202
  misc_feature: Encodes the peptide sequence at SEQ ID NO. 9963
acctcgtctgccaccaacccacctcctagttcctgtttcaggacgcttattattctccgccgttggcgtcgtgaagcccgaagacaccgatctcacggacaaacttacaacatatggctatggcgacggcgaagctgaactccccggctaccagcttggtcgctggcggcctcacgcgccgatctgcgcccgcccgctgcacgacggtgatccgcgccgccgcaggctcctactcggacgagctcatctccaccgcgaaatctgttgcttcccctgggcgtggtattctggcaattgatgagtcaaatgcaacatgtggaaagaggttatcatctattggtttggacaacacagaagtgaaccgccaggcttacaggcagcttttgctgacaactgctggtcttggtgaatatatttctggcgctattcttttcgaggagaccctttatcaatcaactacagacggcaagaagtttgttgactgcttgaaggatcagaatatcatgcctggcatcaaggttgacaagggtttggttccattgcctggatccaacaatgaatcatggtgccaaggtcttgatggtttggcttcaaggtgtgctgagtactataagcagggggcgcgcttcgcaaagtggagaactgttgttagcatcccttgtggtccatctgcattagcagtcaaggaagcagcatggggacttgctcgatatgctgctattgctcaggataatggtttagtgccaattgtggagccagagattcttcttgatggagaccatgggatcgagggagctcttgaggtggcagagaaagtgtggtctgaggtgtttttctacttagccgagaacaatgttctgtttgagggtatcctgctgaagcctagcatggtcacccctggagctgagcacaaggagaaggcttctccagaagccattgcaaagtacacgctaacaatgctcagaaggagagtacctcccgctgttcctggaatcatgttcctttctggtggacagtccgaggtggaggcaactctgaacctgaatgcaatgaaccagtctctgaacccatggcatgtgtcgttctcctatgtccgggctctgcagaactcggtgctgaagacatggcaagggcgccctgagaacgtggaggcagcgcagaaggccctgctggtgcgcgcaaaggccaactcgctggcccagctcggtcgctacactggtgagggcgagagcgatgatgccaagaaaggcatgttccagaagggctacacctactaatgtgccagcgagatgtttccatgacataataataattgtagcgttttggtgttattattattattattttggtacgctctggtgaataataaccaaaaaaaaaaaaaaaa

SEQ ID NO: 9963 - protein, 387 aa, Zea mays
  misc_feature: Ceres CLONE 488202
  misc_feature (43)..(387): Pfam Name: Glycolytic Pfam Description: Fructose-bisphosphate aldolase class-I
  misc_feature: SWISSPROT Homolog: EC 4.1.2.13 Fructose-bisphosphate aldolase
MAMATAKLNSPATSLVAGGLTRRSAPARCTTVIRAAAGSYSDELISTAKSVASPGRGILAIDESNATCGKRLSSIGLDNTEVNRQAYRQLLLTTAGLGEYISGAILFEETLYQSTTDGKKFVDCLKDQNIMPGIKVDKGLVPLPGSNNESWCQGLDGLASRCAEYYKQGARFAKWRTVVSIPCGPSALAVKEAAWGLARYAAIAQDNGLVPIVEPEILLDGDHGIEGALEVAEKVWSEVFFYLAENNVLFEGILLKPSMVTPGAEHKEKASPEAIAKYTLTMLRRRVPPAVPGIMFLSGGQSEVEATLNLNAMNQSLNPWHVSFSYVRALQNSVLKTWQGRPENVEAAQKALLVRAKANSLAQLGRYTGEGESDDAKKGMFQKGYTY

SEQ ID NO: 9964 - DNA, 635 bp, Zea mays
  misc_feature: Ceres CLONE 488242-R
  misc_feature: Pfam Name: LBP_BPI_CETP Pfam Description: LBP / BPI / CETP family, N-terminal domain
cgattgggtaccgggccccccctcgaggtcgacggtatcgataagcttttttttttttttttttatccgagggcaaacaatttatagcattgcaaacttcttgctcagttatggggttgtccagctctggaaggtttggatttggagcgccagcaatttccagagctcaatatataattgtataatacaaatatggaacattctagaagcaaaatggtatcctacatgatgttgctctttcctaccttaaaatgaacttctagtgctgaattgaatacatcttcgtcaagtgagagcaaaagcatttttgatgcaccaccacaagccaaagaaagttgtggatgcttctgcagattggttgtctcagcaactgctgaagtaatcaacccattgatatcgaactcaattgaagaattgccatagtgtggatcattaatgaaagtcaagttgaaggccgcgacgtcgtccaaactgatggtcctggggagaccttgcagaaaggagtccagtttccaagcgccttcaatgatattttcaggtactgccttctcaactgcagctttaatatgatcttcaaaagcatttataaacccttgataaaaccaagatgctccaccatccagggatatcactag

SEQ ID NO: 9965 - DNA, 620 bp, Zea mays
  misc_feature: Ceres CLONE 488496-R
  misc_feature (444)..(444): n is a, c, t, g, unknown, or other
  misc_feature (459)..(459): n is a, c, t, g, unknown, or other
tgaattattttattaagtggagcggtttttcacgtggctaatatatttaatccatataaactcgtggttatgttacgcatacacatagcctttttgtatgaacctgcccatgcatgctgctacagaacaagtctagtaaacacagaaaacgctctcatctcgtgtggctttaatctaaaacggattctactatttttacagtgatatgtctctatagattatagctgcagcagtccatataagtgtctttaatctgaagtccatcgcctacaatattaaaataagactgctcgtcctgacgtgttcagtgtgctcatcacatccagtgtcaagctgataagcggagtcatctctgtgtctccgcgtgcccagaatcacttgctttgcatcgagtcactcgcagcaagatgtggagcagcaggacatcgcttccctctgatgtangagcgtctcactcanagtagtagacacttcttgctgttgcaatatgcaggttgttgcggtttcaagctgcagcagtgatgcaacatttgttcctcagttctttcaaaattcatcgtggtgtaagggaagggcagctttatattgacccgccacaggttggtgttgaatcatggcgg

SEQ ID NO: 9966 - DNA, 2255 bp, Zea mays
  misc_feature: Ceres CLONE 488682
  misc_feature: Encodes the peptide sequence at SEQ ID NO. 9967
actttccccgcctccatcaccaattcacgatctcctttcccgcaccgcgccccggatcgccggctcgcaattccggagttaaattcccctccaccgcaaccgtcatgggcggctcccacagccgcgaggacgtcgatctcacctcctccgacgaagaggaggaattcgaggacgactatgacgcccgatcacccatcgcggaggccgcagcgagcgcggggcagcgcgacgacgacctcctccgcaccgccacaccttcctcgcttgaggccatcgacgccaagctcaggtcgctggatctcaagtaccagagacctaccgccgccaagctctacctccacgtcggcggggcctcgccttccgcgcgctgggtgcccgccgagcgccgcgcgacctacgcattcgtcgaccagtcgagcgacgacgcctcctcccccaggtggttcctagaggttgggccggggccgcgggtctccgcgcccgtggactcggcgctccagctgaagacgatccccgcgcagcgccgggcggacttcgccgcgagcgggtccgtatgggctctgcgactacccaccgacgccgaattgcgccggttcagggtggagtacgagcgctgtcttttcgagaacacgtacggagtggaggccacggacgaagggcggaaggaggtgttcggcgccgacttcgccgcgtgggcgcggcctgccgaggccgacgacactgtttgggccgacgcggaggaaagcctcacccctcccgccgcagcaccagggaaggacctgcttaaggagttcgaggaggaggccggcgacggcgacagcatccagagcctcgcgcttggggcgcttgacaacagcttcttagtcggcggcgccgggatacaggtggtcaagaacttccgccacggcttgcacgggaagggcgcgtcggtgaagatctcgggaggccgtggcggcagtgggagcgcttattcgacgccgaagaaggcactgctgatgcgcggcgagactaacatgctactgatgagcccaggagaggctctgcattccaatggtgttcaccatgttgacgttgagactgggaaggttgtcgcagaatggcggtttgagaaggatggagctgatatcacaatgcgagacattgccaatgacagcaagggagcgcagttggaaccctccgggtcgacattcttgggcctggatgacaacaggttgtgtagatgggatatgctcgacgccagaggccgggtgcagacaatcggtagctcatcagactcaccagtgctgaactggtcacagggtcatcagttctcgcggggcaccaatttccagtgctttgcaagtactggggatggttcaatcgttgttggttctgtggatggcaagatcagactctattctaagagctcgatgcgtatggcgaagacagcattcccaggccttgggtccccgattacacatgtagatgttacttatgatgggaaatggattctgggaacaactgacacatacttgatcttgatatgcactatcttcaaggacaaagatgggaaagaaaagactgggtttagtggccgaatggggaataggattgctgcaccaaggcttctgaagctcactccacttgattcagttttagccgggaccgacaacaaattccacggcgggcaattctcatgggtaacggagaacggaaagcaggaaaagcaccttgtcgctacagtcggcaaattcagcgtcatttggaattttcagcaagtcaaggacagcaaccatgagtgctaccgtgatcagcagggcctcaagagctgctactgctacaaagttgtcctcaaggatgaatcaatcgtcgacagccgcttcatgcacgagaagtttgcgacgagtgactctcctgaagctccgctcgttgtcgctacgccaatgaaagtcagctccttcagtatagcaaatcgacgctgactccgaagctcttttccccagttgtgcagaaataatctgagaagttgcaggtttttgttcagtttgttcctttttcctcttttagacggtttggttagttctgttggtacagaactgatcgaggttcctcccgagaagaactggtttttgtgtcgtgtgcatgtctggtcatttgtagcgggctagcggctcggtaaaatggtgtgtatgtctgttggataaaatgtaccatgtgacaaaaaaaaagtaattttgatttgagactctagttcaagtccaaaaaaaaaaaaaaaa

SEQ ID NO: 9967 - protein, 618 aa, Zea mays
  misc_feature: Ceres CLONE 488682
  misc_feature (1)..(598): Pfam Name: VID27 Pfam Description: VID27 cytoplasmic protein
MGGSHSREDVDLTSSDEEEEFEDDYDARSPIAEAAASAGQRDDDLLRTATPSSLEAIDAKLRSLDLKYQRPTAAKLYLHVGGASPSARWVPAERRATYAFVDQSSDDASSPRWFLEVGPGPRVSAPVDSALQLKTIPAQRRADFAASGSVWALRLPTDAELRRFRVEYERCLFENTYGVEATDEGRKEVFGADFAAWARPAEADDTVWADAEESLTPPAAAPGKDLLKEFEEEAGDGDSIQSLALGALDNSFLVGGAGIQVVKNFRHGLHGKGASVKISGGRGGSGSAYSTPKKALLMRGETNMLLMSPGEALHSNGVHHVDVETGKVVAEWRFEKDGADITMRDIANDSKGAQLEPSGSTFLGLDDNRLCRWDMLDARGRVQTIGSSSDSPVLNWSQGHQFSRGTNFQCFASTGDGSIVVGSVDGKIRLYSKSSMRMAKTAFPGLGSPITHVDVTYDGKWILGTTDTYLILICTIFKDKDGKEKTGFSGRMGNRIAAPRLLKLTPLDSVLAGTDNKFHGGQFSWVTENGKQEKHLVATVGKFSVIWNFQQVKDSNHECYRDQQGLKSCYCYKVVLKDESIVDSRFMHEKFATSDSPEAPLVVATPMKVSSFSIANRR

SEQ ID NO: 9968 - DNA, 1060 bp, Zea mays
  misc_feature: Ceres CLONE 488729-R
  misc_feature (994)..(994): n is a, c, t, g, unknown, or other
ctctacccatcccttaaattatccctctcccctcacccctctcccccccaccccccacagctggcgctccaccgccggtggcggccgcatctattcctagtaggatcccccgcgcctgcaggaattccccttctttttcttctttttatatttaaacacactcattgcacatagtaatgcgtttttacccaagggaataaaatattacatactagcccacaaatgcaaaaggacactcctcaaccacatatttgagactcttacagctcccaagaagtcgcgccagcatagggctagtggcgttagaactcataatttcattcttaacgccaaaaagaaccgccagtaaagctactgcaaaaggatcatctccagtaagaaaaacaattttcttacctttcccaagtgctgagcgaacctttttgctgatatctgacgagcgattgttatttgctccactaatccaaccaggggcgggtaaacccaccccccgccactaccacatgtcacctttcacaaccccaccttcccgaccggctaatctgccctttaccggaataaaagtcacaattcccccaacaattgcctactccaaaaaacccccatgggtaccatctcccactccacaagaatatcctccgtggtcgcttagctcccaaccatcacagccctttaatccttcccaaatacacccactcttcgcattttatgtcaacccagactattccccccggccctccccttggcaaaccccccaacaccaacttcatactggctcccaaccacgccaagcaccaccaacattacatcacattaggacatacacggcatcatctgcaaccacaccctacttgccacacaaaaaggcataattctttcccaacctcgtctcctttccccaacagcccacctacgcttctacttggttttcctcttctccctctcacaaaaaaaatcttctcttttttaagcttcaacgacttctctcctcggncatgtgtcaatataccagtcttccggaaccactttcaaagcatcgcaacatatatacctctcccat

SEQ ID NO: 9969 - DNA, 1003 bp, Zea mays
  misc_feature: Ceres CLONE 488789
  misc_feature: Encodes the peptide sequence at SEQ ID NO. 9970
caaccttcggccatggcttcttcttgatctgtggtgcgcgtgggtctccgtctcccctaccggtgtcgcaatctgcagtattttttccccttcggtgctagggaaaagagagagaaaatctcacatcttttgactgcagacatactagtttgatgcaagctttgtagattgtcttggctgcactgtcctagagcaagtttctgtcacaagtgagatatttctgcgggttccaaaaaggaagcaacgacgaattgaaccatctgcagcttcttccgttgcattgcctcgtactgcatacatctgcagcttcttccgttgaattgagccaacaatgggtagggggagaggcagagggaggaaacagctcaccaacggcaggactcacgcggacaagaggagcagcggcgaggaggtcgtcgcgcctgcaaggaagaggagggggcggccccagaagcgtgtagccgctgagaagaccattgaggcagagatgaaaaaactggtggaggaggccgatgatggcgacgaggactacgtggtgggagcaggggatggtggtgccaagccgaagggctccagaacagagcatgcttccgcaggagccggtggcactggcaacaagaggaacagggtgcacaatgaagaagagggctctagtctccttgacatggacgagaacagctccagcactcggtccagcaatgacgagtccaccagatccaatggcttccgccagtctggaagccgccggaagagcaccccacggcgagcggcggaggcagggctatagtcagaagttggagttggaatgcagcagattctttggtatcgtttaggcagatgctcttcagttttgtcgcacattcatatttttagttgcaatgttcaattttttgtcgtcttggtgtttgctaggcctacatctacatgagtgtaaaaacatatatataatactgattgcaagccatctgaattttgtgcttatgcgaaaaaaaaaaaaaaaaaa

SEQ ID NO: 9970 - protein, 151 aa, Zea mays
  misc_feature: Ceres CLONE 488789
MGRGRGRGRKQLTNGRTHADKRSSGEEVVAPARKRRGRPQKRVAAEKTIEAEMKKLVEEADDGDEDYVVGAGDGGAKPKGSRTEHASAGAGGTGNKRNRVHNEEEGSSLLDMDENSSSTRSSNDESTRSNGFRQSGSRRKSTPRRAAEAGL

SEQ ID NO: 9971 - DNA, 803 bp, Zea mays
  misc_feature: Ceres CLONE 489085
  misc_feature: Encodes the peptide sequence at SEQ ID NO. 9972
gtcgactcgtcgtcgtcggtggtagtatctgagccaaatcttacttggaagtagggttttggcctgtgtaatccgatcgaccttgcgcagttgctccgatgggcaaggactcgaagccgaaggacgccaaggggaagggcaagcaggcggccggctcctctggcggcgacgacggcggcggcaagggaggcaagggcaagggcaagggcaagggcggcaagtccgctgacggactcggcacttgcacctacgtcaaagctaagcacgtattgtgtgagaagcaggggaagatcaatgaagcttataagaagttgcaggatggatggctgaataatggggacaaagttcctcctgctgagtttgctaaggtagcacaagagtattctgaatgcccatcagggaagaaaggtggagatcttggttggttcccgcgtggcaagatggctggtcctttccaggaggttgctttcaacacacctgagggaactgttagcgcaccattcaagtccacgcacgggtatcactttatcctctgcgaagtacggaagaactgatctggaaatgtcggttggggagactgcatcatcaggttgtatgagacgcaatgcaaactactcaccttctctaataagcgctggacatgtgtactttgtgttgggctattcgcattctgttccaaacaagttgccaaaacaaaagaatgtgtgattcgctgtaattaacatattgtactgataatctgatatggcatacctatctgggtcagttaacaggtgggttttagcaaaaaaaaaaaaaaaaaa

SEQ ID NO: 9972 - protein, 151 aa, Zea mays
  misc_feature: Ceres CLONE 489085
  misc_feature (56)..(148): Pfam Name: Rotamase Pfam Description: PPIC-type PPIASE domain
  misc_feature: SWISSPROT Homolog: EC 5.2.1.8 Peptidylprolyl isomerase
MGKDSKPKDAKGKGKQAAGSSGGDDGGGKGGKGKGKGKGGKSADGLGTCTYVKAKHVLCEKQGKINEAYKKLQDGWLNNGDKVPPAEFAKVAQEYSECPSGKKGGDLGWFPRGKMAGPFQEVAFNTPEGTVSAPFKSTHGYHFILCEVRKN

SEQ ID NO: 9973 - DNA, 665 bp, Zea mays
  misc_feature: Ceres CLONE 489162-R
  misc_feature (531)..(531): n is a, c, t, g, unknown, or other
cagattggtgaccgggccccccctcgaggtcgacggtatcgataagcttttttttttttttttttgcttccccaattacaaggttacaagcaaatgtaccttcgttttctggacttttcaatgcggtcccacggccgttaatggcacagttttgatagcgcccaaccagccacacaggagacagcaatagtttggcggataagcgaaagtactggataattctgcagcaagagcagcaacttctagtgtgctgggaacaaaaaaatgttttctgaaacacgtagaccctagacatgtgatccactgcagtcaagaacagcctgctcatggcaaactccatccaaattagcctgccatagcttaaccatgccatctcctccggttgatgagagtgtcataccgcccatgtcccattccagttgccacacctcgccattgtggccattaagtaaagcaatgttctgcgtcgaaggtccgccatcagcatcagcgttcaaacctatatgccagatttgcaatccctttgcaggntgcaactgcgataatctcatatggtctgccaatgttaggagcccctgctacagcacatactttatctcctgtatcctcaggtgaactagctccacaaagtgaagaccagcgctgatgagctccttcaactccca

SEQ ID NO: 9974 - DNA, 1016 bp, Zea mays
  misc_feature: Ceres CLONE 489700
  misc_feature: Encodes the peptide sequence at SEQ ID NO. 9975
ctccgccccaagcctcccacggttggcactcgcacaggcacagcaccacagagcagagcagcagcagcagcgcgctcacaacgttcgcaatggcggcgcgggccaccgtcgtcctctacgccgcgctcctctgcctgctcttcgccactagctccgtcgcgcagtcccccgcggccgcgccagccaaggcgccgcccaagccctccaaggacacgcccaccgccgcgccgtccgccaccccggctgcgcccgctcccaagtcctccaaggccagtagcccatcagcagcgccggccgccgcgccaaccaccccggcccccgcagcggcgccagccaagccgcagcccaaggcccccgcgccccacaccaaggccgccgccccggccccggccgctgccgcgcctgcgcccgtcgccactccccccgcggcgacacctccggccgccgcgcctcccgcgcccgtgcccgaggtgccctccgcggcgccggcgccggagaccaagcccgccgaggcccccgcccccgcgcccgccaagaagaagaagccgtcgtcttcctccaaggacaagacgaagaagaagaagggcgcttctgcccctgctccggcccccgtcgcgaagaagcccaagaccgccgacgcgcccacgtccgcggccgaggcccccggacccagtggcgacgccgccgccgctgccgacaccgcgggcgccgcagggaggacacaggcgggcgtgatggtgtcgtcggccgtcgcggtggcgctgggtgcggcggctctgctcgcctagatctcggatggctctggcgaatgcgtttcttctgtgtaggacccacatcacatcgatcgattcacttgtgcggatgcattctttttagctttatgccagagatgacatgagtgtggttactgtgggacacttgcccctgtaatgttcagatttattgctatttatatattattaaaaaaaaaaaaaaaaaaaaaaaaaaaaaaaaaaaaaaaaaaaaaaaaaaaaaaa

SEQ ID NO: 9975 - protein, 232 aa, Zea mays
  misc_feature: Ceres CLONE 489700
MAARATVVLYAALLCLLFATSSVAQSPAAAPAKAPPKPSKDTPTAAPSATPAAPAPKSSKASSPSAAPAAAPTTPAPAAAPAKPQPKAPAPHTKAAAPAPAAAAPAPVATPPAATPPAAAPPAPVPEVPSAAPAPETKPAEAPAPAPAKKKKPSSSSKDKTKKKKGASAPAPAPVAKKPKTADAPTSAAEAPGPSGDAAAAADTAGAAGRTQAGVMVSSAVAVALGAAALLA

SEQ ID NO: 9976 - DNA, 716 bp, Zea mays
  misc_feature: Ceres CLONE 491553
  misc_feature: Encodes the peptide sequence at SEQ ID NO. 9977
aaagtttcggcagcggtgtaggcagcggcggcgtgctcgtgtaatcccatcccgaagtctccggtcacctgtcactctacgcaaccatgtcgaggaggaagaccagggagcctaaggaggagaatgtgacccttggccccactgtccgtgaaggagagtatgtctttggtgttgctcacatctttgcatccttcaatgacactttcattgagggaaacactggttcggatcactggtactatcgtgcgatgaaggtcaaggctgatcgtgatgagtcgttaccttatgctgctatgcttgctgctcaagatgctgcacagcgttgcaaggagcttggtattactgcactgaacattaagcttcgtgccattggaggcaacaagatcaagacccctggacctggtgctcagtctgctctcagggctcttgctcgttctgggatgaaaattggacgcattgagaacgttacccctgttcccactgacagcatccgcagaaagggtggtaggaaggggaaggaggctgtaggcgtatttgacatctcttggaggtggccatcaagcagctagtcctctctggatagtgttgctgtttctatgcttgtcaagaggagctttgattttgctatatgttgatgaccatttaccgtggttgaggaattgagttgtcatatttatcttctagatatgcattttcacgtaaaaaaaaaaaaaaaa

SEQ ID NO: 9977 - protein, 160 aa, Zea mays
  misc_feature: Ceres CLONE 491553
  misc_feature (28)..(142): Pfam Name: Ribosomal_S11 Pfam Description: Ribosomal protein S11
MSRRKTREPKEENVTLGPTVREGEYVFGVAHIFASFNDTFIEGNTGSDHWYYRAMKVKADRDESLPYAAMLAAQDAAQRCKELGITALNIKLRAIGGNKIKTPGPGAQSALRALARSGMKIGRIENVTPVPTDSIRRKGGRKGKEAVGVFDISWRWPSSS

SEQ ID NO: 9978 - DNA, 709 bp, Zea mays
  misc_feature: Ceres CLONE 491623-R
  misc_feature: SWISSPROT Homolog: EC 2.4.1.18 1,4-alpha-glucan branching enzyme
  misc_feature (40)..(40): n is a, c, t, g, unknown, or other
  misc_feature (92)..(92): n is a, c, t, g, unknown, or other
  misc_feature (95)..(95): n is a, c, t, g, unknown, or other
ttttgtgtttgcgggtcggtctggcgcgcaccccaccgcncccccacagaaagccgggctctcccggttggtgggtgatatccccgcagagntanaacgaattaggtacgggaccccccctcgaggtcgacggtatcgataagcttttttttttttttttttgggatttttaaattgaatgaaaataaatatatacacttagattacatacggcttagataaggaagaccaatgtgaagaagatgctaggatctaaatatcgttgaagcctataattaactaaaactgcaggtggctagcagtcaaaaaaaactcgccctggggggacgacgtcccccaggtggccgggtggtacatatgcctagcactggctaaagaagcaaaaggaaaaggggacataccgggctactcattccgacatgggtttcgtatatccgcaatgattttggacaattaggttgcgcatgtctgaacacatactttacctcttcaggaggatcctaataaatcccatcatatgggatttctcctggggcctgcactgagtaattgatccacgctggaattgaatcctttatccctgatggagtatccattctcacctttacacgagatccatgaggaatatgtgatgcaccatctgaacttgctaggcagaaaaatttcccaaacaccaaaatcatttttgctcatacgatctgcatttgga

SEQ ID NO: 9979 - DNA, 1605 bp, Zea mays
  misc_feature: Ceres CLONE 491925
  misc_feature: Encodes the peptide sequence at SEQ ID NO. 9980
aaatacgcctctgctttagcagtagtttccaaccagaggcaggcacctcgagaggcgggtgaacatggagggcgataagaaggcgggcgccgtggcagagaagaaggcggcggcggcggatcagagcaaggaggtggccgctgccgcaatgatgcagtcgcatctgccctccccggcgaggctggggctcacagcctcgtcgccgtcgctcccgcccaatccggtccccttgaatcccacatcctcgccttcacacggtagcctgccctggagcgcagccgctggcaccagtgctgccccaaccctaacgacctcgccatcgctgctaccgctcctgccgccgcttccgcgcgcgcaatcgctgctccagcttatatcgtcgctcgcttccaacttcttggaactctcggcgaaccgcgccgcgtggatctcagcataccgaggatcgcttcccaccttcctcccatcggcgtcctccgcgccgccgctcgcaaccccgatctcctccaccgaggacgcgctctctcttgtcaccaccctgcagacgcagctcttcgaggccgtcgccgagctgcaagagaccctcgatctgcaggatgcgcgcgcgcgccttgtccgtgaggcgcgtggcaaggatgctgcgctgctagcctttgcgaagaagctgcacgaggctcaccaagtacttgaccgcctcgtcgacgactacgctgactaccgtcgcgatcccaaacgcccgcgtggcgccgctgctgctgacgatcccgagccggcgtcagagggcgacttcggcacgtccctccactccagccttaagcttgatgacatcctgacctacgcgcaccgcataagttacacagcctttgctccgccggagcatggtgctgggttgcctctccgtgttagcctgccacctgtaccacaggagaatcagatgagagcgtcgcagctgtatctgtttgctgatttggatttaggggtacccaagaagccattggatgcgaaggacgggatcgcggcagaagtggaggttgcaccgctgtatgaggcaccacaggaggggccgtcgaggctaccaaacaccttggcacccatgttcccgaaggagctaaagccgccgccgggatggaagcctggtgatccgatcacgctaccacttgatgagatactacctggtatcaagggtgaagagcgggaggcacaggcccctgtgccgcaggcacctgtttcagtgcgaccagtggcaccaatgggcccagagacaatacaggtcaagcctgtgcagcttgattttgggagcagtagtagtgatgagtacagtagtgacgttgggagctcagaagaagatgatgaggattagtgctcggtaagctgctctattttgttggctttcaattgtagttgccttctatcgtatgcttggagtagaatcttctatgctagcgatttttacctgctcatatcttcctgactatttatgaactttagggctgatctcagatcattgtaatggtgctttatcctctacttgttaaaccaatgtattctaccattgattttacttattatatgcttagtatcaattgtttaaaaaaaaaaaaaaaa

SEQ ID NO: 9980 - protein, 431 aa, Zea mays
  misc_feature: Ceres CLONE 491925
MEGDKKAGAVAEKKAAAADQSKEVAAAAMMQSHLPSPARLGLTASSPSLPPNPVPLNPTSSPSHGSLPWSAAAGTSAAPTLTTSPSLLPLLPPLPRAQSLLQLISSLASNFLELSANRAAWISAYRGSLPTFLPSASSAPPLATPISSTEDALSLVTTLQTQLFEAVAELQETLDLQDARARLVREARGKDAALLAFAKKLHEAHQVLDRLVDDYADYRRDPKRPRGAAAADDPEPASEGDFGTSLHSSLKLDDILTYAHRISYTAFAPPEHGAGLPLRVSLPPVPQENQMRASQLYLFADLDLGVPKKPLDAKDGIAAEVEVAPLYEAPQEGPSRLPNTLAPMFPKELKPPPGWKPGDPITLPLDEILPGIKGEEREAQAPVPQAPVSVRPVAPMGPETIQVKPVQLDFGSSSSDEYSSDVGSSEEDDED

SEQ ID NO: 9981 - DNA, 2432 bp, Zea mays
  misc_feature: Ceres CLONE 492021
  misc_feature: Encodes the peptide sequence at SEQ ID NO. 9982
gccgcgccgcacttctccccatccggcgccttctctatcctcgccgctgaagacgtcgtgccgtgcgtagctagcagtgctgacgcgcgctcgtcgaataaggattggatttggcttttcgtccccccaccgcctcctccggtccttcccctgccactccctattctcctcgtccgaagcggcaagctcaagctcaggagctcgcaaccgaggagtaccaatttctctagggatttggcgtatccaccagggagcaggaatagggtgaggcttcctgatggcgggggcgaaagcggatgtagacgcggaaacaggagacggcggctccttcagcgagcagaggctgattgataagctcaaaaggctcaacaactcagccgctagcatccagactctttcgcgttggtgcatttttcaccgcaagaaggccaaaagggttgtagacacatgggaaaaacagtttactagtgcaagggaggataagaaaatatcattcctatatctatcaaatgatatcctgcaaaacagtaaacgcaagggagcagactatgtggatgagttctggagggttctacctagatccctgaagcatgtctatgaaaaaggaggaggagaagggaagaatcaggtggcgagattgatatcaatctgggatgaccgtaaagtttttgggacccgtattgaaagtatgaaaaatggcattcttggtgacaaccctcctatattggataacaatgggaatagtttaaatcctagctctaatcccacttcaaattctaaagctgcacggaaggattctggtacaatagtaaaaaaactcactgttggtggtatgcctgaaaagatcgtgtctgcataccaattagtgcttgatcagcattttgatgaagacactgctttaaacaaatgtaagactactttgggccttttggagaggataaataaagatattaatgattctatcatcaacggtaatcagccagcattgtcattgatctctgaccttcaagaacaggaaatgacccttaaacattgtatcaaacaactcgaaagtgtagatatggcgaggatatccctggtcaatcaattgaaagaagctctcaacgaacaggagtcgaaatcattagttcttcgcgatcaattgcaagttgctcaaacagaggctcaacgtgtcatccaacttaggaaacaactggggggtgcccttgtcacgagcgtcacacattctacttctagtccgctcatgattactccaccagaacaaacttcggctataatgcagggttcagaagtaagatcgacacatccccagtcacaaccactgaatcctgcagcttcgcttccccctacagtcagtgcagtgggtgatgagtccaagagaacggcggcagctatggcggataagcttgcatctttgtcagcacctgtgcaggtgctgacctccattctctcatcttttgctgctgagcaagctgcttccataaatggtggatcatcttctggggaattctctggaggaccaccaggtttccacattgataagaggcctaggcttgagaaaacaggtcaggcctctgacatgggtgctcctcctcccttttttgggcaagcggcacaggtgcaacaacagattggaggcacgcatccaccagctccagctccaggctcattcccaccacctccaccgccattgccgtctctactgccaccgctcctgcaacagttcggtcaaaatactggagggatgattggaatgggaggacctttcgggatgatggctggatctatgccacctccgcctccattgtccaacattctgccggcaggttttccgcgaccaagtgggccacctcctccacctccacttccaccagctcagagccagccccagcagcagtctcctcaggcggcacagcaatcaccaacatcaactggattctttcagtcatcgggcatggggttctttccgcctgcgcaggtgcagcaatctccatctgcccaacgccagtgactcaacggtggctctggcattcatgggcgtaaaggcagcggcgcccttgtgtgttaactttgtacactgaacaatatttcactctgtgtcgagcttaaacgtggctggctggtcctgcaagcgaggcagggccaatggccacgaattagagagattgtagaataggcatgcgtcctctgctatgtataactattcacttttttttgttttgttttgtttgtctgagtagttttaacttttcctttttcccgtttgcattgatcccccgaggcagaagaaagtgactttggaaagaaaaaaaaaactggtgtttgcccaactgatggaaacagttttaggactgaaacagctgtggaactaccggtcatagtctcagatatgataatgaactgcaaatatttccctaaaaaaaaaaaaaaaa

SEQ ID NO: 9982 - protein, 577 aa, Zea mays
  misc_feature: Ceres CLONE 492021
  misc_feature (67)..(132): Pfam Name: DUF618 Pfam Description: Protein of unknown function, DUF618
MAGAKADVDAETGDGGSFSEQRLIDKLKRLNNSAASIQTLSRWCIFHRKKAKRVVDTWEKQFTSAREDKKISFLYLSNDILQNSKRKGADYVDEFWRVLPRSLKHVYEKGGGEGKNQVARLISIWDDRKVFGTRIESMKNGILGDNPPILDNNGNSLNPSSNPTSNSKAARKDSGTIVKKLTVGGMPEKIVSAYQLVLDQHFDEDTALNKCKTTLGLLERINKDINDSIINGNQPALSLISDLQEQEMTLKHCIKQLESVDMARISLVNQLKEALNEQESKSLVLRDQLQVAQTEAQRVIQLRKQLGGALVTSVTHSTSSPLMITPPEQTSAIMQGSEVRSTHPQSQPLNPAASLPPTVSAVGDESKRTAAAMADKLASLSAPVQVLTSILSSFAAEQAASINGGSSSGEFSGGPPGFHIDKRPRLEKTGQASDMGAPPPFFGQAAQVQQQIGGTHPPAPAPGSFPPPPPPLPSLLPPLLQQFGQNTGGMIGMGGPFGMMAGSMPPPPPLSNILPAGFPRPSGPPPPPPLPPAQSQPQQQSPQAAQQSPTSTGFFQSSGMGFFPPAQVQQSPSAQRQ

SEQ ID NO: 9983 - DNA, 671 bp, Zea mays
  misc_feature: Ceres CLONE 492075-R
  misc_feature: Translation starting site: 324
  misc_feature: SWISSPROT Homolog: EC 1.3.3.9 Secologanin synthase
caaattgggtaccgggccccccctcgaggtcgacggtatcgataagcttttttttttttttttttattcgtcggttcgtcctcccattcaaatgcaaatcaaaatgatatggactttttacacatgcatttttgttcccagttgagtaatatacctcaccaaactctttaattacttactgtcaatatctacataacttttcatttgacgtttccaatctgtccgctggtttccttcccgacctgcactgcacgaacccctatgcggaggccgcggtggctctggccgccgcgtcgtactccccggcgccgcggagctcgtcgatgacgacgctgaggtcgcgcgggcgcacctccatccggagcccgtgcttcatgaagagcgtgagcgacatcttctgctcgacgcggtggcccggcgcgacggttaggcggtggcgtatgagcacgctcccggcgatgttcttcatctgcaggtaggcgaggtccttgcccaggcatatccgcgggccggcgttgaacgccacgaacctgtacgagtcgtggggctggaacctggtgccgtcgtccgacagccagcgttcggggcggaactggaggcagtcctccccccacaccgtcttcatgcggcccgccgagtagatggagtaggtgaccgaggagcccgctggc

SEQ ID NO: 9984 - DNA, 761 bp, Zea mays
  misc_feature: Ceres CLONE 492107-R
  misc_feature (46)..(46): n is a, c, t, g, unknown, or other
  misc_feature (48)..(48): n is a, c, t, g, unknown, or other
  misc_feature (49)..(49): n is a, c, t, g, unknown, or other
  misc_feature (52)..(52): n is a, c, t, g, unknown, or other
  misc_feature (54)..(54): n is a, c, t, g, unknown, or other
agggattttttgtgtgtgtttaaattgtcgttactacaccaaaaancnngancnccccccaattgggtaccgggccccccctcgaggtcgacgttctcgataagcttttttttttttttttttaacgatccgaatcagtcacggctggatattagttcacgacaaataaacggaggtactacattatgtatttgtgtgtgtttttcccttcaagaagtgaaaaaaagaacggacgaaaaaaaactgaaccagcagcgcctcttccatacacgggagactcatcgcccctaacacttaagctcaggttaacgatctcgccaccaacctaaacgacagttctcactcacagcctaccaagtactaccaaataacggcgacttccatccacatgtgcatgtatggcaacaacgaacgaacgaacagatccttaaataacacgccggtgacaggacgaacttcttctacagagcagcccgctaccgctgcttgagtttatctgtcaacagcctcttccccggctggggcagcggcgggggcaccaactcttttgtcgaactagggaatcgagcctccccgggcctccaaatggcgaacatgggttttaaacaggaccgcggactttggggccgccccataagctttaatcaccattcaccataaatctccccccccggaaggaagcccggatccacccgtggttgcctatgcgggtggccccgtccctggaaacctaatctcccctggggggattcctttgtggg

SEQ ID NO: 9985 - DNA, 686 bp, Zea mays
  misc_feature: Ceres CLONE 492181-R
ccgattgggtaccgggccccccctcgaggtcgacggtatcgataagcttttttttttttttttttgtatcttaactgattgagttaaacgcaagctgaaacatcacatcgggatactacctactaaaaggacagaggggaaacagggctgtgcaaatgccatcaatcaggaaggtgatggccagagaaccattatactgaaagcttctgtggctcatggctagcagaactgaatctgtcaagcataagcagtggcgtacagacggttagattcggccatgtcactctcctcgccttccactcctaaaaactgagacgtctttccactcgaacagctcctttcagagagcaacttctcttcggataaagccttctcgagcctctcctcaaatggcgttgcatgccaactcaccttttggtcttctttgtacttatttgttgaattgggaatgccatttccatcccgcaatttagaggtaaaatttgctggcaccttatctttccaatgtgctgcaaccattccaataatgggcctatcctcatctgaactcttacccgaatgagacctgtctcctgccatggcctcatctctgaatgccttcttaggatttggaggtttcaaccattgggctaagcttgggagctccagttctgaattatcgctgttcggtaacttctttctggtgg

SEQ ID NO: 9986 - DNA, 718 bp, Zea mays
  misc_feature: Ceres CLONE 492267-R
gaccgggccccccctcgaggtcgacggtatcgatattttttttttttttttttgtttaaacagtactttacatttgactttttgaaatctgtcagtgtcagccgacaccgctcctgcgccctgtaaatattaactactcttatgcaagcagaagggtgtaatgtatttttttcatacgaagggtaacacatgattcaaaagacgagctccgactatgccattgcaacaacaaactgtccccagcagtaaacaaaatgaaatctgaagttggtagtgagttaatttgcatgtgttgattcctttggatcagcatctctgcaattagtccctttctcttccaacttctcacaaacataaatgaaatgtgaatctggatctttgagaacatagtcaggtggcagttggccaccctctgtgagtgtaacctcctccaatataagatgtggagcacctttactcattctcagttggtatccagctgtgggcatgaatgtagagggcaatactccagctgcatccggactgggttcagaagatgggaacacgttcccttttggagcaaccatatggtttatcaattaagtaagaatccccatgaaggcaatcaaaaagcctttggccactttcgtgcctaagacattttttgaaaaagccaccattgtagggaagccattccatccaggcgacccaccattcaataaggccaattccccaggga

SEQ ID NO: 9987 - DNA, 809 bp, Zea mays
  misc_feature: Ceres CLONE 492299-R
aaatcaaaaaatttttataattattattcaatatttatggaatgtcaagagtaggaacggcggagttactcagttactggttataatttccaattgggtacgggccccccctcgaggtcgacggtatcgatacagcgggtcgtacccgccgatgacgaccgtggcaggcgggaaatcaggggcgccgtcgatgcccgcggtggcgacgtcgggggatgacgcctcgtgggtgcggtccgcgccgtggggaaggaaagcgcgccacatccagtcggtgcgcggaacggagacgatgggcgcgccgacgagccgcagctcggcgggcgtgcgctcctggccgccgaagaagggctggatggcgatgaggccggcgaggcggaggttcgtgaaggcggaagggtccagcgcgtagcggcgggcgacgtggtgcgcgatgttaccgccggcgctgtcccccgcgaggaagcagcgcgcggcgtcgatcggcggggcgcccgcgatcgcgccgggggtcggggtcgggcccgggcccgccgtcgaggaagcggagcgccgcgaagccgtcgtcgtaggcggcggggaaccggtgctcgggcgagcggcggtagtcgacggacagcaccgccgcgccggcgttccctggcgatgccggcggcacgcaaacgatcgtaaggcggggggaacgcccgccggtagaggtatacgccgaaaaaccgtcccgtcccgttggaaatgaaacggcggtaccaaccgggggaaaccaacccggggtaacggactaaaggttcctttacgctcggtttcacgaa

SEQ ID NO: 9988 - DNA, 908 bp, Zea mays
  misc_feature: Ceres CLONE 492350
  misc_feature: Encodes the peptide sequence at SEQ ID NO. 9989
cgccccctccctcctctcgtctccactctctctctctctctggcagccaaaggcgaggccgagatccggcgcgcggaggatgccttccaggtccatgagccggctgtccgtcgagtccgcctcgggcagcgggggcggctgccgggaggccgagccggtgctctgcgcgcctcggccgcgcagggcccagcagcagctggtccacgtccacccccgcggcgccgacctcatcctcggcccgccgcccttcctgctcaacgaggtacccaccaccgcccttgtgcctggaaccggaaccggaaccgggaaagcaatcttgtctccaagctcttccccgctcacaacacaagcacgttctttctcgcagagcagcgaggagggtcgctgcagctgggcggcgttgggcggcgggtcgccgccggcgcgcgcgggcaacccgctggtgcacgaccccagcttcctgctgagccagcgccaccccgcggcggacccgccgctggagctcggcttcttcgaccacctgatccgcaccagcagctacgtgcaccggccgacgacgacgacgtcgtataccagctccggcaccagcagcagcggcggcagtagcagcaagagcagttttggcccgtcgtcgttcgcgcccgccgtgaggatccaggggttcgacgtcgccgcgtgccggagctcccacggcggcgggggcggccgcgtgctgtccgccgcccgcgcgtgagcggtcgagctccatggtgtggagggggatgaaatcaaagagggaggaggaagaaccttgtgtacagattctgtgtctgacgagtcgtgttcgtgttcgtgtccgctgtactaattgtgaacaccaccacacatagcatagcatatagcatagcatatcaaaaaaaaaaaaaaaa

SEQ ID NO: 9989 - protein, 217 aa, Zea mays
  misc_feature: Ceres CLONE 492350
MPSRSMSRLSVESASGSGGGCREAEPVLCAPRPRRAQQQLVHVHPRGADLILGPPPFLLNEVPTTALVPGTGTGTGKAILSPSSSPLTTQARSFSQSSEEGRCSWAALGGGSPPARAGNPLVHDPSFLLSQRHPAADPPLELGFFDHLIRTSSYVHRPTTTTSYTSSGTSSSGGSSSKSSFGPSSFAPAVRIQGFDVAACRSSHGGGGGRVLSAARA

SEQ ID NO: 9990 - DNA, 623 bp, Zea mays
  misc_feature: Ceres CLONE 492473-R
  misc_feature: SWISSPROT Homolog: EC 1.11.1.7 Peroxidase
  misc_feature (569)..(569): n is a, c, t, g, unknown, or other
tcgaggtcgacggtatcgataagcttttttttttttttttttggacctcaaatccatgcttatcaatcatactacgtactcctgcgaatcgaatcgaagcaagtgtacaccaggaaagtaacccaatccactgatcgatgcaaatggcgcggcgcgcgcgggcaggctgcacgatcagttcactcggcggcagttgagccggacctcggcggcggccgcgctcgccgcgggcggccccaggttccccatcctcaccatggcggcggcgaagtcggccgcgaaggccgtcccgttggcggcgtacgcgcgacgagcgcgtccgtggtgttgcccccgtctccgccggtgccgtacagcgcctggtccgagggaagcagcacgcggcgcgcgaccaggtcccggaagtagccgttgtcgaaggcgtcgggcgcctgcggatccagagccgccaggctggcgtcgccgcccgtgtaagggcagacggagccccggaggcccgccgcgaagctggcgtccgtggtggcggtgtctttgaatatgtgggcgcggaacaccgccgcagcgggcgngaccccaccctgagccctcttgtaacaaccacctacctcaccccccctctccgc

SEQ ID NO: 9991 - DNA, 657 bp, Zea mays
  misc_feature: Ceres CLONE 492550-R
ccaattgggtaccgggccccccctcgaggtcgacggtatcgatattttttttttttttttttcttggtttagggttaccgacaatgaaattgatttgcaggtgcagatatattacaaacatatactactactgtatacttatagctaggaaattctaactatctgttactagtatatatataacctttaatttgttgatgatggaatcaaaagaatggatcttttactaccaagaggcgagaggctgagaaagaaagaatggatatcagtggatgcagatgcccggtagcttccactggaactttcccgcgcgtcgctcctcgggtgtgccggcggtgtagttcctccagacgtcgaggaccccgcggaggtcgtggagcttggcgccgaggccgacgcagcagttggcgtggagcgtgcagatcctgttgaggtccttgctgagctggcagaagccgctgatgtaggctgtgtcgaggaactggatggcgaggtccagcctgggcgcctcctcgtgcttgatgaggttgaacacgtcctgctcgtgcttccccaggaagcgccaccgcccctgctgccacgcccggtagaaggcgacggtcttgtccgacgcccgcacgaagaggaaccgccgtttggggaagttgcgcaggctga

SEQ ID NO: 9992 - DNA, 485 bp, Zea mays
  misc_feature: Ceres CLONE 492796
  misc_feature: Encodes the peptide sequence at SEQ ID NO. 9993
aaaatcgaaacaaagaaagataaaatcgagaggacgccagggccgattctctgcgtgacttggggcgtcgtcgccgagttttctccggccgagggcggcgcgaccggacaaccagcgtgagcgcgaccggcgacatgactcgcggcaaccagcgtgaccgcgaccgtgagcgcgcggcggcgcggaagcccaacgccaagaactcccaggacgggctcaccccggagcagcgccgcgagagggacaagaaagctctggaggagaaggcggccaagaaggcgcagcaggcagcggccggcggcaccggtacctccagagctctcttgtccccggtgtggtttgcaacacctgatgttgtaagactttctggttatgtccgccccgctttgccactgggttattaagaacgtcgttatggatggttgtctacattattgcttatcgatattggaaaactgttatgcgccccaaaaaaaaaaaaaaaa

SEQ ID NO: 9993 - protein, 89 aa, Zea mays
  misc_feature: Ceres CLONE 492796
  misc_feature (1)..(56): Pfam Name: 4F5 Pfam Description: 4F5 protein family
MTRGNQRDRDRERAAARKPNAKNSQDGLTPEQRRERDKKALEEKAAKKAQQAAAGGTGTSRALLSPVWFATPDVVRLSGYVRPALPLGY

SEQ ID NO: 9994 - DNA, 685 bp, Zea mays
  misc_feature: Ceres CLONE 492805-R
caattgggtaccgggccccccctcgaggtcgacggtatcgatattttttttttttttttggaagaacataaagagtgtagcatacatatacaacacactggagtctggagatggaagcttcgttcgtcctaggtcctattaccgtaccgtcaatctatgacgaactttatccactccaaaacacacacacacacaacacaacacaaacaaacaagatactctgacaacacatgaagcaaaccaaacgccataaaaaaacagtgaaaatagggcgggcgaaaataaaaatacagcttaatttacatacatacacgagcactaggaataattttacagcagtggtcgtggtcgtggacacgaagagcgcgtgacacgagatgtcgcgtagcggagacgagccggtgacatcacatgacgctgcacgcagcgctgggctcttcgtcctcgtagtactgctggccgtacgggttccggccgtagccgccaccatagggccagtgcccggcggggccgcccccgccgccgtagtacccgccagtaggcgggccgctgtagctgccgtatggctgcgcgctgtagcccacctcggggggcggggcggccagatgggacggcgcgcccccccatgcccctgctgctgcggcatttggcgccaatcgccggcaatcggcatcggcattcctcc

SEQ ID NO: 9995 - DNA, 646 bp, Zea mays
  misc_feature: Ceres CLONE 492961-R
ccgattgggtactgggccccccctcgaggtcgacggtatcgataagcttttttttttttttttttcagaaaagttaatgtgactatatgccgaagctatatcccgctgcgagttgtgcagttgtgcactaaaacagtaaggacaagagtggagtcaatagctgacatgccagggacgaaagacaaagggtgcactggcaccagcctaaccggggcctttatacaccggatggtaccatattgcgcaaaggtttctcacttttgtcactgccacctacacaacccgcacaacttcactcttcaatgaggaaaactattgacatacatattgttttctcctcaaaaccatatatgaccagacctattcaaaatctggttcaatgctctccctgaataccaccagatgcatcgcctattgactggcacgattccaggaaagtattcccacagaaagcaaaatcagcattgctcgaatagcaagactcggtctttatcgttgcacttgtctcgttgtctacaccatacagcacagcagctgcgttctggtctgactgcagactagtcgaagcatctattccattatgaaggccatgcaagtctttactagcattgagcaattgatcgccagatggtgtgccatttattaa

SEQ ID NO: 9996 - DNA, 850 bp, Zea mays
  misc_feature: Ceres CLONE 493208-R
  misc_feature (23)..(23): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
agaatttaaatattaatttaaanttatattgaaatttagttttttttttagttttttgattgaggtggaagagaacaattatttttttttctaattgggtacgggccccccctcgaggtcgacggtatcgatattttttttttttttttttcttttttttttttttcacaagaagatagagatgttttcaataaatgtgttgtttacaaatacagataagatggaaacgtaaatcaaatcaagaactagtagtgttttatcatgccatgaaaaggggaagtcctccagtgtccagtcctctgttgctataagccacttcatatttccagcagtcagttgccttgtaacttcattgatagtatacattgactagggaaggcgaagcaattgactgacagccaaatctagtgaatcaacattcttccgtagaatcttcagttgcatagctaagctttccaagcctctcatttcctcattcaacctcaagcacgaattgatgcccctatttcctttcgaagatgcttcaagtgcggattactgcaagcggccgaagacatgccccaagcactccatggttttccgcccgagttttaggtgacgtatggnnnnnnnnnacgcggatatgaagctgaagaagggagggcgttgcttttccggcgaatgggcaaaccgtggttcccggtttccaaccggcttttcattggggccggccgtgcgtaccaaccttggagtcccccggggataagggggggataagacctttttttcggggggaggccataacgaaccgggcccctttgggtccggggaagggaattaaaggaaaaaggtaaaaggggggggtataaat

SEQ ID NO: 9997 - DNA, 1143 bp, Zea mays
  misc_feature: Ceres CLONE 493230
  misc_feature: Encodes the peptide sequence at SEQ ID NO. 9998
atgtccatgccgtggaagctcacttgacttatccccacagggacgagggaatgtagtgacatcctgacgtgacctcacgtctcctctcagcccgatcctggctcctgtctctgatcccaacgcccactggtccgcggcagcccggagatgtttctccactccctcttgatgcaaaaaatggcaaagaacacgcagcagccaagaaaagacggcggcgcgagatcgtcaggtggcgggctgtcgtcgtccaagaagtcccggtggtaccagcgcgcggtggaggtgctcctcctggtctggaagcagcagccggcggcgcctccaacgacgaaggccgcggcggcgtcgggggtgacagccgccgcctcgggcaacaagggcgcggcgccaccgggggtgaggctgcgcaagtcgtcgtcgctgaacgtggcggcgtcgttcacgcgggtgtgcctgtgcgcgcccatctcctcgtacaacagcgagtcgctctactgcttcccggccgacggcgccgcgccgcgccggagctacagctacccgcgcgcgtcgtcggcgtcggcgtccgggtgcggcgccggcaccggcgtgagcccgctggtggcgccggcgccggcgccgccgccgccgcctcctctccccgcggggagcagaggcggcgagggcgcgcggcgcgtgttccgcggcaagtcgctgacggacgacgtcctgatgcggcggttcgtggtggacgaggaggccacgcggcggcgaaacgagatggatgtcgtccggcggcgccacgccgcggcctccaagcgccggcgcctcggccccagcccgctccgccggatggcgctggcggagtcggaggcggaggccgaggccgaggaggaggcagcagcgcctggaactgggaggggaacggacaatcgcgtggcagctgctgctgtagcgtaggactgactgcggagctttttttttttcccctgtcctgtgtgctctcgattggctcgccgtcgcctctgttttttcctctgtcgttttcctcttctgctgctgctgtcgtgcgctgcgatgcgactgggagaaggaggagaatcgcccagttttttttttaacagaactgtactagcctcttgttgtacaaaaaaaaaaaaaaaa

SEQ ID NO: 9998 - protein, 263 aa, Zea mays
  misc_feature: Ceres CLONE 493230
MFLHSLLMQKMAKNTQQPRKDGGARSSGGGLSSSKKSRWYQRAVEVLLLVWKQQPAAPPTTKAAAASGVTAAASGNKGAAPPGVRLRKSSSLNVAASFTRVCLCAPISSYNSESLYCFPADGAAPRRSYSYPRASSASASGCGAGTGVSPLVAPAPAPPPPPPLPAGSRGGEGARRVFRGKSLTDDVLMRRFVVDEEATRRRNEMDVVRRRHAAASKRRRLGPSPLRRMALAESEAEAEAEEEAAAPGTGRGTDNRVAAAAVA

SEQ ID NO: 9999 - DNA, 801 bp, Zea mays
  misc_feature: Ceres CLONE 493311-R
tttttttgttgtggtttttttttgcggtgatgagtggagatataagatggcagcaagtgtatgttgtattcctttaattaggtgtgtttccaattgggtacgggaccccccctcgaggtcgacggtatcgataagcttttttttttttttttttcgtttttttcgccaagcaatggattttttcatgtttcagcaaaggtctagatgcaacaatacagacgcgatagtcactgcgcatcccgcgatagtcactgcgcatcccgcgtctgaatatttctgtcactccagcatcatcagaccactacgaacgaatgaaatctgtacaagacggaggagccacctccaatgaatgaaaccaaccgagcacggagcacggtctatcttccagacggcagcaatgagttatcggccgatccctggccgagcagggacgcaggcagaggaagccacgggcctcccggcgcggcagcctccttggcaatggcttccgcgagggggacgaggccgcccggcttgtcgtaggtgaagtgcaggtccctgttctcagccaaagccatgagctccgactcgtccagcccccgcgcaggcccgaggctgcacctctcagccccgtgcttggcgagcgcgtccttgaacttgttgaatcgttgcgttggtgcagctgaagctgctgacccgggccctcgggctccccgggtagaacctgaaagaaagggaaggaccgtggaacgccggaaggcctggtaagcacaatgggactttgtggcggttctcgttaagttccaccctggcagggaaaaa

SEQ ID NO: 10000 - DNA, 638 bp, Zea mays
  misc_feature: Ceres CLONE 493945-R
caattgggtaccgggccccccctcgaggtcgacggtatcgataagcttttttttttttttttttttttttttttttttttttttttttttttttttttttttttttttttggagaaaaaaaaaaaaagatctccctggccctaaaaaggaaaacccgctccatggtttccctgatctctacacatactagcagtatgcatacatgccctgagggatctaggggcagtttctaagggtaaacaaccatccctagcatacaagctactacagatgtttaatcccacacaacgactaatacttccctattccaagagacatttcccccagaaaaaaatggggaaacccccgggctcaaaaagggtgaaatctccaggcagccttcgaaacttcttttttggaccggggggcactgatccatgggggatgcaggggaattcactgatcgatcagcgacgtgggggaatcccccgctagctgccccgaaacctctgcgaaagaattgagggtgcccttgatcaccgcctccaagaaataggatgtctcgtccttcggggtggcctcagggacatcgaccaccaaacactctatcaccagggtggccgggcccccctcaaaggtctccggggggaaaactatta

SEQ ID NO: 10001 - DNA, 1035 bp, Zea mays
  misc_feature: Ceres CLONE 494411
  misc_feature: Encodes the peptide sequence at SEQ ID NO. 10002
atatggaccacaagcctcgcgctggtagtctggtacagacgtacagtacagtcgctgcagcgaaagggggatcgcgcgaggcgagatggagctctcgccggtggggaggtgggccgacctccccgaggacatcgccgtagccgtcgcctcctgcctccaggaggccgacgtctgcgcgctcggcggctgctcgcgctcctggcgcagagcctgcgacgctgactgcatctgggagcgcctcttccgctgccgctggccatctgccgtggcgtcggcgtcccctgtgcagggatggaaagctctctacatcagccagcacagaagaatggctgttgcaatatctaatgtggttgaatttgtgggcagcagcttaaataatgagtcacttgaatccgaatactatctgaaagctattgctgatttggccttgatacctgatataggattcctcgatgtccagtttttcttgttctcaaggaatcatagtgcgataatcaaccttattggactgcactactcgatcgcatctttgcatgtgctgccaactgaagtcagtaaagcactccaagctcaccgagtagcagaaagggtagtttgtgtgaacctggtcattaggtggttctatggtttccggttgcccgacgaatacgagtgccaccgaatctctctaggtgagctcaccgtggctgagggagcagagtttttcgccatccttaaccgtggagctgttcacacggtattccttctccggatcagtctggtgaacgtagacaagtgaccctaaagtacaaaaaggtacacacggccacacgccataattagctgcctggcttgttttgcgccctttgtaaatatgtgtaagcttttgttccctcgccccccctggtgcctcttgtttgttgcaaacgcagccgtggggatggatggatccaagtatggagccatttaagcttcggttgcgcagtaaactttataaatacgtaatgtaaaggcttgtcgtgtgtggtttgtgctgctaaaaaaaaaaaaaaaaaa

SEQ ID NO: 10002 - protein, 230 aa, Zea mays
  misc_feature: Ceres CLONE 494411
  misc_feature (7)..(54): Pfam Name: F-box Pfam Description: F-box domain
MELSPVGRWADLPEDIAVAVASCLQEADVCALGGCSRSWRRACDADCIWERLFRCRWPSAVASASPVQGWKALYISQHRRMAVAISNVVEFVGSSLNNESLESEYYLKAIADLALIPDIGFLDVQFFLFSRNHSAIINLIGLHYSIASLHVLPTEVSKALQAHRVAERVVCVNLVIRWFYGFRLPDEYECHRISLGELTVAEGAEFFAILNRGAVHTVFLLRISLVNVDK

SEQ ID NO: 10003 - DNA, 1955 bp, Zea mays
  misc_feature: Ceres CLONE 496249
  misc_feature: Encodes the peptide sequence at SEQ ID NO. 10004
aattcggaggcacgcactcggctaggcgcagaggctttctcctcccccaagccgaaacaccagagggcgagactcgagagagaagagcggcgcggcggaggacagcactggatggagccctcgccggcggcgggagagcttggcgcgatgcttcgtgcggccgctgacttcgcgtcctacccagggttgcatagtgatgatactgtgaggcagttcctggaacgatgtccgctgcctaagctcttaggtgcattgcagagtgaagcagatgtacctgggatggttgaaactgtcacagagtgtctagacaaaatattttcctcaagatatggagcgtcacttctgccaaactacggtgcatttattcaagctgggttgctcacagactcgaagcaaatcagaaaattagcctgcaaagctgtactccatcttcttgacaaggctgaagatggtgctgctgctgtggaaacagttgtgcagcataatctgtatcctcttctgatcaaatgtttgattgagggagatgaagaaatttcagcaatcgttttggacactgtaaagcgtttagcccaaattcctaaaggagctgaagtcatattcccaccagatggtcaaggatctgtgcaacttggtaaagtggcggctcagtcatcttcattggcacggattcgtattctatctttgatagccaagctcttcactgtttcaagttatactgctactgtcattcgtgattcaaaccttctgagcatatttgaagaggaaataaaagatagaagagatatgcttaaaaccctcagtgcgctggaggtcctatatgagcttgttgaacaccctcacagcaacattttcctgctgaagaccaacttgcttcaactcataattgatatcatcaatgattcctcagctgattctgttatacgatcaagggcagcatcagttagtgggaggcttctttcttcagctgatgctttcacagcaatagataaatcctgtgttaccaatctgcttgtagccatagacagaattttgaagatggaagaaagcaagaatactgatgaaattgagagtgcattggagaccttgggtctaattggtacaacaagtcaaggagcacatttcttgctgacatcatcaaatgttgccagacatgttgtcgagtcatcctttgaccgacaaggcaggggtagacagctggctgctttacatgcatttgggagcatctgtggtgttggtagacaagaagaccagatgaaactggatagcgaagccgaggaaaacttgaagcgcttggtctatacgactgcagcaaacagtccaaaattaaccccttcagctcttctactatcagttctgcaacaagacccagacgttaggatagctggctacagagtaataacaggactggtcatccgggaatggtgcttaagggaggtttgcttaaattcagagataatcagatttgttacggatccaacaatggagacaacaaaacttggcatggaaacccggtatggctgctgtgtggcaatcaacaaggccctatcatcatcccatcttctgcatgaagcaagtctttctgaactcgttgggaagttgaatgacgcggtgaaacggggcccttacctttctgataggaagcgtgtggaggcacggccggtggttgatactgcagagaggttttaaggtgccctcgagtattcacccaaagtaaatgatcagtctcacagcgtagctagtaggtaactgggcgtgccctgcgtctcatgcggttggcttatgggtaacagacatagatatgatgtacctggacgatggggaggacagtgtgtacctaaacttacaaagcaaagatgttgtttcttctattttgctttgtggatgtctgatgcagcccatacctgcgaaagaaaatcatctgttgcaggaccgtgccaagaaaaaaaaaaaaaaaa

SEQ ID NO: 10004 - protein, 524 aa, Zea mays
  misc_feature: Ceres CLONE 496249
MEPSPAAGELGAMLRAAADFASYPGLHSDDTVRQFLERCPLPKLLGALQSEADVPGMVETVTECLDKIFSSRYGASLLPNYGAFIQAGLLTDSKQIRKLACKAVLHLLDKAEDGAAAVETVVQHNLYPLLIKCLIEGDEEISAIVLDTVKRLAQIPKGAEVIFPPDGQGSVQLGKVAAQSSSLARIRILSLIAKLFTVSSYTATVIRDSNLLSIFEEEIKDRRDMLKTLSALEVLYELVEHPHSNIFLLKTNLLQLIIDIINDSSADSVIRSRAASVSGRLLSSADAFTAIDKSCVTNLLVAIDRILKMEESKNTDEIESALETLGLIGTTSQGAHFLLTSSNVARHVVESSFDRQGRGRQLAALHAFGSICGVGRQEDQMKLDSEAEENLKRLVYTTAANSPKLTPSALLLSVLQQDPDVRIAGYRVITGLVIREWCLREVCLNSEIIRFVTDPTMETTKLGMETRYGCCVAINKALSSSHLLHEASLSELVGKLNDAVKRGPYLSDRKRVEARPVVDTAERF

SEQ ID NO: 10005 - DNA, 690 bp, Zea mays
  misc_feature: Ceres CLONE 496322-R
  misc_feature: Encodes the peptide sequence at SEQ ID NO. 10006
cgaattgggtaccgggccccccctcgaggtcgacggtatcgatattttttttttttttttttccgaatcaagcaccactactagcagtagtactaaaatttcaaatcagatgtctaatttcctaaagcagatgtaatatttttcttctacacaagaagcagccttgttgtaacccatttatcttacatgaaaatttaccattctacatttctactgaacaggatcttcagcagagcagcagcaactggacggagatcgtggacgccgatgacgaccccaagaagcacagcgacggcgacgctgccaggcagagggagaagctgagggagcccgacaaggtgctgccgtgcccgcgctgtaacagcgcggacaccaagttctgctacttcaacaactacaacgcgaagcagccgcgccacttctgcaagcgctgccagcgctactggaccgcgggcggcgccatgcgcaacgtgccagtgggggccggccgccgcaagaacaagaacgccgccgcctcgcactcgcacctcctccataggacgacgacgactgccaacggcgcgatgctcagcttcgcccctcccggtcctggccttgcctgcctctgcctggacctcgccgcgcagttcggccacctggccccggtcagggacgccgccgggaccccgtctcgtccttgcacttgcagcc

SEQ ID NO: 10006 - protein, 76 aa, Zea mays
  misc_feature: Ceres CLONE 496322-R
MRNVPVGAGRRKNKNAAASHSHLLHRTTTTANGAMLSFAPPGPGLACLCLDLAAQFGHLAPVRDAAGTPSRPCTCS

SEQ ID NO: 10007 - DNA, 652 bp, Zea mays
  misc_feature: Ceres CLONE 496434-R
cgattgggtaccgggccccccctcgaggtcgacggtatcgataagcttttttttttttttttttgcacacaccaacagctttcaccaccgaagcaaatttattgactgttacaaatacattcagatttattgttgttttggaaaagcagcagacttcacaggttaccctactacatgtacaattgtgtggtcacagatcagtcagatgtgattccaagataggagaagaaggaagctagttctggtctctaaaccaccactgcaaagcaatataggatggatttcactgacacaatctgcaagctacctattgtacatatgactggtcactgagctgttgacacgatctgatcaaggaatacatttccatccgttgcacttaacgaaaccccatcagctccaatttgtcaccaatcgattggaatctgaccttaaactgatttgtgatagatgtgcaacaactcagtgacggttggtactattttttgttaggaacataaccaaataattaataaagaatccacgctgaggcgcgtatcacatagcatcaaggctgttgtttgttgcttttgatgcctctacctgagatcattactgacgctgctatatcaatagggtcttggtggataagtaccagggtaaggcgctggtg

SEQ ID NO: 10008 - DNA, 663 bp, Zea mays
  misc_feature: Ceres CLONE 496453-R
  misc_feature: Pfam Name: CG-1 Pfam Description: CG-1 domain
cgaattgggtaccgggccccccctcgaggtcgacggtatcgatattttttttttttttttttggttttttttttttttttttttttttttttttttttttttttttttttttttttttttttttttgaagggggaaaaccagttgattttccccttcaatgaacccccatacaaggaaattgaactagatacggggggggcccccaaaaaaacccagggtaaaaaattgggggccaaaggagcccggagcatctgggaaaaaaaattggatcatcccccccccgaggataaaaaacatgaacccttttttcattaacaaactttagtttttcaagggcttcttggaaaagcttgccatcttttttttttttccagttatggccctcttttccgaaattcccgaaaacttttccatcatttagaaaaacagggcccccaattggtttttccaagggctgaacaaggacccttaaccctgcataattcccccacaccccaaaaaattcatttggccggaaacagaggggcccaacccccaacaaccacttgtcaaaattcaaatccgcccaggggaagaaaccccggattcctaaaggaaaaaaggggtccccccccccggggcccccccccaagggcccggttgcggcggcctccacaggtccc

SEQ ID NO: 10009 - DNA, 1152 bp, Zea mays
  misc_feature: Ceres CLONE 496577
  misc_feature: Encodes the peptide sequence at SEQ ID NO. 10010
aaaaaaaagatggtcgtgctgccgcgccattatagccccggaatccgcggcgcgcccccgccttccgtcctctctccagccacaaatcgcgccgccccagcctcccttctccctccctccctcatcccctccgtgtcccggagcccagggagcggaggcgggcgggccggcgggcggccatggacgtggactgcgtctcgctgcccgacgccccggcgggcgacgtggatggcggcgccgcccggccgtggcccaaggccgtgaccaacggcggcgtccacgagctgctggagtgccccgtgtgcaccaactccatgttcccgccgatccaccagtgccccaatggacacacgctgtgttccacatgcaaggccagagtacacaaccgttgccctacctgcaggcaagagctgggcgacatcaggtgcctggcgctggagaaagtcgccgagtcgctggagctcccctgcaggtactactcgctggggtgccccgagatcatgccttactacagcaagataaagcacgaggcgcagtgcggcctgagaccgtacaactgcccctacgccggctccgagtgcggcgcggccggcgacatcccttccctcgtctcccacctgagggacgaccacaaggtggacatgcacagcggctgcaccttcaaccacagatacgtgaaatccaacccgcgggaggtggagaacgccacctggatgctgacggtgttccactgcttcggccactacttctgcctgcacttcgaggcgttccagctcgggatggcgcccgtgtacatggccttcctccgcttcatgggggacgagaacgaggccaagaactacagctacagcctcgaggtcggcgccaacgggaggaagatggtgtgggagggcaccccaaggagcgtccgcgacagccaccgcaaggtgagggacagccacgacggcctcatcatccagaggaacatggcgctcttcttctccggcggggaccggaaggagctcaagctcaggatcaccggacggatctggaaagagcagcagacaccagacggcgcatgtactccaaatctgtgcagctaattaagcaatcttcaaacacacaccttgcctgtcaaaaaaaaaaaaaaaaaataaaaaaaaaaaaaaaaaa

SEQ ID NO: 10010 - protein, 300 aa, Zea mays
  misc_feature: Ceres CLONE 496577
  misc_feature (81)..(280): Pfam Name: Sina Pfam Description: Seven in absentia protein family
MDVDCVSLPDAPAGDVDGGAARPWPKAVTNGGVHELLECPVCTNSMFPPIHQCPNGHTLCSTCKARVHNRCPTCRQELGDIRCLALEKVAESLELPCRYYSLGCPEIMPYYSKIKHEAQCGLRPYNCPYAGSECGAAGDIPSLVSHLRDDHKVDMHSGCTFNHRYVKSNPREVENATWMLTVFHCFGHYFCLHFEAFQLGMAPVYMAFLRFMGDENEAKNYSYSLEVGANGRKMVWEGTPRSVRDSHRKVRDSHDGLIIQRNMALFFSGGDRKELKLRITGRIWKEQQTPDGACTPNLCS

SEQ ID NO: 10011 - DNA, 740 bp, Zea mays
  misc_feature: Ceres CLONE 496648-R
  misc_feature (1)..(1): n is a, c, t, g, unknown, or other
  misc_feature (724)..(724): n is a, c, t, g, unknown, or other
  misc_feature (740)..(740): n is a, c, t, g, unknown, or other
ncgattgggtaccgggccccccctcgaggtcgacggtatcgataagcttttttttttttttttttggtttttttttttttttttttttttttttttttttttttttttttccaccccccaaccccaaagagggactcgtcacattatattgggcaaacatgtctgtgtccgttctgatcaaaagatacaaacaaagactgtcgtccccggcaaattcaagccaaagcggcaggctaaccaaccaaatgtgttcccagccaggccctcgaactggcatgtcaccagtcaccgcatcacatgcgtttcctttcaccatatccggaggtgcgccagctccggaatctgcgtggcgggtccgtcaacaagcgggggatgatcgtcttgcggccaaaaccttcccggggacgggtccaaaggatgcccggcgccgcgcggcgtcttcaacaacaacaacaacaacggcgtcaccggcgtcgtcggggtcaacggcatcaactgcgcccgcttgtagctgccgccgtccgcgtctttgttgatgacaagcgggcgggcggtggtggccttgcggagcttctcgaggcccgtctccgggcgaggcccggccaccacgtcgtcccacagcttgtccagcatcttctaattcgctcgccgctttcgacctacaaaaccaccagggatgacggatctagaccaacgtcagtagcaccgcgggcactttcgatangatgttctaggtaatn

SEQ ID NO: 10012 - DNA, 637 bp, Zea mays
  misc_feature: Ceres CLONE 497207-R
  misc_feature: Pfam Name: LRR_1 Pfam Description: Leucine Rich Repeat
  misc_feature: SWISSPROT Homolog: EC 2.7.11.1 Non-specific serine/threonine protein kinase
cgattgggtaccgggccccccctcgaggtcgacggtatcgataagcttttttttttttttttttgactgaaaacagctcagtgctacagaaggaattttcccatcacgcaaataacccttgtatactatgccatatccaccttcacctaagatgttctttgagttaaaattattagtagctgcacggagctccttaaaagcataccgctttagatgacccaaacaaacttctggatcatattgatcgttaacatcaaaaaagatctgctgatttcgcctatgacgccaccaaagaagcataccaactacaacagcgccaaaagctaccgaaccaacagttgctccacatattgtagcaatatgatggctccttccaataccttgttgtggctgagttttcagatcatctggtgggtaagagagtgggtcaagtgacacagaagagcagctatctccagatttattaccacaaatcattggatttccagctatgataaaggttcttgcagaaatcttgggtaatgggccactgagattgttaaacgaaagatctacgagagcaaaaccatcaatgctggcaattgaatcaggcagaactccagacaagctattattgttcaacttcaaataattgagg

SEQ ID NO: 10013 - DNA, 757 bp, Zea mays
  misc_feature: Ceres CLONE 497459-R
cgattggtgtaccgggccccccctcgaggtcgacggtatcgataagcttttttttttttttttttggctcacttgctcagcaattcatcattcatcgacaccacaacccccgtcgacccaaggcacgaacgacgacgaacagaggaccgaggagcatgctgctgacacgccatcggcatcgatggatgccctcgtgcccgcagcccgcctactctccatggacctccttttctggagctaggtaggatccagcgcacatgcgcgcgcgcgtgcacgtaacatgatgcttatcgggacgccgacgccaccgaggctgaacggcagggagatcggtcggcgtcggggggcaagcgccggtgtcgtcgttgtttgcccggggcgctcagcttttgggtgagcagggggcgctgaacgcgtgatggccgcgccatgtctccgtgacggtattcataggcgcaggggctgccgggcgtggggcaggccgcgagcgagaagggcagagacgccgtgcaggtgtcggaggagcacgggatgggcgcccacgtccgggacctgtccggccggaacacgcgcgcggcggaagatgccgccgtcgagagcgacgaggagtcattctacgctggcccgccgtagccgaagttgtaaccccgggcctggcgcggccgaggatgtggcgtgggggcggcacttgaaccagggaaagcccgctgccgggggtcggccaccaaaccaggaaaggccgcggcgggcgctgccc

SEQ ID NO: 10014 - DNA, 1138 bp, Zea mays
  misc_feature: Ceres CLONE 498084
  misc_feature: Encodes the peptide sequence at SEQ ID NO. 10015
ggcgactagtattaacctaccacaacaccaagtccccccccacctccgcattgtctccgccgcgatttgtcaacgtgacgtcacgccgcgcctccgagagggagccagtgtggtggaggacacgaggctgccggagccgcaggtgttgctccggtcagcatcggcatggcggggcggatggtgcggagctgcgtgcagacggcgctcaaggcggccaactccgtcgtggggctcgccggcattgccgtcatcctctacgcgctctggatgctccgcgcttggtacagggaggtcgccgacctccaacaacacctcccggtcccctggtgcatctacacatttcttggactggggatctttctgtgcctactgacttgctctgggcatattgctgccgaaactgcaaacggtcactgcctctcttgttacatgaccatcgtatttgtgcttattatgctggaaggcgcaatcactatggatgtatttttgaatagcaactgggaagaggatttccccgctgacccatcaggcaagtttgaggatttcaagcacttcgtgagatcaaatttcgagatatgtgaatgggtaggcctctcagtggtggctgctcaggtgttatcgatcattcttgggatggtactcaggacccttgggcctgaccgtgagaccgactatgacagtgatgatgacgtgaccgtgcctgcaaggctgcctcttttgataaatcagtcccagcatggttcatactatgctgaacctaacacgtctggaaggagtgattcatggaaactgcggattttagacaaggtcaacaactaagatcttaaggatctcatacaacagaccctccagtaaagactctctctccaaggggttcgggagaatgataagagtatacctttttcttcatctcatggagagatgattagcagcagcagtagaatagtttacacacatttgaatgcaatccaacatgcacaagtatttgagtagcatgtgacttgacccccccccccccctcctacaaaacctacacaatgtaggggaaggatgtttattgtaccaaaatgtttcagaaaagagataaagggcatgaacggtggtggtgccttcactgaccaaaaaaaaaaaaaaaaaa

SEQ ID NO: 10015 - protein, 217 aa, Zea mays
  misc_feature: Ceres CLONE 498084
MAGRMVRSCVQTALKAANSVVGLAGIAVILYALWMLRAWYREVADLQQHLPVPWCIYTFLGLGIFLCLLTCSGHIAAETANGHCLSCYMTIVFVLIMLEGAITMDVFLNSNWEEDFPADPSGKFEDFKHFVRSNFEICEWVGLSVVAAQVLSIILGMVLRTLGPDRETDYDSDDDVTVPARLPLLINQSQHGSYYAEPNTSGRSDSWKLRILDKVNN

SEQ ID NO: 10016 - DNA, 609 bp, Zea mays
  misc_feature: Ceres CLONE 498171-R
ccaattgggtaccgggccccccctcgaggtcgacggtatcgatatgataatgaagaccttgcaatcctggaatcatgaggttttgacagtcgtcctggcttcagtaacacaatttttgttggctcggacaaatttgaatttgccgggcaaacatctaaactctgatggcgcctgtatctgttaagtcccctttcatctccatctgaaaacagttgtctccccacaagaatgctgccttttctctttgctagttctgatggcttcagtatggttatctgcttcgcttgagaaggtggcgcgacaggttggaactcataacggttgcttgataacagaggatttggctcatcaaggaactccaagaataggtccctatttgagcttaaaaactgtagtgcatcttggaactccttcgaatgaagaagcttctcgtccgtggctagacgcttcgcttcagcaaacttctcgcggacaagcgacatcctcttctcacagcaaggctcatttccttgatgcttgctccggctgctattgattcttgaaggttggtcaccagaaccattccaagtgtgccctgccttttggttttgatggcatttgctttcctta

SEQ ID NO: 10017 - DNA, 2509 bp, Zea mays
  misc_feature: Ceres CLONE 498451
  misc_feature: Encodes the peptide sequence at SEQ ID NO. 10018
accctgtccctttccccgcgccaccgccctctccgtcgccgccgttcgaccgagcgccgctcacccaccccacgagctcccgcgcgggttcatgtccatctctccacacgaacgcaccggaggagcctattacccgcgcccgcacaaccctagccctagtccccaacatggcagcgacagacgccgccacggccgccgctcccctccggcatccgtctcgccacccggcgccgctgcggaagctagcgacggcggggtcggctcgagctccaacccagtggttccagctattggagaatctattaatgctcccgaaaaggtagttggatttataatatctggggaagagaatgatacatgtacacaagaggttggcaatgtttcagaatgccactcttcagaacagggggattccggtttgcctgtagataattttggctcagttgggtcatatcctgagagacctaaaatggtgggatcccttcaggctgaccatttggcttcaggttctactggactgggtaatgggactcagatagctgccaggaagaatcagaccgtgaatgctaatcacctactgaatttccagtatgatcctatttctcggccacagcccagaggccctagaacatatcttccgagaagacaaaggaagataaaaccttacaacaaggatctgttcatccaagcaaactataagtttgttgtattggatactgggaattaccagattgattcaatggatcctgataagatgcttcagtgggaagatattatctgtgtaagatactatagcccttctgaggtacaatgccctatttgcttggaaagaccattgtgcccacagatcacatcatgcggacacatatattgctttccatgcattttacgttatctaatgatgggcaaagatgattatagaggtgagtgttggaagaagtgtcctctgtgtttcatgatgatatcatcaaaggatttgtatacaatacaaattactcaagtccagaatgtccgtgctggtgacgttgtcacatttacacttctgagcaggtcaagaaattcgctcactccttccatcaaaagctcctccagtgaaagttctacaacagatgaagagcattataatgttttctcaaagtttattttgacatctgatgtggagttgtctgttcgagatgcaaaattggatcttagtaattggttgcatatggctgacttaggccttgttgatgacttggagaaacttccatttgtttctgctgctttggagcaactggaagagaagacgaaatattggattgattacagaaattatggtggtagtcctccatcaaaagatagcttctctcctggatctagtttcaagtctaggaactcttttgatgtgaatacttctcagcagatgagtgagcacaagatctctctttcagatagagatatggtcaatggtatttcagaactctccatgtctcccgagttgagtaaaacttctggtaaaggaacaatatctaaagtaaatgagaaatgtaccacaaccattgattcaaatgaacatgacccatacacattttaccaggtgtcagatggccaacacctaattctccatccactaaacatgagatgtcttctaaaccattttggaggttctgatatgcttccacctagaataactgccaaaatattggagctggaaactgtaacacagtctgaggctataaggaagcgctatcggtttttgagtcacttttcattaacaactacatttcagttctgtgaaattgacttgagtgatgtagtgtctcctaactcactggctccattcttggatgaaatcaagaagcgtgagaaacaaagaaaacgagccgccaagaaggaagaaagtgagagagtgaaggcggaagttgctgctgctgttcaggcatcagctatgcgatttgagtatacaaattcctctcaaagtcacaacgatgtcatgttctctctggatgactttgaagccctgggaaacaacgctgggccgtccaccagtccaccagcgagtgaaargaagcttttctctgatgtaacacacttgggttttgcatctgctcaagactcacctcccttaagactcggaactggggatgcaaatggccaaagtgaaacctcgagagaccaagggccgttagcgacacccgcattatcatttgccagcatcatatcttccagtagagccgtgactgcagctgacaactcggagatgcagaaagcaaatggcgctgggaagaagggtaagaaagcaactagagtgcttttgtcgactggtggtggccgtcgatactgaaggactatagatgcattggaacgaacagtttggttgtttccatataatgccgtagctcaatgcaatgtgcatagtacataacctggctgggatacgcttgtaagttgtaacactgagcggcagtcgtgtgtgttttgcctttcttgtgggtgtgcttgcgttgtgcccaaaaaaaaaaaaaaaaaa

SEQ ID NO: 10018 - protein, 743 aa, Zea mays
  misc_feature: Ceres CLONE 498451
  misc_feature (241)..(287): Pfam Name: zf-C3HC4 Pfam Description: Zinc finger, C3HC4 type (RING finger)
  misc_feature (652)..(652): Xaa is any aa, unknown, or other
MSISPHERTGGAYYPRPHNPSPSPQHGSDRRRHGRRSPPASVSPPGAAAEASDGGVGSSSNPVVPAIGESINAPEKVVGFIISGEENDTCTQEVGNVSECHSSEQGDSGLPVDNFGSVGSYPERPKMVGSLQADHLASGSTGLGNGTQIAARKNQTVNANHLLNFQYDPISRPQPRGPRTYLPRRQRKIKPYNKDLFIQANYKFVVLDTGNYQIDSMDPDKMLQWEDIICVRYYSPSEVQCPICLERPLCPQITSCGHIYCFPCILRYLMMGKDDYRGECWKKCPLCFMMISSKDLYTIQITQVQNVRAGDVVTFTLLSRSRNSLTPSIKSSSSESSTTDEEHYNVFSKFILTSDVELSVRDAKLDLSNWLHMADLGLVDDLEKLPFVSAALEQLEEKTKYWIDYRNYGGSPPSKDSFSPGSSFKSRNSFDVNTSQQMSEHKISLSDRDMVNGISELSMSPELSKTSGKGTISKVNEKCTTTIDSNEHDPYTFYQVSDGQHLILHPLNMRCLLNHFGGSDMLPPRITAKILELETVTQSEAIRKRYRFLSHFSLTTTFQFCEIDLSDVVSPNSLAPFLDEIKKREKQRKRAAKKEESERVKAEVAAAVQASAMRFEYTNSSQSHNDVMFSLDDFEALGNNAGPSTSPPASEXKLFSDVTHLGFASAQDSPPLRLGTGDANGQSETSRDQGPLATPALSFASIISSSRAVTAADNSEMQKANGAGKKGKKATRVLLSTGGGRRY

SEQ ID NO: 10019 - DNA, 1180 bp, Zea mays
  misc_feature: Ceres CLONE 498720
  misc_feature: Encodes the peptide sequence at SEQ ID NO. 10020
aaagcaacgactccgcgtccgcctgacctgacgtccgcctgatgaccgattatcttccttctccgtccgagtaaaggaaagcaacgactccgcgtcccgcttccctttccccgcacggcggagttcacaatccccaccggccggcgtagcggatattgcgagttacgacggggaaggagaggaagatccgtcgatccgcgcagattcgtttcgatcgtggtttggtgacttggtaagaggggaggggagaagcggcgatgtcgggcgtgttcggcagggtgttcgggaagtccaaggagcagagccaggcgaccgcgctggcctcgctcgacaagctcaacgagacacttgaaatgttggaaaagaaggaaaacttgctagtgaaaaaggccaatcttgaggtcgagaaggctaagaattttaccaaagccaagaataaaagagctgcaatacagtgcttgaagaggaaaagactatacgagcaacagattgagcagcttggaaatttccagcttaggatacatgatcagatgattatgctggaagcagcaaaagctacaacagagaccgtggatgcattgagaactggagcatcagcaatgaaagctatgcataagtcaacaaatattgatgatgttgataaaaccatggatgaaattaatgacaatatggagaacatgagacaaattcaggatctgttgtcagcgcctatgggagcagcagctgattttgatgaggatgaactagaagctgaacttgcggatcttgagggggaggagttggaggcagagctgcttgcacctaccacaacagctccgtccacagctccagtgcgtgtgcgtgtacctactgctcagcagtccactaggccatctggtcagagtagcaaagctgaagacgacgagctggcagcactacaggcagaaatggctatgtaaatataggcattggcatggtcatcttggatttcagattctgcggttatctcgcaactctggtatactcatgaggatcttcctaggaagacaagctttttcagaatcacaaacacaagctgcataccagcctaactgcttatgtatcatagcatgctatgttattgttttgtaatgaaatattttataggctaataaacatatttctattaataaattgtttcgtgacaaaaaaaaaaaaaaaa

SEQ ID NO: 10020 - protein, 226 aa, Zea mays
  misc_feature: Ceres CLONE 498720
  misc_feature (22)..(191): Pfam Name: Snf7 Pfam Description: Snf7
MSGVFGRVFGKSKEQSQATALASLDKLNETLEMLEKKENLLVKKANLEVEKAKNFTKAKNKRAAIQCLKRKRLYEQQIEQLGNFQLRIHDQMIMLEAAKATTETVDALRTGASAMKAMHKSTNIDDVDKTMDEINDNMENMRQIQDLLSAPMGAAADFDEDELEAELADLEGEELEAELLAPTTTAPSTAPVRVRVPTAQQSTRPSGQSSKAEDDELAALQAEMAM

SEQ ID NO: 10021 - DNA, 631 bp, Zea mays
  misc_feature: Ceres CLONE 498772-R
  misc_feature (588)..(588): n is a, c, t, g, unknown, or other
ccgggccccccctcgaggtcgacggtatcgataagcttttttttttttttttttgcaaaaagacactgcagcattaccatatacaacttctatatatactcagcttcagccttcagggcagggtcacggtttcacagactgagccagacgtctgtctgttgccgcgttgcatatacatatacatagctgatgaggcgagaccggatcggtgactctgtacatcacaaatatagaaccgaactggagcacggcatggcgcttgattgagccgtctgccgctcatggccggccgcagtcaccaccgtctgatgcgcgcgcgccgtgcttcacttcgtcgtcttgggcgcttcgtagacacagtcgctgaccttcttcgcctgcttctcgcagtccgtctcgagctgttcccgctctttgcccgtgccgcgctcctggtctttctccttcccccacagcagcatgtagaggcccagaatcacaaccccgcctccgacgacgctcccgacgtataggttttcgccgaagatgaagtaggccaggatggcgaccatgatggtggagagggggttgaacatggtgacgaagacngggcctttcttctccgtgcaccagagctgcacgaacaccgtga

SEQ ID NO: 10022 - DNA, 681 bp, Zea mays
  misc_feature: Ceres CLONE 499258
  misc_feature: Encodes the peptide sequence at SEQ ID NO. 10023
cgatgaagtattaacaatggaaccaaacaagattgatggttggttgaaacgcttgccattaacgtttcagtgtttagatacgggaggtttgtacctccttgatgatggcttcactttcttagtgtggttaggaaggatgctcccacctgaacttgtgaacaacattcttggagtgagcttggcaaacttccctgacctatctaagattctattgagagagtgtgacaatgagttatcaagaaatttcatgaaaatactaagatacctgcgggagaaggatccttcttatcaccagctatcccttgtggtgcgacagggtgaacagccaagagaaggctatctgcttctatctaaccttgttgaggaccagatggctggaacaagtagttacgttgattggatacagcaaattcaccgtcaaacacaaagctaatgacgagaaaccaacaggaagctatgcttgaaatttttgcctactgtaagctgctgcagggcgtagattcagttgctgccagttccaagtcaatctcgcaaccccatggcagatcttaggccctgttccaatctcgcgagataaactttagcagcttttttttagctacttttagccatttgtaatctaaacaggagagctaatggtggtaattaaagctaaactttaacaaaaaaaaaaaaaaaaaa

SEQ ID NO: 10023 - protein, 138 aa, Zea mays
  misc_feature: Ceres CLONE 499258
MEPNKIDGWLKRLPLTFQCLDTGGLYLLDDGFTFLVWLGRMLPPELVNNILGVSLANFPDLSKILLRECDNELSRNFMKILRYLREKDPSYHQLSLVVRQGEQPREGYLLLSNLVEDQMAGTSSYVDWIQQIHRQTQS

SEQ ID NO: 10024 - DNA, 655 bp, Zea mays
  misc_feature: Ceres CLONE 499697-R
  misc_feature: Encodes the peptide sequence at SEQ ID NO. 10025
  misc_feature (1)..(1): n is a, c, t, g, unknown, or other
ncaaattgggaccgggccccccctcgaggtcgacggtatcgataagcttttttttttttttttttgcaaagagtacccaaacttgttcctaagttgtctaaatgactgcggttcaccacatgcccaaaggaacattgctaagacctccttcgttgacacacctcgactagcaatgaggtcgtaatcattaactaacgaatcatgtagtcaacgaaacacgatacaacgcatgcggaacatatcgtaaccatagttgggttctctcacactaattctagatcatcttcttcaagctcatctgaaaatgaagctgcatcccttggttgacctcctagaattaaggtagttttattagtgcacacaattggcccaaacatgatccggagatccccctcgttttctagtggttgattcttgaacattagacagcctcattttgctttgcccaccagtcattcatagcacttattgatcctgtgtgaggatccctcccgaggcctgttgccctctcattcagtgtcttccattgtgtgtacatgcttttgagggtgtcccacttatttttcatttggtctctagtgtaggttcgaccaatgcgtttcttgaacttcctaatcaggttagcatatacttcgacattcagaaaatgtgttgg

SEQ ID NO: 10025 - protein, 60 aa, Zea mays
  misc_feature: Ceres CLONE 499697-R
QIGTGPPLEVDGIDKLFFFFFCKEYPNLFLSCLNDCGSPHAQRNIAKTSFVDTPRLAMRS

SEQ ID NO: 10026 - DNA, 626 bp, Zea mays
  misc_feature: Ceres CLONE 500102-R
  misc_feature: Pfam Name: SWIM Pfam Description: SWIM zinc finger
cgaattgggtaccgggccccccctcgaggtcgacggtatcgataagcttttttttttttttttttgtagctgaggccagcatgtcctcacacatcactcacgtataattataaactcctgagaaaacctgtgcgagattgaagtctccaagattttacaaggtcaagccctcagctcagtgctacaaattaatgttcacatgacaaatatatcgctcaatgtcacccgttgtcacgactttgtgtggattcatggcctgttctatagactgaaggcccaaggttcagaaccatgtacagatgaggactagatgcttggatgtattggctgcgaatatgtttctcggtacttcattacactgaagcagtcatgagcatagaagcgcgggtcttcgccacacgaaagcagcgcggcggtagcatgtgcgcatggaatgccgtagatttgccatcggcggcatgagcaggacctagcttcagtgtccacgatgtttgtccgctccgacgacacgatctcaaactccaccttgtttgctcgaaggacctggtagcactgcgagtcatggatggcttctgaaacaagtttctcagctgacggaacaagaactgagttgtatgactgtgcca

SEQ ID NO: 10027 - DNA, 655 bp, Zea mays
  misc_feature: Ceres CLONE 500168-R
  misc_feature: Encodes the peptide sequence at SEQ ID NO. 10028
tccaggtcgacggtatcgataagcttttttttttttttttttctacaaaaatagtactaggagtcttttttgccattaatcccgtgtcaccttcaccttcaccttcatcaggttaatataagttgattaacaccccggtgcgccggccagtgcaccaccccaacccataaccttttttcttcgtcacaacaagaaaacacccaacgcgacgccactgctgacactgccacagggcgcgcacgggacgcgtataccacgcacgcacaccccaaaccaaaaaactgataccagccgaattacaccatcccttgcgcggtccgtccgggcgtagtgcacgtggaagcagcgcttataggagaataatgaagcggtgcgcggccttcttcttgcgcaggccgagtgagccaagcatcttcgacaagcgggccgcagagcgtgtcgtcgggcttcatgtggtagaaggcgctctggaagacgacccgcgtgcggttggcgatgggcgtgaagtccagcacggcgcgcttgtatcctccggtgcccctggaatggtagggcaccttgaccggggcgcgccgccccgaaggcctcggcagccatggagcccccgcagccggcgagccgagtctcccacggagtaaggcgaagtctggcgggt

SEQ ID NO: 10028 - protein, 91 aa, Zea mays
  misc_feature: Ceres CLONE 500168-R
MKRCAAFFLRRPSEPSIFDKRAAERVVGLHVVEGALEDDPRAVGDGREVQHGALVSSGAPGMVGHLDRGAPPRRPRQPWSPRSRRAESPTE

SEQ ID NO: 10029 - DNA, 797 bp, Zea mays
  misc_feature: Ceres CLONE 500187-R
  misc_feature: Encodes the peptide sequence at SEQ ID NO. 10030
  misc_feature (41)..(41): n is a, c, t, g, unknown, or other
  misc_feature (46)..(46): n is a, c, t, g, unknown, or other
  misc_feature (47)..(47): n is a, c, t, g, unknown, or other
  misc_feature (49)..(49): n is a, c, t, g, unknown, or other
  misc_feature (52)..(52): n is a, c, t, g, unknown, or other
aagaccccccaaacactaacccaccaaaccacaacccaaanggggnntnggnttcgattgggtaccgggccccccctcgaggtcgacggtatcgataagcttttttttttttttttttgacgcaacaaaaacagaacaattctcaacatatataaacggaatacatacacgagtaaaaaagcatgtggatacacgatcacaccaccacgtaaaacccaaaacgtaccacgtcgaacacaaccagcacgtttattccagctgctactccacagcacaacccacatcatccacgtgtacacaaacctgacacagtaatcagagagcagccgtgctctcctcttgcgtatcacttcagatggcattcgtgttcagcttcgcgccgccgatctcctccccgcggatcacgggcgcctccgccggatacgctttcttcacgtcttcccctgtggctgtggttggctgtacggtatcggagacccggttcccgccggtgagcgacgcgacggcctggacgggggccgggacgcgctggactaccgtgtccccggcgtcgtccttgcggccgctgccggggccgggaatggcctcgggtagggcggggacctcgttcacccggaccggagcttcccggccatgtacccccgtgaaggtaaacccccttggtcctggttgaccggcacccggggaggagacatagacgacggtaacaccttgtccccgcttcaaacacgaaaacccgggacagtcacccttgccctaccgaactaaggatggccctgaaagaaaccttgacccct

SEQ ID NO: 10030 - protein, 105 aa, Zea mays
  misc_feature: Ceres CLONE 500187-R
MAFVFSFAPPISSPRITGASAGYAFFTSSPVAVVGCTVSETRFPPVSDATAWTGAGTRWTTVSPASSLRPLPGPGMASGRAGTSFTRTGASRPCTPVKVNPLGPG

SEQ ID NO: 10031 - DNA, 863 bp, Zea mays
  misc_feature: Ceres CLONE 500187-R2
  misc_feature: Encodes the peptide sequence at SEQ ID NO. 10032
  misc_feature (857)..(857): n is a, c, t, g, unknown, or other
aaattgggtaccgggccccccctcgaggtcgacggtatcgataagcttttttttttttttttttgacgcaacaaaaacagaacaattctcaacatatataaacggaatacatacacgagtaaaaaagcatgtggatacacgatcacaccaccacgtaaaacccaaaacgtaccacgtcgaacacaaccagcacgtttattccagctgctactccacagcacaacccacatcatccacgtgtacacaaacctgacacagtaatcagagagcagccgtgctctcctcttgcgtatcacttcagatggcattcgtgttcagcttcgcgccgccgatctcctccccgcggatcacgggcgcctccgccgcatacccttccttcacgtcttcccctgtggctgtggttggctgtacggtctcggagacccggttcccgccggtgagcgacgcgacaggcctgggccgggcgccggcacgcgctgcactaccgtgtccccggcgtcgtccttgcgccgctgcacggcgccggagatcgcctcgctcagcgcgcggtcctcgtcgcccggccggagcttctcggcgatgtaccccgtgacggtcacccccttgtcctgctcgccggcgccgggggtggccgtggcggcggcacccgtgtcccgctgcgcgccgaacccgggcgtcgccgtgccggccgactgcgtggcctgctgaaccttgcccgccacggctgtgccgacgctggcgaacttctcgtacacggtgctcgccagctgcttgccgtaactccgttgtgccggcagccgcggaactgatcttgtccgtaagcccggccttcgactcggtgttggcctccctcacantggcgg

SEQ ID NO: 10032 - protein, 42 aa, Zea mays
  misc_feature: Ceres CLONE 500187-R2
MYPVTVTPLSCSPAPGVAVAAAPVSRCAPNPGVAVPADCVAC

SEQ ID NO: 10033 - DNA, 656 bp, Zea mays
  misc_feature: Ceres CLONE 500685-R
  misc_feature (656)..(656): n is a, c, t, g, unknown, or other
cgattgggtaccgggccccccctcgaggtcgacggtatcgatattttttttttttttttttcagagcaaaggaagtgcatattaaaattctgccagttgcttatatgttacattttacaggagacgggctaataattaagctgctaaggtcatagctaggtagtcaccacacaactcatacagcagatgaaccttcctgggttaagctaatcaaaggcggcaggcagctttgcacatggatgcctgcctgtgcctctcaaacccatatgcgtctgtctgatatatcgaacacaatcagcaggttgccggccagagttcacatctggggccgggagctgagctgagacgatggggtaatgtatgtagatcgtcgaggagggttattactcctagagtagtgcaacaattaataaactaactaactaactataattaaattaaacacgcttagcgatctgcaacgatctgttgttgtcgtcgtctgttactgctttcgcccccttgggcgcgccgccggcgatggtgatcgcagtggcttccactgccccagacggaccaagaactccatgacctcagtgggatcttggagagagtaggtggcatcagtctccttggggcatttcgaaacaaggatccctatcccttgacctctctcn

SEQ ID NO: 10034 - DNA, 1158 bp, Zea mays
  misc_feature: Ceres CLONE 500780
  misc_feature: Encodes the peptide sequence at SEQ ID NO. 10035
aaataaagagttaaaaataaatagtttctcgtagaaattctaagtcggacaacaaacaagcaggagagaagaatcagtgatctgtgctgtgagtacctgacctcttccagacagcctctgaaatccccttcgacccttcctgctccagcgggagcgcaccagcaatgtcgtcggcggggccaccgccgccgctgccgccgtggagcaggctggaggggcaggtggtgctggtgacgggcgcttcctccggcatcggacgcgacttctgcctcgacctggcgcgcgccggctgccgcgtcgtcgccgccgcccgccgcgccgatcgtctccgctcgctctgcgacgagatcaacccctccgctgcctcccgagccccccgcgcggtggctgtggaggtcgacgtcgccgccggtggttcggccctggaggcggcggtgcagaaggcctgggacgcctttggccgtatcgacgccttggtcaacaacgccggcatacgaggtgcagtgcattctccattagattggcccgaggatgagtgggacagaatcatcaagacgaaccttaccggatcatggctcgtggccaaacatgtctgtcgacgcatgcgtgatgccaagctgaagggttcagtggttaacatcacctctattgctggccttaaccgtgggcatctgcctggctccacgggatacgcatcctcaaaggctgctgtgcattatgccaccaagattatggctttggaattgggcgcggatcgcatcagagtgaactcgattgcacctggactcttcaaatcagagataactgctcctctgtttcaaaagaggtggttgagcaccgttgcttcaaagatagtgccgcttaaggagcatggcgctactgatcctgcattgacgtcgctggtccgttttctgatccatgaagcatcgtcgtatgtgactggcaacatcttcattgtagactcaggtgccaccatacctggtgttccgatattctcatccctgtaatccccccccccttaaggtttagttcattgtaccttagtttcatatggttgcataaagcagacagttaaagactccatggaggaagcactgctggctgtatagttcattcccgacaatattccatcatttttgctgaaaaaaaaaaaaaaaa

SEQ ID NO: 10035 - protein, 280 aa, Zea mays
  misc_feature: Ceres CLONE 500780
  misc_feature (19)..(195): Pfam Name: adh_short Pfam Description: short chain dehydrogenase
  misc_feature: SWISSPROT Homolog: EC 1.1.1.100 3-oxoacyl-[acyl-carrier-protein] reductase
MSSAGPPPPLPPWSRLEGQVVLVTGASSGIGRDFCLDLARAGCRVVAAARRADRLRSLCDEINPSAASRAPRAVAVEVDVAAGGSALEAAVQKAWDAFGRIDALVNNAGIRGAVHSPLDWPEDEWDRIIKTNLTGSWLVAKHVCRRMRDAKLKGSVVNITSIAGLNRGHLPGSTGYASSKAAVHYATKIMALELGADRIRVNSIAPGLFKSEITAPLFQKRWLSTVASKIVPLKEHGATDPALTSLVRFLIHEASSYVTGNIFIVDSGATIPGVPIFSSL

SEQ ID NO: 10036 - DNA, 878 bp, Zea mays
  misc_feature: Ceres CLONE 500982-R
  misc_feature: Encodes the peptide sequence at SEQ ID NO. 10037
attgggtaccgggccccccctcgaggtcgacggtatcgataagcttttttttttttttttttcgcacaacacataccgaacattgcatttagacacagcggatttattaagattcaacgcttgcccctcatcttcttgtaacataacataacaaatagactgaaatcttatacatgagccggaatcatatgcaaaaaaacaaacctatatacagaggggagaaccatggtggtgataggatcaagtcctactggtcatccagcttccacacctcatggagaagcctatacctcgctgtggtcgagttgctgatccgcttcagcttcgcaagcgggtctgatgaggtgttggagatgaaggtaagtggggagctcagctcatcaagctcgtcatcgctcgtgttggacttgtgaaggatggcggacccgctcttcctaggatcaccgatgacgcttagtattgccccagatacaggggcattgtacaaaattggcgatgcgctgcacgggatcgaccgtatgcccttgttaacctccaggtggtcctccaactctagtgcttgaagtaaagaaccttgaatggaatctggacaaaattcatctggtaaaaagacatccaggatgttcttgatgattgatgagctaaaggtagggcaaagctctttcctgctactggaatccatgagcacatccttgggaagcattaggagatcactcagtgcattcaagtgaatagaatggctttacagattcaccaaaagccattttcaccactttcattgtcaaattccttgaaaatcgtccaatatccctgccaaaccagtcagtaaaaaaatctaaaacccccttgcaaaaacatttttttaggttggaacccct

SEQ ID NO: 10037 - protein, 79 aa, Zea mays
  misc_feature: Ceres CLONE 500982-R
MSRNHMQKNKPIYRGENHGGDRIKSYWSSSFHTSWRSLYLAVVELLIRFSFASGSDEVLEMKVSGELSSSSSSSLVLDL

SEQ ID NO: 10038 - DNA, 858 bp, Zea mays
  misc_feature: Ceres CLONE 500982-R2
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
nnnccaagnnnggggaactttgttttttgcaggcggagtgtatatgaatccatgggtggcccgtgatcttctggtaccttgccataacaaatggactgaaatcttatacttgagccggaatcttatgcaaaaaaacaaacctatatacagaggggagaaccatggtggtgataggatcaagtcctactggtcatccagcttccacacctcatggagaagcctatacctcgctgtggtcaagttgctgatccgcttcagcttcgcaagcgggtctaataaggtgttgaagataaaggtaagtggggagctcagctcatcaagctcgtcatcgctcgtgttgaacttgtgaaggatggcggacccgctcttcttaggatcaccgatgacgctaagtattgccccaaatacaggggcattgtacaaaattggcaatgccctgcacgggatcaaccgaatgccccttgtaaacctccaggtggtccttcaacttcaagggcttgaaattaaaaaaaccttggatgggaatctgggaacaaaatttattttgggaaaaaaaaaatttccggaaaggttctttggaggaattggaagagcccaaagggttgggggaaaaaactccttttccccggcacggggggaaccccagtaaacccaattccttgggggaaaactttttgggagaaatccccctcgggggggttttttcgggggaaaaaaaaaagggggttttttttaaaaaattctcccccaaaaccgctttttttttttccccccccctcttttttttttgtagaaaaatttttttttaaaaagaagcggtccacatatatttatgggttgtgtgtaaaaaaaaaaaaa

SEQ ID NO: 10039 - DNA, 1129 bp, Zea mays
  misc_feature: Ceres CLONE 501863-R
  misc_feature (29)..(29): n is a, c, t, g, unknown, or other
  misc_feature (31)..(31): n is a, c, t, g, unknown, or other
  misc_feature (37)..(37): n is a, c, t, g, unknown, or other
  misc_feature (38)..(38): n is a, c, t, g, unknown, or other
  misc_feature (40)..(40): n is a, c, t, g, unknown, or other
  misc_feature (56)..(56): n is a, c, t, g, unknown, or other
  misc_feature (1050)..(1050): n is a, c, t, g, unknown, or other
  misc_feature (1129)..(1129): n is a, c, t, g, unknown, or other
cttcacctctccccccgccccccccaccnanagcaanntntttgcgattgggtacngggccccccctcgaggtcgacggtatcgataagctttttttttttttattttccatttggaaacaggcctagcagtggacatggggtcacacgaaccctgtcccatatccgtacaccgtgccatcaacgtccaacagcgctagagcagcatcatgcatgtagctagatacagaagctattaatgggtagcagaatcaacgagggggaaggaaagaaaataataactagtggccaccccaagtgactattccagggcaggaaatcctccagctcctccggacgctcaaaactgctcagacctttttcccaccccgccagaccacgatgcagggaccatggatgacgaggcccgctgtctactagctcccccctccgccactggcttttcccccacactatgggcaaccatgcccgtcctcgcgtttttccctatgtcttccaatcctccgcccccttacttggtccccccaccacctttcactgctccctcttcctcggctccaaatcagttcaacgatccacccgacctggtgcccaccttttgatccctgcgacctatccccccccctccctatatgttcctctccctgggcacctcttctgtacgaacgcctgtaataccgttacggctatctttacatctacattctctctccaccttcattgcaccatccttccaggtttcgcgatgatacctcactatacaccccgcctcttataccccagtaatattctgcctcccctcactccattgtctatgtttgttcctactttcccctctcccctcctccccaactcactctttcagccccatcttatactctcattctcctcccttcctgtccctcatatctgagaccctcctctaatttcggagttcaccatttctccacatctcgggtctcatgcatgtttctatcgcaccgcgctttcatcggcaccacgtttctccttcgtctctctcacccccttgcactcacttcgctctcacaantcatattaaccacccgtggacatattcttcttattatcacaatagctctaccccactaccgtgggattcactctcttcn

SEQ ID NO: 10040 - DNA, 661 bp, Zea mays
  misc_feature: Ceres CLONE 503005-R
ccaattgggtaccgggccccccctcgaggtcgacggcatcgatttttttttttttttttttgctgtactagccaagcatgcatgtgctttatactactcccataggatccggtgcacggtgcagggttctttccagagtatcacttgcatggaacttccatattagcgccaaaacattgccataccatggctcgcaattattatgagacgaaagcaaggcacgacattgatgtacatagccgacaaaaacaactcacaggtcacatcctcctcgttgcttcgatgttgttttattggtgtgaagtgcctgcttctttcctctgccactgctgcctagctggctggccctggccgtgaggctgtcgtcttgatgcattaactctgtttctccttcgatggcctggattcttcggcttgttgctgctggcgttgcttgcctggccacgttgctcactttctgaggtcgaagtagccgtgccttggctgggatcagcattctcttcttcagctgtgtctggcgtgctgggaggaaccgaaacgtacattcctggttgtatggcaaggtctttctttggttcaatcaggccgtttagttcttgctgcacattaacaagtgactcgattctttttctcctgttttgctcagcctcggaatggaaca

SEQ ID NO: 10041 - DNA, 594 bp, Zea mays
  misc_feature: Ceres CLONE 503202-R
  misc_feature (394)..(394): n is a, c, t, g, unknown, or other
  misc_feature (431)..(431): n is a, c, t, g, unknown, or other
ccgattgggtaccgggccccccctcgaggtcgacggtatcgataagctttttttttttttttttgagcactaaatcataaatggaatgatgtttactacaaattcttacctctgatgtgagctaattatgggcaatgctgtcaatctgaaactatggctaaaaataaactaatgatattgcaggcatcatatcatgccacttttctagcatcgagacaggtcaatatccaagagtatgtgaatccatcattaccgaatactagccaaaatgtaaagcattgctcttatcagtgtgctaaaacaaccatatccatcaaccaaacaaatgtaaagcattgctcttagcagcaactaggcatttgaacgtcaaatcccagatcggccaaccccctancccctaaatttaatcccgttaactggaaaaatggagnaggggcaccacgacccatagcagctaattccgagctgacctttttgttccagcttcttccgaaaaaattaaaaagttcccttggcaaaactggccaataactggcacgggaaaaaagggggttacgccggttcccctttttgggcccggggtttttggcccaa

SEQ ID NO: 10042 - DNA, 961 bp, Zea mays
  misc_feature: Ceres CLONE 503308
  misc_feature: Encodes the peptide sequence at SEQ ID NO. 10043
acgaaggaccttagcagagctcaagtacctgcgccggccagctatagacaagaggcggcttggagaggcaggcaccatcatccatggcgccctccggtgacaccattgccctcgtccacagcggcatggacagcagcaacaagacgctgctcaagagcgaggccctctacaagtatgtcctcgacacgtcggtgctgccgcacgagccagagtgcatgcgtgagctgcgcctcgtgaccgacaagcacgagtgggggttcatgcagtcgtcgcccgacgaggcgcagctgctgcggatgctcatcaagctcaccggcgcgcgccgcaccctggaggtgggcgtgtacacgggctactcgctgctggccacggcgctggcgctccccgacgacggcaaggtcatcgccttcgacgtgaaccgcgactactacgacatcggccgccccttcatcgagcgcgccggcgtggcgggcaaggtcgacttccgcgagggccccgcgctgggcaacctggacgagctcctcgccgacgaggccaacctcggcgccttcgacttcgccttcgtcgacgccgacaagcccaactacgtcaattaccacgagcagctgctccgcctggtgcgcgtcggcggcaccatcgtgtacgacaacacgctctggtgcgggaccgtggccatgccgccggagacgcccatgtcggacatcgacaggaggttctcggccgccatcagggacctcaacgttcgcctctccgcggacgagcgcgttgaggtctgccagctcgccatcgccgacggcgtcaccatctgccgccgcctcgtctgatggagtcagtgcgtgcccagggcatgcatgcatggctcgcgtgtggatattccgtcgaccagttctccatccgatccgtttgttgttgcatgatgctttcaataaagatctgttttccttccaaaaaaaaaaaaaaa

SEQ ID NO: 10043 - protein, 246 aa, Zea mays
  misc_feature: Ceres CLONE 503308
  misc_feature (33)..(245): Pfam Name: Methyltransf_3 Pfam Description: O-methyltransferase
  misc_feature: SWISSPROT Homolog: EC 2.1.1.104 Caffeoyl-CoA O-methyltransferase
MAPSGDTIALVHSGMDSSNKTLLKSEALYKYVLDTSVLPHEPECMRELRLVTDKHEWGFMQSSPDEAQLLRMLIKLTGARRTLEVGVYTGYSLLATALALPDDGKVIAFDVNRDYYDIGRPFIERAGVAGKVDFREGPALGNLDELLADEANLGAFDFAFVDADKPNYVNYHEQLLRLVRVGGTIVYDNTLWCGTVAMPPETPMSDIDRRFSAAIRDLNVRLSADERVEVCQLAIADGVTICRRLV

SEQ ID NO: 10044 - DNA, 1443 bp, Zea mays
  misc_feature: Ceres CLONE 503410
  misc_feature: Encodes the peptide sequence at SEQ ID NO. 10045
agcattgcggtggagagggaagcaagaggtatcggagatagagagagaaagggcgaaaaacagaagggaacagcaacggagcagctgatcaggggctgacgcgcgcgacaatgctgctcaggagggtggcggcggacgacggctctggcgccggcgccggcgtagggaggccacggctcttcgccatgccaaggctgctggtcgggctcgaggcgcccaggtgcggcgcaccagactgcgactcgccgatggcggcgcgcagcccgacgtcgccgctcgatctcaggcccttcgcctctctgctccgctcgccgcgctcacccagaaccaggagctgggattcgcaccgccttggcctcggcggcctcgtcgacgacacgctcgccgaacccgccgcatgcgccaggagccgcctgctcggcctcgggccccaggcgcggcagccgttcaagctgccgcaacgcctcgtcaagcccctggccacccagccgagggactgctcccacgcatcctcggagctcgggaatgtggggaccgctgccggctgcaagccgctgccgtgcagcaggtcctacggggatgtgaagtctggtccagaggtcaccgtgcccggcggcgctccgcccggcacgagcagccaccttgccgatgtcggcaagttccccgcgccggggtccctgccggtgtccatcggcggcccgcgctggtacatcgggtccgtgtccgcgacggaggtggagcagtccgaggactacacctgcatcatcgcgcacggtcctaacccgaagaccactcgcatcttcggggactgcatcttggagccctgcactcctagtgtgtctgacggtgacggcatggatgccatggaagtcaaggaaggagcagagtcctactggttggtcaaatgcttcgatgctagcgagcctggagagttcttagactcctgcatctcttgctagaagaagctggatggcaatgacccctgcgtttatcgtggtgagagggcattctgccgtgggaactggaggaatcaggaagtccttgctgagcaggaagacaacattccagctgtgtccttcagctcggctggctcatcatcttccttcaacgatgaagtagtcatggctgaaatggttgtggtggctgcaccagttgacgtcaactaccctgaatctggcaaaccagggtagctgatcaataatgtcaattgtcgcagttttcatcttcgccgccatcattattttgctggttttgtaagttaagttccagcatttggtagcattgatcattttatgagaattgaggctccatctagaatttgctgagatgtgatctctcagcctttagaacggagagcttccatgccttaagcattgtaattttgaaccgaggctattggcaatgcaggttccccaattttcatccaaaaaaaaaaaaaaaaaa

SEQ ID NO: 10045 - protein, 282 aa, Zea mays
  misc_feature: Ceres CLONE 503410
MLLRRVAADDGSGAGAGVGRPRLFAMPRLLVGLEAPRCGAPDCDSPMAARSPTSPLDLRPFASLLRSPRSPRTRSWDSHRLGLGGLVDDTLAEPAACARSRLLGLGPQARQPFKLPQRLVKPLATQPRDCSHASSELGNVGTAAGCKPLPCSRSYGDVKSGPEVTVPGGAPPGTSSHLADVGKFPAPGSLPVSIGGPRWYIGSVSATEVEQSEDYTCIIAHGPNPKTTRIFGDCILEPCTPSVSDGDGMDAMEVKEGAESYWLVKCFDASEPGEFLDSCISC

SEQ ID NO: 10046 - DNA, 623 bp, Zea mays
  misc_feature: Ceres CLONE 503784-R
  misc_feature: Encodes the peptide sequence at SEQ ID NO. 10047
cgattgggtaccgggccccccctcgaggtcgacggtcccgataagcttttttttttttttttttggtcctaaacatggtttcccacaaccaacgacactcaacagtcaacatactacaagaaaacagtgcagcccaggagacagtggctaacattcagacccaggggcatgcaacagaacccaaatcagccgtcgctagtagctgtgaaggcgatgaggacacaagacaaggtgaagatgatcgttcctgcggcgaaggccaggatcgccctctgcgagaagccctgcctctcctggccggctagctccacctccttcagcagggctctgatctcatcgatgtcgctggccttggggggggggaccaggctgctctggacctcctcgagcttgggtagccgtgtagctcggggcagggctctgggggggccagatgaaccccggcatcctccacaggaggacgccgacggagatcgcggggacgcaggccacgctgtaaggggggcggtcgcgtacctccctctgcgggctgtggaggacgaggaggcatatcgcgacagagatccagcccccgtatgcgtccgccccggcattgcacggaggacaggaacaaaggtatgggc

SEQ ID NO: 10047 - protein, 151 aa, Zea mays
  misc_feature: Ceres CLONE 503784-R
MQQNPNQPSLVAVKAMRTQDKVKMIVPAAKARIALCEKPCLSWPASSTSFSRALISSMSLALGGGTRLLWTSSSLGSRVARGRALGGPDEPRHPPQEDADGDRGDAGHAVRGAVAYLPLRAVEDEEAYRDRDPAPVCVRPGIARRTGTKVW

SEQ ID NO: 10048 - DNA, 666 bp, Zea mays
  misc_feature: Ceres CLONE 503816-R
  misc_feature (666)..(666): n is a, c, t, g, unknown, or other
cgattgggtaccgggccccccctcgaggtcgacggtatcgataagcttttttttttttttttttagtatagaaataacattgttttgagatataagctgcataaaggagctaatcctagaacattcctaattcaatcatatggtgtcctaggatccaaacctacaactgtgagaaactgagaataaagatgtgacttctggtacaagtatcggactgacccaatagcggaggctcccatatataagtaaggtttgggaaagggataaagcaaagcaagccttcccccctcgaatgcggagaggctgcttcaaacatgtgacctagtgactcagtgagacaactctcaccactaaaccagtcctgatctttgacttctggtataagcattattttgtctagtttgcagggctgctacttcacttctcagatggcttcacatttgaagatgagacactgactttttcaattctttaattctctttagctactgagctgaaacaaacagcaactttccactgaatttaaattgtagttgcatgtgcaatgagctgatctgagtttcaacaaaatagatgcaccgactttagcttgtctcctgatcagtaaatccacactccaattatactgccagcatgttgtctgagttggagcacggtcggccaatn

SEQ ID NO: 10049 - DNA, 598 bp, Zea mays
  misc_feature: Ceres CLONE 504165-R
  misc_feature (598)..(598): n is a, c, t, g, unknown, or other
cgattgggtaccgggccccccctcgaggtcgacggtatcgatattttttttttttttttttcttttttttttttttttttttttttttttttttaccagattctgtcgcgcataataaaatttgctagctcaacccagaaggaatacatatattataaaaagaatgacaaataaacggtattattatataaaaaaaatcatgatcctctcttatacaggcaaaagagaggcaccctagaacaaacagaacgaacataaatatccccctctcctctctctctgggatccaaatcgcaggattcgtccctccatctcccgcgatgcgcagcacgatccccacgccctcagatcacgaggaaggcgacgaaagaaaccaaagcggggacggcccacgcccccgggttggcgccaggcagccccgcggcaccgccaacggccggggcgggggctgggcccaggcttcccagaagtgcggcctcctccagcttcctgctgggtgccggggacgcgaccaacgccaggagcaccgcggcgaggaggaacccaacggtcttggtcgaggaggccatggagacaaaccaccagaaggagctctctn

SEQ ID NO: 10050 - DNA, 795 bp, Zea mays
  misc_feature: Ceres CLONE 504171-R
  misc_feature (61)..(61): n is a, c, t, g, unknown, or other
  misc_feature (795)..(795): n is a, c, t, g, unknown, or other
gcgggatttgataagtattaaaacctcactccgtcacagtatcgcgaaacaaaaatgaaantcaaatgggtaccgggccccccctcgaggtcgacggtatcgataagcttttttttttttttttttgacacctgactagcaacttgccatacagcattggctgatgagctgccatgagggaatacaaacaccaaaatacgtaatgtaatggatcaatagaaactctgcagagcatattttgttacaaacttttgacttgcttctattttcaaacagggagatggattatagtctgttaactgcctcaactaggttacaaggccaaaactgccaccatgatgaatggctttctacgtaaagcgatgttgaatgtataaatcaaacttcaaacatgtagtcaaccacagcttgtaaactggggtgatccctaaccatattgaaccctttgtctcatgacccacagcagtttgtttggcataaccaacagacgggaacggtctcacacagtgtaccactataacacagaacaattgtgcaaaaaaatttttcgtgcaatcatctccgaatagcatagctatatagcgattcatcactcccgtacatttcgtgaaaggagtaattttggggacatgtcaccacttaaaaacctaccctaacgcaatacttcttcttttataatcgtccgatatctcataagacacaacaagcctccaattcagacgaaacaggctccagcccaaagaaaacaatgtggtcccgctcccagtcacacatacacagttgggtactcagctn

SEQ ID NO: 10051 - DNA, 824 bp, Zea mays
  misc_feature: Ceres CLONE 504659
  misc_feature: Encodes the peptide sequence at SEQ ID NO. 10052
aatcctcctctctttactttgttcgtgagtgccgccgacgacgacggaggaaaagctaggggagctagcgagtgagcccagacatcctcctctaagattagcttttagctagcactagctagctcgatcatctgtcggtcggtccggcgcgcgcgagaccatggcgtccatcatcgtcatcgccgtcgtgctcgtcctggacgtcctcgccttcgtgctcgccatcggcgccgagcggcgccggagctacgccaacgtgaccgccgccgactcgtccgggcgtgcctactgcgtgtacagctccgacgcgtccacggcgtacggcgtgagcgcgctgctgctgctgctcgccgcgcaggccgtggccatggccgccacccgctgcttctgctgcggccgcggtctctcgccgggccgctggcgggcatggtctggcacctgcttcatcatctgctgggtgacgttcgtgatcgcggagctgtgcctgctggcggggtcggtccggaacgcctaccacaccaagtacgtctcgctgttcagcaacgccccgccccggtgcgccgtgctgcggaggggagtcttcgccgccggcgccgccttcgccttgctcaccgcgctcctggccgagctgcactacctcttctacgccagggcgcgcgccgccgccgccgtgcccccgcccatcgtcggcggcatcggcatgacccgcatgtgatgtgactctgtattttgtggcatctgccccgccggcgcttggctgcgtgctttgtaccgtgtgttcatgccttccacggggcctttttggcaaaaaaaaaaaaaaaaaa

SEQ ID NO: 10052 - protein, 184 aa, Zea mays
  misc_feature: Ceres CLONE 504659
  misc_feature (44)..(159): Pfam Name: DUF1218 Pfam Description: Protein of unknown function (DUF1218)
MASIIVIAVVLVLDVLAFVLAIGAERRRSYANVTAADSSGRAYCVYSSDASTAYGVSALLLLLAAQAVAMAATRCFCCGRGLSPGRWRAWSGTCFIICWVTFVIAELCLLAGSVRNAYHTKYVSLFSNAPPRCAVLRRGVFAAGAAFALLTALLAELHYLFYARARAAAAVPPPIVGGIGMTRM

SEQ ID NO: 10053 - DNA, 987 bp, Zea mays
  misc_feature: Ceres CLONE 504661
  misc_feature: Encodes the peptide sequence at SEQ ID NO. 10054
agaggctcgcacggtgtcgctggctcctctccccttccctcccgactgttacatccagcgagctgttcacggccgtgccgagctcagtgaggtagcgtttgcgagtccgggacgaggggagcggcgggcgacatggggaggggccgcagcgagataaagcggatcgagaaccccacgcagcggcagtccaccttctacaagcgcagggacggcctcttcaagaaggctagggagctctccgttctgtgcgacgtggacctgctgctgctcctcttctccacctccggcaagctctaccactacctctcgcccaccgtcccctccgtcaaggacctggtcgagaggtacgaggccacgacgcacaccaaggagcggcgcgcggagctggagaaggcggagcagatgtgcgagctgatggagaaggagctgcgggtcatgacggtggacgacggggagcagtacacggtgccgtcgctggagctgctggagcacagcctggaggcggccgtgcgcaaggtgcgctccgagaaggaccgcaagatcggcggcgagatcaactacctcgagaacattatcagaggacgccacgaggagcgctacgggttgtgcaacaagcttgcgcactctcaggcatcgaacaacgagggaggaggagggtcgaccccaccaagcagcggcctggaactcaaactgggtctcaactgacgctggctggctggaaagctcgaggactatgctctgttccttgggtactgtactctgtaggttttggttgagtggttgttgtcagcagttgtccttagatcaaacaagtctcgagtttgatgtgttaatgtactccattattcaggtgggatcaagtacctttgctgctccgattgaagtatattgtttttgttggccgcagaaaaaaaaaaaaaaaaaaaaaaaaaaaaaaaaaaaaaaaaaaaaaaaaaaaaaaaaaaaaaaacaaaaaaaaaaaaaaaa

SEQ ID NO: 10054 - protein, 190 aa, Zea mays
  misc_feature: Ceres CLONE 504661
  misc_feature (9)..(59): Pfam Name: SRF-TF Pfam Description: SRF-type transcription factor (DNA-binding and dimerisation domain)
MGRGRSEIKRIENPTQRQSTFYKRRDGLFKKARELSVLCDVDLLLLLFSTSGKLYHYLSPTVPSVKDLVERYEATTHTKERRAELEKAEQMCELMEKELRVMTVDDGEQYTVPSLELLEHSLEAAVRKVRSEKDRKIGGEINYLENIIRGRHEERYGLCNKLAHSQASNNEGGGGSTPPSSGLELKLGLN

SEQ ID NO: 10055 - DNA, 668 bp, Zea mays
  misc_feature: Ceres CLONE 504916-R
  misc_feature: Pfam Name: PRMT5 Pfam Description: PRMT5 arginine-N-methyltransferase
  misc_feature: SWISSPROT Homolog: EC 2.1.1.125 Histone-arginine N-methyltransferase
acgattgggtaccgggccccccctcgaggtcgacggtatcgataccaaattgtccattagaggctgcagaggagactgcaaaaagtccctgtaattaatctcaatgcgttcctgctcaggaagcggatccatcttctgatataggtacgcaatgtattcaaggtaaggagttaatgcatgtcgaacacgggaatcttctgcgtagctctcatcacctgagagcactcattcagatactgggaaaacattgtgatttgatcttccatatattatcacctaaataggacaaaaaagaactcaagaacaatgtccaccacaattacctcaattgaagcacaaaattgaatatatattaaaaaaacaagttaaaagaagcatacaacattggatcattgactctgaagatatgaaaatacaaaggttgactaagcgtaagcataaaagcaataaaaataacaaacatgaacagaatgtttaaaaaatccagttagcagactctgatggcgctttgataaacaaggatatccttttgcatttgtaagaaaagcctcggtttgcagaatagcagcccttacaggctctccaaaccaccttgctaatgagtttattgatggcagagtgctcgttcagccatgcggactaccatcccaggacaatggctatcaacg

SEQ ID NO: 10056 - DNA, 667 bp, Zea mays
  misc_feature: Ceres CLONE 504988-R
caattgggtaccgggccccccctcgaggtcgacggtatcgataagcttttttttttttttttttggtttctagggactaatatttagtccttcattttattcctttttagtatataaattgttaaatatagaaactaaaataaagttttagtttctatatttgataattttggaactaaaatggaataaaatgtagggactaaacattagtcactagaaacaaacatccccttaaacggtgcctagcatctggtgtctacatcttagagcaagccagagtcaatgagaggcatagatagaacaggagtagaacaaaagctgcagtgcaggatctgcatgtgagcaatggatcagcgacctcgcccctcagaaccatgggaaccgatggacaggagtcaactccagcagcacgtccgcggaagccctcggccagacacggagctccctccgggccgcctcgagcttggcttcatgctccggcctgacctgcgagtggtggtacacgacgctcatcctcttgaggaccctcgcgttcatcaccaggaacttgcagatgccctcgcaagggtggccttccaggagcgagtcggtgtagaatgtgacgctcgccaggtggtacagaaacccctccgcggttatcttcttcctccagaactccgcagccaaa

SEQ ID NO: 10057 - DNA, 719 bp, Zea mays
  misc_feature: Ceres CLONE 505009-R
  misc_feature (1)..(1): n is a, c, t, g, unknown, or other
  misc_feature (6)..(6): n is a, c, t, g, unknown, or other
  misc_feature (11)..(11): n is a, c, t, g, unknown, or other
  misc_feature (12)..(12): n is a, c, t, g, unknown, or other
  misc_feature (18)..(18): n is a, c, t, g, unknown, or other
  misc_feature (19)..(19): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (32)..(32): n is a, c, t, g, unknown, or other
  misc_feature (37)..(37): n is a, c, t, g, unknown, or other
  misc_feature (55)..(55): n is a, c, t, g, unknown, or other
nttttnccccnntttttnntnnnaacagcccnccccncccgcgcctacacaaacnttcgaatagggtaagggccccccctcgaggtcgacagtatcgataagcttttttttttttttttttaaagtctcaaataatactcatactggctaagaataatacatgaggcgagcacagattagtatcctcttcgagccccaggagacacaaaagaaaaagaagtatagatatgtttgacagcatcacaactcaagtctaagcacataaatagctctaccagatataccagcccctattacccaatgcaaaaggcataaaagtagttttagaagctggcatccatgtcgtctgttgagatagcttcctacagctcaaatcattatcaaccaccgacagcatccgctcactaatcaacatcaacttcctcatcatcgcccgtgtacctatccgcaaaaatattgcttgaagagacaatgtttcctacatcatcgttgtcaccctcccttaacttcttcactgtaaatgattctggtaaatcagttcccttgctatcttggaaatggtctagggcatcttcaagtctatagttccctgatgttgggatcatatcatcaccaattctctctctgtctcctttccagatttttgcttccttccccttgtttggggaaaggaaaataaagtcttttttcctccgatggcttaaaacaatgggtctttc

SEQ ID NO: 10058 - DNA, 750 bp, Zea mays
  misc_feature: Ceres CLONE 505184
  misc_feature: Encodes the peptide sequence at SEQ ID NO. 10059
gaaacgagaacaaggacgccgtgtaaaaactcgcgcgcgccccaggaaggagaggaagagggagtaatgtaccaggccatcccgattggcgtcgaggccgcggcggcggtggcggaggaggagaggctgctcgcggctgcacagcagcagcagccgtcggcgggggcggaggcggcggcgaggggggaggaggtgcgacgggcggtggcggagtgccccgtgctcgtggtggggaagcgcgggtgctgcctcagccacgtggtgaagcggctgctgcagggtctcggggtcaaccccgccgtgcacgaggtcgccgacggcgccgaggcgaagcttattgccggggtcgtcgacggcggcggcgacgttgccctcccggccgtgttcgtcgggggcaggctcctcggcggcctcgaccggctcatggccgtgcacatctccggcgacctcgtgcccatactcaaggacgccggcgcgctgtggctctgatgagaggaccaaggcgttcgtagtctcgctcccccgtccatccttccttggcctctccatcgtcgtcagctccccttgtccttgttatttttaacttgttatttttactctattaaatagaccagataggcatgcatataggacttttaactctttcggtagaaacagaatattaggtagttagaacaatggagtacgtgtgttaagcgatttacagtatatatttatcttggtttcccgtctaaaaaaaaaaaaaaaaaa

SEQ ID NO: 10059 - protein, 140 aa, Zea mays
  misc_feature: Ceres CLONE 505184
  misc_feature (52)..(113): Pfam Name: Glutaredoxin Pfam Description: Glutaredoxin
MYQAIPIGVEAAAAVAEEERLLAAAQQQQPSAGAEAAARGEEVRRAVAECPVLVVGKRGCCLSHVVKRLLQGLGVNPAVHEVADGAEAKLIAGVVDGGGDVALPAVFVGGRLLGGLDRLMAVHISGDLVPILKDAGALWL

SEQ ID NO: 10060 - DNA, 772 bp, Zea mays
  misc_feature: Ceres CLONE 505223-R
  misc_feature (21)..(21): n is a, c, t, g, unknown, or other
  misc_feature (22)..(22): n is a, c, t, g, unknown, or other
  misc_feature (24)..(24): n is a, c, t, g, unknown, or other
  misc_feature (38)..(38): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
cagccaaaaaaaaaaagaagnnanaaccgccggacacnacacactcccgcggcccnnncacgaaatgggtaccgggccccccctcgaggtcgacggtaccaacaaagcgggttttttgttttttttttatcgccaataatttctgactaaagaagacttcaaacacaatattatgcggagttaaaaggatacaccgtcatatcaactagaggtacaagcccaaacgcataagtatgtcaacttgtcaagcttagaaagcgcagcaaacacaacggatgtcattctcatgtgggtagtgggggttgctcctgcatctccagtatggcacacctgtggaaaccctggcattttccatctccagaaacggagacatcatctctggtaagattggttctccctccgcttcacatagcgggtccggtcactgtaccgtggccgatcctgagctctctgaggcactggctccacccttctctgcctttctggcgacccgctgaacgatttcaccgttcacgaataactcagcaacataatacttgttctccgcattcaactaagaatccaggaagtacaaaaagaaaccccttggaaaaatcctaccaagttttgttggaagggcctctttccatccaatattcccaattccccaaaatcccaataaataaacggcaccgccaagggaacaccattgggtaaaaataatttgcttttgttattcaaaccttacctaacttatacaacatacccctatagaagaaacaaatagggggga

SEQ ID NO: 10061 - DNA, 637 bp, Zea mays
  misc_feature: Ceres CLONE 505404-R
cgaggtcgacggtatcgataccatatcaatggttccatacaggcgttgcaaaagcttctgacttagtgctttagcttctgcagctttgttcaaagcatcttctgttgccaagaattgctgtacatgttctttctgtctttctaatagctgatcatatgttcctcgagttggcaactgagatccaatcttcccattgccatacacctcagtaattctgcatcagcacgtatgtcaatcttgtctgtttctctatgtataagtgttttcatgcgcgatgtgtaggtaatgattgactgcagaagcaggaacggattctttagggaatccaatgcaacagctttaacatctgtgggtatttcaccatccaagtcaatacccagctttgctgcagttaattggcaacttgaattaatgccactcccttcaaatgccgggaatgaacttcgaatcgtttcaatcatatctgcagcaagagtttcacatgccttccggatgctcctttcacctgcagtttctaaaagatcctctgacaacctattgcttttaatagttgatgagtaaaggtcgtctctattgctctgcaattgcatatcttcaacagaacctgtagttccagccacacctatacttgatcttt

SEQ ID NO: 10062 - DNA, 775 bp, Zea mays
  misc_feature: Ceres CLONE 505458-R
cgattgggtaccgggccccccctcgaggtcgacggtatcgataagcttttttttttttttttttgtcataacattaaacttcattccacggttcttaaaaaagttaatgctttacacaaatacaatgacaacaagaaagacaatatcaattgaacaagatttgaacataaattactttccacaagccaacaatctaaaaaataattccaaattttgtattattgtgggcaattatgtgatttataacaccgcatggcatttttaaggaaatagtcaaccaaatttctttatgaagttgattatgtgctcactaacttcgtttggtttttcttcattgataaaatgaccaacatctttcatgacaataatatgatcgttaagaagtggaacgaacttcttgaagccacccttgtgaatgacaccctgtatgccaggattatggtatgtcaaatccaaatctccaatgatgaacttaacaggtacttttatcgtagctaaagtccatggggatgtgagctcccatgccttatttacggcacggtagtatttgagtccccccgagaagccggccttcgccaacaggctgggggggattttaagggccccctctgttacccagctccgaaaagggaacttctccacccggtgaggccccaaccccccctttgggaaaaaacaaaggctcccggaaaaggcgatacacctaagaattttcttggacccacccatttcatgggacacgggggtgtgcaaatgtcttgccttccaatttgcc

SEQ ID NO: 10063 - DNA, 682 bp, Zea mays
  misc_feature: Ceres CLONE 505640-R
  misc_feature (379)..(379): n is a, c, t, g, unknown, or other
  misc_feature (380)..(380): n is a, c, t, g, unknown, or other
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (387)..(387): n is a, c, t, g, unknown, or other
  misc_feature (389)..(389): n is a, c, t, g, unknown, or other
  misc_feature (390)..(390): n is a, c, t, g, unknown, or other
  misc_feature (392)..(392): n is a, c, t, g, unknown, or other
  misc_feature (393)..(393): n is a, c, t, g, unknown, or other
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (399)..(399): n is a, c, t, g, unknown, or other
  misc_feature (400)..(400): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (407)..(407): n is a, c, t, g, unknown, or other
  misc_feature (409)..(409): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (427)..(427): n is a, c, t, g, unknown, or other
  misc_feature (428)..(428): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (435)..(435): n is a, c, t, g, unknown, or other
  misc_feature (451)..(451): n is a, c, t, g, unknown, or other
  misc_feature (462)..(462): n is a, c, t, g, unknown, or other
  misc_feature (469)..(469): n is a, c, t, g, unknown, or other
  misc_feature (484)..(484): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (533)..(533): n is a, c, t, g, unknown, or other
  misc_feature (549)..(549): n is a, c, t, g, unknown, or other
  misc_feature (552)..(552): n is a, c, t, g, unknown, or other
  misc_feature (553)..(553): n is a, c, t, g, unknown, or other
  misc_feature (559)..(559): n is a, c, t, g, unknown, or other
  misc_feature (566)..(566): n is a, c, t, g, unknown, or other
  misc_feature (584)..(584): n is a, c, t, g, unknown, or other
  misc_feature (591)..(591): n is a, c, t, g, unknown, or other
  misc_feature (603)..(603): n is a, c, t, g, unknown, or other
  misc_feature (611)..(611): n is a, c, t, g, unknown, or other
  misc_feature (635)..(635): n is a, c, t, g, unknown, or other
  misc_feature (636)..(636): n is a, c, t, g, unknown, or other
  misc_feature (652)..(652): n is a, c, t, g, unknown, or other
  misc_feature (653)..(653): n is a, c, t, g, unknown, or other
  misc_feature (665)..(665): n is a, c, t, g, unknown, or other
cgattgggtaccgggccccccctcgaggtcgacggtctcgataagcttttttttttttttttttgtttagctcgagagggcagatcagctgtatctgtcaataatctacacaagtgctctcactccagaagggaggtggtgcttagattacagcctaagatttctcatagcatattctttgcgaccacggccggattgggacagtattgctgcatcatggcaggctcaggtgtctgtgcctagcaagggggtgcaatcacagtcatcacatgcacaggcaatggattccattggcaggatggcagtgtgcctgccggacatgcaggtggtgcagagtttcacatggcggcggtctcctcctctcccaaatgtcgctgannannnacnannannannnannacnnnananaannnnnaaaacaccacnncnnnnancattaaacaacacccncccacctcacnaaacaanaaacaccaaccaacnaccccaactcaaacaaaccacacccnnnaaacccccacccacaccaaancaaccaccaccccccnccnnaaacanacccccnccccaaaccaaaacccanccccccncccccaaccaancccccccnccccaaattacaaccaccacccannaccccccacaaatccnncccaccaccaanaaccataaaccaccaac

SEQ ID NO: 10064 - DNA, 645 bp, Zea mays
  misc_feature: Ceres CLONE 505790-R
  misc_feature: Pfam Name: Str_synth Pfam Description: Strictosidine synthase
  misc_feature: SWISSPROT Homolog: EC 4.3.3.2 Strictosidine synthase
ccgattgggtaccgggccccccctcgaggtcgacggtatcgatattttttttttttttttttcaacgatgacaatatataatagataggcgtccgacattactagtgcacatatattacattgctgtcacacgtacgtgtgcgacagatagaagatcgactactcttaatttaggacaaacgacagacatacactgctacacacgtacgctgctagctaaaggccgatcttgaacagaccgacgtaaggcgtgtcgacagaaccgagccagagcgcgccgccggggcgctccacgacctcgctgaccgtggcgttgccgagcccgcgcagcgcctcgacgacgacgccagtctcagcttggaccctgacggcagccacggaccggggcgtggtcccctgctccagccacgacttgtcccggttgagcgccacccagtagtacccaccgtcgccggcgcggcgcacgttgtccgggtaccccggcaggtcggcgaagggctcggtggtgccggcggcggggccgcgcagccagtggcgcagcaggcggcaccgcgtggtctcggccaccacgacgtgcgtcccgtccgcgctcagcgccacgccgttggggaaggacaggccggacgctagcacggcagcgctgcc

SEQ ID NO: 10065 - DNA, 1320 bp, Zea mays
  misc_feature: Ceres CLONE 505860
  misc_feature: Encodes the peptide sequence at SEQ ID NO. 10066
aaaatatatatatcctcgctttccttcccgtcgccgcctgaaaccgctgcgctctcggcttggatagcaagggtctcagtctctcagagggagcaagaagaggatctgagggtgagatggcgatcgaccacgagtccccgttcaaggagctccgcctcaagaaccgaaggatcatgggcggcggcggccctgaccctgagccggaggaggaggaggaggagggcgtcacggcggcgtacgcggagcggtggccgcggtggctgcagccgctgctgtccgcgcgcttcttcgcgcagtgcaggacgcacagcgactccaaccgcagcggcgaatgcaacatgttctgcctggactgctcggccgccgggggcacgggcacgggcgcgggcgcgctctgctcgctgtgcctggcgcagcacgggcaccgcgaccaccacaccatccagatccggcgctcctcctaccacgacgtcatccgcgtctcggacatccagcgcttcatggacatcgccggcgtgcagacctacgtcatcaacagcgcccgcgtcgtcttcctcaacgagcggccgcagcagcagaagccgggtggcggcaaggccgcgtcgtcgtcgtcggcctccgccaacctctgcgaggtctgcgcccgcagcctcctcgacaacttccgcttctgctccctcggctgcaaggtcgtcggctgctcccccgacgccgccaaggccaggaactggctcctccgggccgccgacggcgacggttccaccacatcctcctcggccccgcgcaacgccgacaggaagctgagcttcacgccgcccacgccgcagccgaccctgccgacgaagcgccgcaagggcatcccgcaccgcgccccgttcggcagcctcatcgtcgagtactagaatctccttctcccccagccatcgctgtccacgtccgttgcttctgcattggcagttggcactacacgcgcgcggtagagtggaagtactcttcaaacgacggaatggaatcgcacagtgagccagtgaatccagattacaggcaagccaataggttggccaccacttgggtggcctggcccgcctttctttgccacggcacttcggttggtgggtgcttatcgaggtggatgccatttgctcgctggcttcgctttccagaaaggggagggaggagaaaggaaggtggatggattggatcggacatcggaggaagaatcaaaaccagcttttcatcactgttcacgagatatatgtttctttctgtctgagaaatacatgtaaattttaaaaaaaagaaataaaaaaaaaaaaaaaa

SEQ ID NO: 10066 - protein, 261 aa, Zea mays
  misc_feature: Ceres CLONE 505860
  misc_feature (61)..(192): Pfam Name: PLATZ Pfam Description: PLATZ transcription factor
  misc_feature: The sequence is a functional homolog of SEQ ID NO 664 in the 10/666,642 US patent application
MAIDHESPFKELRLKNRRIMGGGGPDPEPEEEEEEGVTAAYAERWPRWLQPLLSARFFAQCRTHSDSNRSGECNMFCLDCSAAGGTGTGAGALCSLCLAQHGHRDHHTIQIRRSSYHDVIRVSDIQRFMDIAGVQTYVINSARVVFLNERPQQQKPGGGKAASSSSASANLCEVCARSLLDNFRFCSLGCKVVGCSPDAAKARNWLLRAADGDGSTTSSSAPRNADRKLSFTPPTPQPTLPTKRRKGIPHRAPFGSLIVEY

SEQ ID NO: 10067 - DNA, 927 bp, Zea mays
  misc_feature: Ceres CLONE 506131
  misc_feature: Encodes the peptide sequence at SEQ ID NO. 10068
acatcccctcgtttccggcaaaccgcaatgaagtctctgacccccaccgccgctggctccgccgcagatttttccgactctctgccctccccgatctcccctgcggcggtgccatgccattccagccccggccgccactactacctcgccgtcgaccgcacccagttcaaaatgaggacactcttggagctcctgggggttgtcgcggatcgccgtggtgggctgccgattgcaacatgtgtttcctcccgtgatgagcttgatgccgtctgtgctgccgtcgcaaacctcccctttgtgtcagcgtcacctctgtatagtgatcaagctgaagcagagcgtgcatctattcttgagaactttcgtcaagaaacaactcagtggaataaaactgctaaagctaccaatattgccgaaagttctaagcttgaaagtactggctctaaaataagcattatagttgcaacagatgcttgcttgcctcaggcagcgatggcagaggcmccccttatggctcgagtgctgataaactatgagcttcccmcaaagaaggaagcttacttaagacgcatgtcaacatgtttggcggcagacggaattgtgattaacatggtcgttggtggtgaggtggttacactcaaggctttaraagagaacagtggtctgcttattgctgagatgccaatacatgtttcagaaatattatgaccgttccagttgtacaacatttcagaagttactgttctgattgcacmctaactactcatggtttacttytactttaatttttgaattgcttttcatgtttcagaatgttctcaaattatatctytaaagcattagaataatgctcattgcttcttttttcctctgtataagraatgatagaatatagtcatggttcaatattcaaaaaaaaaaaaaaaa

SEQ ID NO: 10068 - protein, 226 aa, Zea mays
  misc_feature: Ceres CLONE 506131
  misc_feature (159)..(159): Xaa is any aa, unknown, or other
  misc_feature (173)..(173): Xaa is any aa, unknown, or other
  misc_feature (208)..(208): Xaa is any aa, unknown, or other
MKSLTPTAAGSAADFSDSLPSPISPAAVPCHSSPGRHYYLAVDRTQFKMRTLLELLGVVADRRGGLPIATCVSSRDELDAVCAAVANLPFVSASPLYSDQAEAERASILENFRQETTQWNKTAKATNIAESSKLESTGSKISIIVATDACLPQAAMAEXPLMARVLINYELPXKKEAYLRRMSTCLAADGIVINMVVGGEVVTLKALXENSGLLIAEMPIHVSEIL

SEQ ID NO: 10069 - DNA, 656 bp, Zea mays
  misc_feature: Ceres CLONE 506833-R
  misc_feature: Pfam Name: Prenyltrans Pfam Description: Prenyltransferase and squalene oxidase repeat
  misc_feature: SWISSPROT Homolog: EC 5.4.99.8 Cycloartenol synthase
cgattgggtaccgggccccccctcgaggtcgacggtatcgataagcttttttttttttttttttggcaccattagttcaatctaacatttattctgcttccaatatacgtagtacattattagaactaggagcgcaaccctaaaaaaaagcatagctgcattattccaaccaccgcacatagctagctactcacaaaaaagctgattgattcatgagacagctaggcggccggcaagacagccctcggcgtgccaagatagaacaccaagaacaccaagacaacaaagcgcctttcagtcaagttgacggggccaggccgggtcactaccgcttgccagctcccaggactcggcaccggtactctcccagagcccagatcgggaaggtgttcctgtactgggagtaactgatcatgcagttcttgttgaacactcctatgatctcttgctggggaaattctccgtcctctgactgcaagttgatcaaaacctttgctgctcggtgtagaggcgcgggatctctctgggcctgtcctgcatcaatcagcgccagcatggcccaaccagtgttcgctgcatgagctcggttgcctttgagattggtgtaaacctggtcttgagacgataaatagctttctccccagccaccggaagga

SEQ ID NO: 10070 - DNA, 578 bp, Zea mays
  misc_feature: Ceres CLONE 506874-R
ccgggcccccactcgaggtcgacggtatcgatatttgttttttttttttttcctttttttttttttttttttttttttttttttttttttttttttttttttttttttggcactgatcatctggagcaatgacttctctacaattctctagtaaagttaaacatgcagcaactccgaaattgaccaaagtaacaaatccgcaaattgacacgtgaaaaaagacagcaaattttctttcaaccaaacgacagtgggctccaagctaatatatgctcatccccatctttaacaggcgaaggccatttgtttctaaccgatcataaggcgggccaccacccctttggaatccggcagggtggggaaaccggttggaattttggtttccgggggcaaaaatctttccggggaaaaaaggggcccccaacaaaattgtccggggcgggaaaaagggccggggggccggccccgggaatttcttttggcccctggaattccggttcccccaaactttttgttcccccctttccaaaccctggttttttttaggaaaataagaaaatttttaccttttccccccc

SEQ ID NO: 10071 - DNA, 1118 bp, Zea mays
  misc_feature: Ceres CLONE 507722-R
  misc_feature (14)..(14): n is a, c, t, g, unknown, or other
  misc_feature (28)..(28): n is a, c, t, g, unknown, or other
gagtgccaacgagntgtgatgggtgtgntttttgtgtgggggggggggtctgttttgggggttttaaccgtgtggtttatttttctattgggtacgggccccccctcgaggtcgacggtatcgatattttttttttttttttttcaagggctgaatatatgaatcatttccttaaacaatatatttacaaagggctgctagctagcatagcagtccatgcatgcatatatgaatcattgactgtatatttgccattgccatcatccatcattaatgggtgatgagtaagtaggtacatacatatctagcagccttgccggccagggactcattaattcatcgactacactagctaggtggatcaatgagcttgcgttgtcagcccgacttgactgttgacatgggcttgcgctaaatacgtaaatcttgggcaccgagtcaattcatttacaaaaactattgggtgccattggaagaatctttgaaagtttggggtgaaaaagcagcaccccccccacacaacataacggaaaagtacggggcttggtcagtaccctagacctcgaccagacggaagacattggagaggaaataaacagagaactatacgagggaaattattttgagagaaaagataaatgttaattcaagatgaatgaataagtattgcgagggagagcggcagaacgacgccgtcattgtaatagacaaaacggtggtgcactccttgggaatcgatgctaacaattcctaacgaatggtgtgatcctacagatattgtgtgtaaaatagagatagtgattcataagaatcactgcgcgacaacatcgacaaccgccgaattaataccgcattcgctctactctcgtaatgttcgggctgcgtacaatataacatggaaggcgatccgaatggtagtatggttatatgaatcgtgatcatatagttacgccactggagagcaatggggagaggtaggggtgatatcccataacaataacttccggatctggcattgcgttgacataaattaatgtaaggagattgggtgtaagtgtcgttacggacgcctattgagcatgcgaataaacgcggagggaataaatacttctgttaag

SEQ ID NO: 10072 - DNA, 797 bp, Zea mays
  misc_feature: Ceres CLONE 507791-R
aaacaaacaaggaaagacaaaagcaagggggagagaaagagagggagagaggaaaaaaagggggggaaaaataatctcttcttgctcgattgggtacgggccccccctcgaggtcgacggtatcgataagcttttttttttctttttttggtctggtttctcctttgagctcccttttgccccttggcaccatttggtgagagtgtgctactcgtaattgtctcaatgttgacatcgtcattatgaggttgattctccgattcaaaatttgtttggggtatttccagggattcaccagccactttcttgcccctctttgactgttgcttccttttcctttcttgaactgcctgttgcttcttctgtttggtcggggatagatcaggtgccgatttcttagtgcttccaccatgcatctgagcctgattcagtggattaatatcttcctgaggcatctccaacaactggcttgacttatcttgtaggacaccaccctctttgaccgcttctagatgttgaatgctatcctcaactgcatgtgaagtcctacagataccatctggagccgcatgtctacctggtttagtgaccaattcttcttgtcgagctgccctccaaaggatggagaagaagaaaacttctggtttcaattaataggaacctggccaataggttattataggtcttatttgggcaacaatcaattctttcccttccaaaaagaattatattttggccttccctggtaaaaacatgggtgcgtccaaaattgttacctttataagagcaaacccttt

SEQ ID NO: 10073 - DNA, 1486 bp, Zea mays
  misc_feature: Ceres CLONE 507918
  misc_feature: Encodes the peptide sequence at SEQ ID NO. 10074
gcctttcgttcctcggagctcttggcgtcttcttttcggcctcccgcgaaccgccatccaccaaacctagcaccaatgcaagtccccaactcccaatcccacagtgcatccatgcctcccatgtttgtggctagtgggtgggcgaacctcaccatcaacgtggtgatcgagatggtgaaccgcctcccgtgcgcaatggaccgcgcacggatgaccgccgtctgccaggcgtggctcgcggcgatcgcgcatgcccagcctttgccgtttcagctcccgtcgctcctcctcccgcccgcggacgtgactgacgtctactgctacctcagcggcggctgccgcgaccacagcatgttgcccgggccccgccacttcggctcgtacgacggcggctggatcttcttcgcctacggccagactagcttgcaccggatgatcaacatccgcaccagagagaggcgcgcgctacccgacatgatcgagggtctcgccgcacacggaacccccagcatggtcatcctcgccgccaccctctcgttcccgcctgatcacccgaaatgcgtcgctgcgggcatcgtcacctacaagccgcacctcctcgaggcgccgcgccgacgccacttcgcgttctggtgcctagggagtaaggtggccacgtgcgacgtggccgtgcctgcgccagttgggctggcttggcaacaggaggacgtcgtgtactaccgtgactccttccatttcctcacccgaggtgggcatatcatcgtgtgcacaccgatcgttcgtgatggggttctcctgagagtgctgtcggagttaatgcgcttcgagcaaggggggtacaataaccagcagttcgttcgcgctcgctacctcgtgtcatcccgcggggaactgctgatggtcgtcaggctcgctgcccaccatcgcgcgctgacgtcgtcgttcaaggtattccggatgaccgtaatcactagggctaggacctggatcgaggaggttgcattgtgtggccgaatgctgttcgtggggcgaggatgctccaggtcctacgaggtgagtcagtacccagggttcaaggacggcatcttcttcttggatgatcggagcttctacgacgtcgagatgatgttcggcagaatcaatgagaggctgtacccctgcagcgacaacggcaggtggtcgccggcggaagggctgtctcgccatgtcgacctcttcttcccggagcgagttccttctttgaactctcctccggcttggcttctgccttgagacggcaagtttgtagctacgaaatatatctgttatgtttgactgtgataaatgatgtgtgttcctcttgcggtaattgctggttctgttaacagtgaaacgatagctgaaactgtagcgttccagctgttctgtactttgtgctactcttattggtttacgtacatatatgtgcataaatgggtttttacgggtgaaaaaaaaaaaaaaaaaa

SEQ ID NO: 10074 - protein, 398 aa, Zea mays
  misc_feature: Ceres CLONE 507918
MQVPNSQSHSASMPPMFVASGWANLTINVVIEMVNRLPCAMDRARMTAVCQAWLAAIAHAQPLPFQLPSLLLPPADVTDVYCYLSGGCRDHSMLPGPRHFGSYDGGWIFFAYGQTSLHRMINIRTRERRALPDMIEGLAAHGTPSMVILAATLSFPPDHPKCVAAGIVTYKPHLLEAPRRRHFAFWCLGSKVATCDVAVPAPVGLAWQQEDVVYYRDSFHFLTRGGHIIVCTPIVRDGVLLRVLSELMRFEQGGYNNQQFVRARYLVSSRGELLMVVRLAAHHRALTSSFKVFRMTVITRARTWIEEVALCGRMLFVGRGCSRSYEVSQYPGFKDGIFFLDDRSFYDVEMMFGRINERLYPCSDNGRWSPAEGLSRHVDLFFPERVPSLNSPPAWLLP

SEQ ID NO: 10075 - DNA, 1049 bp, Zea mays
  misc_feature: Ceres CLONE 508153
  misc_feature: Encodes the peptide sequence at SEQ ID NO. 10076
gaccaatccgtcagagctctctacccagttacccacacgaaggaataatataggctaggccgccgaccgccgccatcgagtcgcactcgcacgccgccttcaattcatccccctgtgcagcaggcccagccggacgctctctcctgatcttcctccgccgtctcctcctgtcacccgcttgctttgaatccccttcttctgctccgccatcgcgacgcgccgacatgactgggtcttctaagaagcatgacctcaaatctaagcaaaaattggaaaagaagattagtttttacacaaaagtaaaagatgcagttacttccttaaatgctaagaagactgtcagtaagaaaaataaacagagtcggcgccagaagaaacttaaagcatacgatctgtcggcactttctgagttcctcccagaaccagctgcaccagagcagaagactgaagcaaagctgaactgcaagtcaagacagacattagtgttgcaggagtctgctcatcttaaggctgtactggacaacccgcagttccagcttgacccatttgctgcgatccatcagcacctgctggcaacgcagccgcctgcagctgcaaagaaggacgacacagcggggaatcaggggaaggttttcaaggacaagaaaagcaggaggaagaagggcacatcgtcaatctctcaggcaatggatatctgattgtgttccttcagtactagtaacttggtccgatgtcgactgcccgtgttccactagagggagctcatcgaagttcgatatcgatggttggcatagttttagtaccagtagaggttgtactgtaccagccctctcttttggcagcctgttgattgatgtttgcagaaccggtgccatcaacatttggtgctactttggaaactggggatttgaggagaggattgagggagaaaatgaacttgaggggattgagagggtcaatcctatatgaggtggcaatttccaagcacaacaattcatttgttattatacctggcgactgtttcttaagtcaaaaaaaaaaaaaaaaaa

SEQ ID NO: 10076 - protein, 157 aa, Zea mays
  misc_feature: Ceres CLONE 508153
MTGSSKKHDLKSKQKLEKKISFYTKVKDAVTSLNAKKTVSKKNKQSRRQKKLKAYDLSALSEFLPEPAAPEQKTEAKLNCKSRQTLVLQESAHLKAVLDNPQFQLDPFAAIHQHLLATQPPAAAKKDDTAGNQGKVFKDKKSRRKKGTSSISQAMDI

SEQ ID NO: 10077 - DNA, 1258 bp, Zea mays
  misc_feature: Ceres CLONE 508663
  misc_feature: Encodes the peptide sequence at SEQ ID NO. 10078
cgaatcagaagccagagccaaatggagcgcaactaagcaatgcttatacattcctctttcagtaccctcctcttgacagcaagccaagttcgagccagtccatgcaatttccaggttttccaccgcttaatggagcacctcccaataagccactacctcattttcctgctggacatatgccattctatgatgatgcagaatctgtggtatttgaagatccagaacagtttgaggacccatgctatgatcccgatgcaatcgcattgcttgggccagtttcagagtctttagataatttccctccagacttggattgtggattcatctcgagtgatgttgtcaaggaatcacatgggaggccttcaccaattgagtctcctctctctaggtctcgtatggttgaagaaaatcctatcaagcccctgcacttgttagttgcaaaaaggcctggtggtcctattcagcctgaggctagcagtgagcaacgcacatggcaaatgtggagcacaccattggttcatgaaagtttaggtctccaaggtcatcaaagtcagtggcttcaacagacaaatcaattaaactatagtgccaatgttttcaatggcagaacaaacgcccccctgggtactggtttgaatgacagtgatccttggctgcagaaagcacctttcaagcaattgccacctgatactccaagcctgttccttccacatgaaataccagggaaattacacaacgacttggtttttgggtctccaaacaaatcagcacgtgaacacccctttggatcacctggtccttcttggcccaaggaggaactgtcgttgagtggagcccaggaaggtggtggccatttttcattgctgtcgggcgcacatgttggcggcagcggagacttattttgctccacaagtcctgatgtgcagtccttggtgtggtctttcaacgaaaaggagacagcatagcagggacggactttgtggaaggaaatggaggatgtctgactgagccaaaacctccttgcctcctctgagtgtcacagggcggggttaatcggcgaggagataagtagtctccctccatgtcccttggcgcaaagaagatttggggggggggggggggggcattttgtttagtatcgactcctctcacctgacctgttaccacgcgccatcttactttcacctgatgggtcgttgtatgaactctgggattcaatgaaaaatggggctgatttgtttcaaaaaaaaaaaaaaaa

SEQ ID NO: 10078 - protein, 287 aa, Zea mays
  misc_feature: Ceres CLONE 508663
MQFPGFPPLNGAPPNKPLPHFPAGHMPFYDDAESVVFEDPEQFEDPCYDPDAIALLGPVSESLDNFPPDLDCGFISSDVVKESHGRPSPIESPLSRSRMVEENPIKPLHLLVAKRPGGPIQPEASSEQRTWQMWSTPLVHESLGLQGHQSQWLQQTNQLNYSANVFNGRTNAPLGTGLNDSDPWLQKAPFKQLPPDTPSLFLPHEIPGKLHNDLVFGSPNKSAREHPFGSPGPSWPKEELSLSGAQEGGGHFSLLSGAHVGGSGDLFCSTSPDVQSLVWSFNEKETA

SEQ ID NO: 10079 - DNA, 550 bp, Zea mays
  misc_feature: Ceres CLONE 508712-R
catctctattgatccgtacaccagtaggctaacttaactgttacacagcattctactgatttttaccggagcccaaaacgttcactggagatctaatatgctagcactaaactttggtatgaacaggttgactatatcttccacaaaccgcagttcgccatggcaaaccttgtttgaccaaaatcctccttcggcggtcggtgatcatgaacagccgatgaaatcgtgcgcaagagttgtacgactgaaagagaacaggagaaattcgatgctcattgcaactccttgtcctcctgtctcaacgcaaacttagccgtgtccttccacagggacacctccatttctttctcaacgagcttcttctccgcacgccgcaacgcggcttccagctcctcaatccggtcccggtttctttcgtggagaagctcgtggagccttctctccagctgtacggcagaaactccgtggtactcggtgtcatcttaatttttaatttttcctcataaggaagctgaaagaattcacgggttacattcctgacttccctcat

SEQ ID NO: 10080 - DNA, 874 bp, Zea mays
  misc_feature: Ceres CLONE 508856
  misc_feature: Encodes the peptide sequence at SEQ ID NO. 10081
atgtcatcgtctcgttcctctgctcccttttgcaacctcccttcatataggccactgtgacctgcttccctttcgcagttgcgcatctccatagccacctcggaagctcgaggccgaggatccacatatatagcatctgtcttttatactaggttttagtttttgggagaatctacacggcgcagaagctaggtagctttcttcaataatcttggtccagtccagcaagcttccctgcttccccttgccctcgatcgacctgctgcgggcccagagacatccatccatccatccttccttcctggctgtaagaagaggagatggtctcatggccgtgatctcacctcgccgagcgctcgtcgcggccgtgtccctctgcctcctcctcggcgccgccaccagcatccgcaccgcgacgttttccccttctcaggcgcaggagaacctggcggaggacaagtcgcggctggggtcgacgccgccgatctgccgcaaccggtgcagcgcctgcaacccctgcatgcccgtgcaggtgacgaccgcgcccgcggggctcgggcgcgcggcccgcgtcaccgacgccgacgccgacgcggtggccggcttctcccgctactccgactacaagccgctggggtggaaatgcggctgcgacggccgcctgtacgacccctagccgagcgtgcaacgccagtgcactctgctccggtccggtagggtgggggagactggaggccatccaggttcttggtgtcatctgttcttggttttaagcgggcaatgtgattggctgtgtatctgcttcgctcaagttgctttatgtcattcctaatggaataggaaatgccgtgtttctaaaaaaaaaaaaaaaaaa

SEQ ID NO: 10081 - protein, 115 aa, Zea mays
  misc_feature: Ceres CLONE 508856
  misc_feature: SWISSPROT Homolog: EC 3.2.1.15 Polygalacturonase
MAVISPRRALVAAVSLCLLLGAATSIRTATFSPSQAQENLAEDKSRLGSTPPICRNRCSACNPCMPVQVTTAPAGLGRAARVTDADADAVAGFSRYSDYKPLGWKCGCDGRLYDP

SEQ ID NO: 10082 - DNA, 1927 bp, Zea mays
  misc_feature: Ceres CLONE 509150
  misc_feature: Encodes the peptide sequence at SEQ ID NO. 10083
cttctcccttgatcggcacagccacaacctccttctccaatactctctccctcgccgccggccacctccgcctcctcccacgcgccacctccgcctcctcccacgcgccacctccgcgacaaaccactgaaggagggagaggactcgctcatatcgtccgatggaggaggactcgatcaaggggatgatctccgcgatatcctgggtgcccaggggcgccgccaagagcgtgcccgtcgttgccgacccgcccactcaggaggagatcgccgaggccatgaagaccttcgacctgggcagagactccgggagcgacgctgacgaggatgatgatgctgccaccatggaactcgacggtgcggcggaaacggtggaggaggttgatgaggctgcccgagccaaggccgtagccaaggcgctctgcaagggctctagcaaggcggacgacgtcgctgatgagctccgcgaactcaacatggacgcgtacgatgatgaagatgaagaggtcgatattttcggctctgggctgggggacttgtactatccgagcaacgcaatggacccatatctgaagaagaacaatgaggatgatgaggaggacgacgatgatgatgaggaaatcgaagataagatgatcatgcctactgattttgttattgtctgtgcacatagtgaggacgatatcttctctcttcaggtcaacattcttgaagaaacaaatgatggtgaacaaaatatctttgtgcatcatgacgttcctctcgctgattttccgctatgcacagcttggatggattttaatctgaaaggtggtgaaaaagggaattttgtagccgttggaaccatggatcctgccatagaaatatgggacttagatatggttgatgaagtgcaaccgcacatggtgctaggaggactttcaaaaaagaagaaaaagacaaagggcaaaaaggggaagaagtataagaaaggaggccacagaagttctgtgcttggtcttgcatggaacaaggaagttaggaatgttctagctagtgcaagtgcagacacaactgttaaaatctgggatatagctgttggtaaatgtgcagtcactctagaacaccatgatgacaaggttcaagcagttgcttggagcccacagtcacctgaagttctgcttagcggatcctttgataaaacagttgccatgaatgatatgaaagatggtgggcagaattgtcataaatggtctgttgaagcagacgtcgaaagtttagcttggaatccacacaatgaacattcatttgtggtcagtcttgaaaatgggatggttcaagccttcgataagcgaacagcttcatcaagttcttctggccagtctatgtatacccttcatgcacacgataaggctgtttcttccatctccttcaacccgtctgcccctaactttctcgcaacaggctcagttgataaaatggtgaaactatgggatctatcaaacgacaaaccatcatgcattgcctcccaaaatccaaagcttggagctattttttcggtatcattttcaaatgacagccccttcttgttagcatgtggaggttcaaaaggcaaactgaaggtttgggacacgcttacggagcctgcagtagccaacaagttcagcaaatagaactgccgctgtttgccattataagttatttcccggcacacacatgtttgggtagattgaagttatagtcgaagttttgcccttgtgagttgaggagcccaattgtataatgaactcatgaaatcaatccaagcattgatttatgtattagtggtgggcagaggttttggagtggacgtattaactttatgacggtgcgagttgggttgtgacttcccaattttttgtgaaagaagttagtgatcttcagaccagctcagaaaaaaaaaaaaaaaa

SEQ ID NO: 10083 - protein, 496 aa, Zea mays
  misc_feature: Ceres CLONE 509150
  misc_feature (399)..(438): Pfam Name: WD40 Pfam Description: WD domain, G-beta repeat
  misc_feature (264)..(303): Pfam Name: WD40 Pfam Description: WD domain, G-beta repeat
  misc_feature (307)..(346): Pfam Name: WD40 Pfam Description: WD domain, G-beta repeat
  misc_feature: SWISSPROT Homolog: EC 2.3.1.48 Histone acetyltransferase
MEEDSIKGMISAISWVPRGAAKSVPVVADPPTQEEIAEAMKTFDLGRDSGSDADEDDDAATMELDGAAETVEEVDEAARAKAVAKALCKGSSKADDVADELRELNMDAYDDEDEEVDIFGSGLGDLYYPSNAMDPYLKKNNEDDEEDDDDDEEIEDKMIMPTDFVIVCAHSEDDIFSLQVNILEETNDGEQNIFVHHDVPLADFPLCTAWMDFNLKGGEKGNFVAVGTMDPAIEIWDLDMVDEVQPHMVLGGLSKKKKKTKGKKGKKYKKGGHRSSVLGLAWNKEVRNVLASASADTTVKIWDIAVGKCAVTLEHHDDKVQAVAWSPQSPEVLLSGSFDKTVAMNDMKDGGQNCHKWSVEADVESLAWNPHNEHSFVVSLENGMVQAFDKRTASSSSSGQSMYTLHAHDKAVSSISFNPSAPNFLATGSVDKMVKLWDLSNDKPSCIASQNPKLGAIFSVSFSNDSPFLLACGGSKGKLKVWDTLTEPAVANKFSK

SEQ ID NO: 10084 - DNA, 633 bp, Zea mays
  misc_feature: Ceres CLONE 509168-R
cgattgggtaccgggccccccctcgaggtcgacggtatcgataagcttgatgggctcaccagcaggcagtggcttaggagcttgaagttgaccgggtcaacccgaagcttttttttttttttttttgctgttgctcaattttacaatgcttcatgtagtacatatacacgagcatacaacaaatgacaacattacatgggcaagaaatatggcgcctctgtcaaattgaggtgccgacatcttacgcaacactacatatactagagcactagacactagacgcaaaactgcaggagcttcacagcttaacccagaccggctccaagcaggacaacaggtccagtcgtccagaaacatattatttcctttatggccatacctccaatgatcaacacaaaagctgaatagtgcagagcctcctgcaacaagtctgcagcataacagcctcatttctgcaagtccatgtcgagggtcgaatcaaaatctgagcggagtctttttggctcccgctctcccaggttcagggcaatagaaataccatcaggcgaattttccagttccaagtccatcaagttattcaagtcaccgttaccttcttgaccgttgcgcatcggagacatcaggtttagctcc

SEQ ID NO: 10085 - DNA, 655 bp, Zea mays
  misc_feature: Ceres CLONE 509954-R
  misc_feature: Translation starting site: 336
  misc_feature: SWISSPROT Homolog: EC 1.8.4.9 Adenylyl-sulfate reductase (glutathione)
  misc_feature (655)..(655): n is a, c, t, g, unknown, or other
acgggccccccctcgaggtcgacggtatcgataagcttatttttttttttttttgaagctcagacttcaggtatacatgctgcaatcattttgcagttacaaaagctacacctgatttttcccccctgaaccctcgttccttcctgtgtcactaccaaacccagtcccctccacctcccttctctacgaacctagataaactcataaagaccaacataagatcatacagactgacagagaacgatggttctcgctcactggaggtcgtctctcaccggaggctgttgacgaaggcgaggagcgagtcgacgtccctcttctccgacgggtacttgatgggcctggcggtgcggccccggaacaggagcacggtgggaaagctctgcagctgcagctcggcctgcgcgaacggcttctgctcgccgtccgcgcggaacttggccaccttcaccccggaccccgccagcttctcggccagctccacgtatgaggcccccatggcctggcagaaacgggcacccgggggggtacagcacccccaaccacgggttcggcggggtttttccagggccaagaaggttctccattcccggggcggggggagaaaaaaccaccgggggggcctctcaaaaaaatatccggaggacgccccccn

SEQ ID NO: 10086 - DNA, 843 bp, Zea mays
  misc_feature: Ceres CLONE 571134-R
  misc_feature (31)..(31): n is a, c, t, g, unknown, or other
  misc_feature (32)..(32): n is a, c, t, g, unknown, or other
  misc_feature (39)..(39): n is a, c, t, g, unknown, or other
gccaaaataaccaaaaaaaacaaaaatagannttttttngggattaatctcataacccaaaactgtactccccgcggtggcggccgctctagactagtggatcccccgggctgcaggaattcttttttttttttttttttgtcttgaaactcagacattcagtcatgacattatatatatatacgcatcacgtacaaatatacacgaccatacgtacaaaacacgtacgtacgcgatgaacgcaacgcctctgagtttagcgttggaggttgggctggatcggagaaaaggtacctagcttagcttagctaaacggaacatcatcccctccgccgggacgtgggtacatggtggtcggaagaaggaggcccttctggggcgtttacgcgtccaaccaaaggacgggggacgaaaacccctggggactttggggtccctggtaactggccgggaaaaaaggcccacagggcctctccactaactaaagaggaaacccacacaaaatccccaaaccaaaacaggggatttaggggggaagaggggtagaacccttccccacccggcaaaatcctctgtgacacggggtccagatggccaccgcagaaaatgatactcccgccggggcgcaaccccctttgcaaatataagggcccaaacctataagagcaaaaaaaaataggtcctcccacccaaaccgccccgaaaaaagaaagttgtgcgccacatgggaagcacactaataaatctccaaccaaaaacatttctactttctattttatgagtctcccacgggtgccccctcacacccactctttgtggcgcaacacataatatatattatat

SEQ ID NO: 10087 - DNA, 878 bp, Zea mays
  misc_feature: Ceres CLONE 622782-R
  misc_feature (38)..(38): n is a, c, t, g, unknown, or other
  misc_feature (43)..(43): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
gtggtgggttggtttttcttatacccccccgccggggntatanannntcaaagtagctccaccccggtggcggccgctctagaatagtggatcccccgggctgcaggaattcttttttttttttttttttgaacaactttcgtgtggatttagacaagaaaacacctgtatcaagccaacaaccgtctccctttcacaatacaaacactcatcaccactcgagcactccacacaagagtaagcacgcaaacaacaagctcttttcatatctacaggaagcttatctttgggtcagggctagggatttctgtatacaccaactgcagagactgatggtaagaggggccgctcctatggatgatatgctctcacaaaattacatgaatcaggctacactcactgacggtcaatccaatcacattatgaaacggattcacaccccggaaaaacaggttacagatattttataaccacgccccaccactttcccggtttagaaaacattgaggcgccggagagaaagttagtcgaccaaccaaccttggtgggagaacataactgggtcctacaaatatgaggcccggggcgtgccccatttttacgttaccgcttcgtcaccatattgaacgccttgtagcgcctcgcaaccacaatccaacaaagttatttgctcttcaataaatcctctgaacgaaaaagaatatcgttgagaagggagggtgccaaacaagacataagagtgttcgttgctcgcttctcaaactctaacgcataacctttcatgacaccccatccatttaagtcatttttaatacccctatacccccctctttcttctcccccatcatcaccctcctacttctccgtacaccaccctc

SEQ ID NO: 10088 - DNA, 520 bp, Zea mays
  misc_feature: Ceres CLONE 622799
  misc_feature: Encodes the peptide sequence at SEQ ID NO. 10089
aaatttgattcaggacaagactctggtaaggaaaagattgatatcaagcaacaacactcgtgtcaaggcagagtctggcacctgttaacgatgatgagtttagtgcaacctcatatcatgctttgtatctgtaactggtagaaacaaagttgttgcaacatcatccattgccgatgatttgtcagaggttgacatgccatcaaaacgcaggaggctgttgaatcaagacacaagactatctagagcagaataccttgatgacaacaactcatgtgttactggtatatcagcagaaggcaaacttcttgtggataagaaaaaaacttcaagctggattgatgttgatgtggtgcttttgtgactaatcatctttagagcttttgtgaatgatctagctagctatctgtaaatgatctagttgtgaatgatattataattgtgatgcttttgtgaatatataattgtggtgctattgtgtttaaaaaaaaaaaaaaaaaaaaagaaaaaaaaaaaaaaaaaa

SEQ ID NO: 10089 - protein, 55 aa, Zea mays
  misc_feature: Ceres CLONE 622799
MPSKRRRLLNQDTRLSRAEYLDDNNSCVTGISAEGKLLVDKKKTSSWIDVDVVLL

SEQ ID NO: 10090 - DNA, 646 bp, Zea mays
  misc_feature: Ceres CLONE 622867-R
  misc_feature (646)..(646): n is a, c, t, g, unknown, or other
agctccccgcggtggcggccgctctagaactagtggatcccccgggctgcaggaattcttttttttttttttttttcttttttcttttgtggactgatgtttttactttgaaaaggtttgaatctacaacccttccattatctaaaaagaacaattgtatactgcaagtccggctgcacaattcatcagatttgcattcgcaaccagaaattttgattgatcgttttccaatttcgagtctcaaaaagacaaaaggtatcctttacatgattacaacacgcacgacagggtatcatcctcagcattctttgcttcaaagacatgcgtgggcagaaaaataaaatagaaataaaaaattggacgatccatgaacactaaagccatgttgcagcgtaactatcatgtatacaagctgaagcaaatctattatccccttcccctttcctattatttacatctaatgacaaaaaggaagcctgctcaatatctgttggtcagctggaggagatgcatttgccatttggatgagtggttgcgatacaggctctgcctttggttctcccggcaccataagccctgggcacccctgcatagctgatgaatttccaaccatctttacaggggcaagcgatcctagagagggcan

SEQ ID NO: 10091 - DNA, 722 bp, Zea mays
  misc_feature: Ceres CLONE 623167-R
  misc_feature (722)..(722): n is a, c, t, g, unknown, or other
aagctggagctccccgcggtggcggccgctctagaactagtggatcccccgggctgcaggaattctttttttttttttttttgaaaaaaaataattcaattgacattggcaaatattgcattagcaatattatcatatcacggaaggcattcatgtcaccttcttcatctccaaattgactagtactaggcgcaaaaacgattcggtggattataatggcaatggtgggtaatttctaggaaacttgaaagggtagtggggaagtgggaaaaaaataatctaaaataagcacctcctcacttgcttatggattatcataatccaaggggttagattatataatctgggcaaataagctggactgtttgtttgcctcttaggattatttaatccagattatataatctgggggtaaataaacaggccctaagcacaacgactaagtaaacaagattatccttgacaatgaattaactgaagcaaagatcctccactggtgacagggattgcatattacgcttcatgggtatcgtcctcttcttcgccatttgtgccggtaacatgatcagatccatcgccgtcatcccgacttggtcttgttaactaaatgggtgatggcctagctagaatcgatcatgaaggggcttcttctacaggtccccgagagtgatggcccactcccctgggcagaagacgctgaaatccaggatgagattaggatn

SEQ ID NO: 10092 - DNA, 675 bp, Zea mays
  misc_feature: Ceres CLONE 623212-R
aaagctggagctccccgcggtggcggccgctctagaactagtggatcccccgggctgcaggaattctttttttttttttatcgaaaaccacctagtataaaatctccgggaatccccccctcaccctctcacccctatatccccatgcatctccgccaacgtgtgcaaaaattctattaatccgtgctgggtataaaaaactgctcctctcccctgccaacataagcatctaagctcccttatcgctcacaaggggggcaaagggctactcaccactacgtggattacgtggagaacgacgacatggtcacacctctcccatatttctgctttcatacactctacaaccgggagaatgatgaaggaagatgcgcatcctcatgcgtatttatctcccctccgactgccacatcctctcgatgaacaagaatttcaatatcctcgaccatctcaacctcgatatcgtccactgagaggtctagcatcgtcttccatattctcaacaacttcagcatcttcattcttctcgacactatcgtgccccatcgtggacatcattacgtggcgcctcgagccggtagaataccctattgagaactctggaacttgatcctcataaacatcctccgtggggtggccaattttcgccgatatcttcagactggggaccaaaaa

SEQ ID NO: 10093 - DNA, 636 bp, Zea mays
  misc_feature: Ceres CLONE 644652-R
  misc_feature: Pfam Name: RAMP4 Pfam Description: Ribosome associated membrane protein RAMP4
aagctggagctccccgcggtggcggccgctctagaactagtggatcccccgggctgcaggaattcttttttttttttttttttgcgaaagattaccaaattactcgataaatcgaagagtacaatagcccaatgatgcgaccaatttgagcatagaaatatttaacacgaactataactatactcgatatgtattatggactactccaacatctttcctgtcagacaggtgacttaaattagcacttccattacatatataacttaaaactctccacggtacaacattaaaaaggcgacattaagccacgccctacacttgtatagtttctagtgacaaactgcatgtgtcaaccgattcacctcagaatagaccagcgtttgatgctgtcttgatgatctgaaagagagatgatccaacaaccacgaagacaaagaacccaagaagaataggcccaacaggataatcgtttgccttcttggctgtctcaggaacagagcccctctttgtgatattcttctcaaatcgtgatatcttcctatcagcaagacgccttgaggtagtcagaggtgtcgccgagccgtggacggatcagcgacagaatacgatagctcgacgtttagacaggagcgagga

SEQ ID NO: 10094 - DNA, 720 bp, Zea mays
  misc_feature: Ceres CLONE 644921-R
aagctggagctccccgcggtggcggccgctctagaactagtggatcccccgggctgcaggaattcttttttttttttttttttgtatataaattttaaaaacattgaccctttaaaaatatacaatgcttctcgccgtttctaattttttgagccaaactgctcgtcagggcggggagccgtgtgtttggttggggttggctgtatcagaagagccggaccctttacatccattgactacagttcagcacatatttggctcgctacatctaggagactgggcgcgcatgcactaccaccttcacacacagtagcataaagcttccccacttccaggcgaattgacagcccagccgttccctaccagggaagcattctgcaagtcgcgccattggtagcagataagcctgattccactcgacgccgagcttgcccttctctgacggcgagggcgagctgttattcttcccagctggacgacttctgatcagcctgatgcatgaatacaaacagtagctctcccgtccagactcaccagctgctccacgccttcagcggcaccagcacgcccaacccactcgctgcgactggaaagcaacctccaacccgggcaatcaaagccacaatgtcaggttgtcacttgcaggagatcggagaaaagatttctggaaggtcgactcccaactgcatcacgtccacatggttctgtaacactacaggt

SEQ ID NO: 10095 - DNA, 658 bp, Zea mays
  misc_feature: Ceres CLONE 645318-R
aagctggagctccccgcggtggcggccgctctagaactagtggatcccccgggctgcaggaattctttttttttttttttttagtgaagtggatcattgtattgcatagagaaggggttacaatatatagactcaactctaaccctaatgaaccggcagcctaacaatggtaccagcccacacacactcacacaatcagtctaacagttattcatggtacacgcctcgctcaccagacggcatgtcaactttgccgacgctacgagcctacgaccaatagttatccacagtacacgcgtcgcccaatgctacgagcctacgagcagtactgttgacatgtcaatctccaagaatgcacaatggctgcctcatgctgagctccaccttcagccgtggatacaacgctaggtcgttgcttgcgaccagcactttcagagcggcaagatgggcctcttgtaaaataccaccatcgacctccaatctagctattggaaattctggaagatgaccagattgctttttacctagtagattgccagggccacggagcagcaggtctgcattagccaggtaaaacccatcggaggacttctcgagcaccttcagccttggcagcgtgctcgaagttgaagccaggaatatgcatctggatttcctc

SEQ ID NO: 10096 - DNA, 628 bp, Zea mays
  misc_feature: Ceres CLONE 645629-R
tccccgcggtggcggccgctctagaactagtggatcccccgggctgcaggaattcttttttttttttttttttcgtaaagttatgcatttagctcattttttcgaatacatcaagaaaaggacattctgcatcttttttcaggaaaccaacatgttctgtacagatgtcacaaaagagtacatatctgctaacattttctgttttttcttgcatgcataggctattcgaacaacgatgctccccatgagtttcttttaattaaaagaacatccttatgatgacagtccaaacggatggcttgacatggagttgctcgtacatgtatgcagaggaccaaatatggcattccatttctctgtgcttttcgtcaactcctcagggtcatttatgtttttccttgtcaagcgcaatttcgacaagctgaatattcccctgaagtaaagcagccttacatggcggtaggaaggagaaaccatccagcagtttcaaacacttcaaaccccacttgaccatcaaaaactcaatcagatgatgaccactgcggttgtggtatgtggttatgaaaaccgccccagaagaattttcgagaagaaaggtcaccgtcgcgaacagatcatcgaaatttgc

SEQ ID NO: 10097 - DNA, 812 bp, Zea mays
  misc_feature: Ceres CLONE 660720
  misc_feature: Encodes the peptide sequence at SEQ ID NO. 10098
gaaaatttgatctgtttccactctccagatcatgggaataaattttgcttgcaaattatatgttatagtagttttgttttcacagtttgtctgaatttactttgctaactgtgtgttgaagattattgctggtctagtggagtatcgactaggagagagcctggtgacatactacaaccaaccccttattgctggtttgttgtcattcgtggctaggacactgaactcatactggggaacacagcaatgggttgatcttgcgcggtacactgggttacagagaagcgaggaaaagcctcctgctgaggccactatgccacctgattcagcacacttggagggttgtacgacggaaggacatgattttgatgacagcagcaataacaccaacaaatcgactggtccgagctagtgatttgattacttcacggtggctgcagatcacatggcctattttcatagacaatgaaagtggctgccttcctgctyttgggatcacaaggaagtggaaatttgaggaaatattagtcacaaaattttgttcagattctttttcagcgttaccacaagagtgcacawacagttctcgtttctattcgttagagtaaatattgttttgtacaatytacatctgtaagaactgcagcacctaaaggatgtgcagcaatgagggttttaacttgtcgcattgcatgctcgtaagcatgtttgttgcggctttaatcaagactgcggcttytacaatattttgtctctatagattacagctgcagcagttcgaaagtgtagagcmcaaaaaaaaaaaaaaaaaa

SEQ ID NO: 10098 - protein, 82 aa, Zea mays
  misc_feature: Ceres CLONE 660720
  misc_feature (44)..(44): Xaa is any aa, unknown, or other
  misc_feature (74)..(74): Xaa is any aa, unknown, or other
MILMTAAITPTNRLVRASDLITSRWLQITWPIFIDNESGCLPAXGITRKWKFEEILVTKFCSDSFSALPQECTXSSRFYSLE

SEQ ID NO: 10099 - DNA, 713 bp, Zea mays
  misc_feature: Ceres CLONE 660732-R
ggagctcccctcggtggcggccgctctagaactagtggatcccccgggctgcaggaatttttttttttttttttttttgaatcataatttcttaataagatccagatccttccccataaatgcaatccataatcagaaacagatctttacattcataagctggactacatgttagattatttccggcactgcggtcgataatgtacactacaggcaatctaatctagtaatctacagtaatcaagatcagtgtgctgagcccaaaatgcatctctccttagactgaactgcgtcagccacagcagagcatctagctgaagcagtgaagccaacaccccaggaatatgcagactgcagtaggtagtctcataggtaacacagccagcagaagagatttttctcgaaagaccaacccgcgcagaagagataaatcgatagctcactctcatgtcgaggcctgatgcgtagtgtgagatcaaactcattttctacttcgccgatctgatcttgttttagattcatcatttcatcagcatcagaagatcaattattcccctttcttttctttcgcttctttgaggtgttggagacaacattggttgctggtgcagcaggtggtgctacaggagctaccgctggtgggactgcaggggggaaaggtggaaacaccaagggatgccggtgcattggtactaaaaacattcctcggccac

SEQ ID NO: 10100 - DNA, 571 bp, Zea mays
  misc_feature: Ceres CLONE 677118-R
  misc_feature: Encodes the peptide sequence at SEQ ID NO. 10101
accgattatagacgtaacttagaagaacaagtcgacctgaaactacttccccaaagcatttccatatgcgagtagcaaaaaagaaataacaggctcagttagttctataataacaaaatggctccccccgacctctgctcctcaaacaaaacagtcagctcgagctaggcgtttgcacccagctcaaccctcccaggatggccatggccgcctgcctgtgcacctccaccatggttgttgtaataagagttgcgaccaccccggcctctgttgttgtagttcctcggctggtagtatccagattcgtagtacccaccgcctccgccacggccattctggtatccaccgccacctcggccattctggtacccacgcactccacgaccattaggatagcccctcctgccgccaccacgaccgccgccactacgctggttctggtaagagcgccgctgggtgaattgatggtctttttgttcctgatcggccacataatcgccagatggctcctgctctgcctcagctgaaggaacttcatgagctgggagtcaccagggcctcatgatccact

SEQ ID NO: 10101 - protein, 109 aa, Zea mays
  misc_feature: Ceres CLONE 677118-R
MAMAACLCTSTMVVVIRVATTPASVVVVPRLVVSRFVVPTASATAILVSTATSAILVPTHSTTIRIAPPAATTTAATTLVLVRAPLGELMVFLFLIGHIIARWLLLCLS

SEQ ID NO: 10102 - DNA, 671 bp, Zea mays
  misc_feature: Ceres CLONE 679787
  misc_feature: Encodes the peptide sequence at SEQ ID NO. 10103
ggcaagcaagggaaggagacagagaaacacatggcagcagcagcagtgaagtcgtcggccgggatggcggggaagaagtcccggaagccgtacgtggtgagcaggccgcgggagaagtggaccgccgacgagcacggccgcttcctccacgcgctgctgctgttcggccgcgactggaagagggtccaggcgttcgtcgccaccaagacgggcacgcagatacgcagccacgcccagaaacacttcctcagagcggacaagaagctgggcctcgccgtgccgccgcggcaccctcaccgctctgccgccggttgcccggcctggtgcgccgacgatggtggtaccctggcgccggacgtcgagacggttcagttccccctgtctccggacgacctgcgcctcgctcaggtgtacaggttcgtgggcgacgtcttgggctctagcgtcgaggcgcagctgcacaggctgctgggcgcggaccctgtcgtcgtggacaccgtcctacgggtgctggccaacctccaagacaacttggacattttgtaactgctgcttgaaagaatcacaagtaactgtctgaataattcttgaaacagacggtcgcttaatcttctgtagagcggcagcaaatctgacaatcagcattatctactaaaaaaaaaaaaaaaaaa

SEQ ID NO: 10103 - protein, 171 aa, Zea mays
  misc_feature: Ceres CLONE 679787
  misc_feature (27)..(72): Pfam Name: Myb_DNA-binding Pfam Description: Myb-like DNA-binding domain
MAAAAVKSSAGMAGKKSRKPYVVSRPREKWTADEHGRFLHALLLFGRDWKRVQAFVATKTGTQIRSHAQKHFLRADKKLGLAVPPRHPHRSAAGCPAWCADDGGTLAPDVETVQFPLSPDDLRLAQVYRFVGDVLGSSVEAQLHRLLGADPVVVDTVLRVLANLQDNLDIL

SEQ ID NO: 10104 - DNA, 828 bp, Zea mays
  misc_feature: Ceres CLONE 687129-R
  misc_feature: Pfam Name: V-ATPase_G Pfam Description: Vacuolar (H+)-ATPase G subunit
  misc_feature: SWISSPROT Homolog: EC 3.6.3.14 H(+)-transporting two-sector ATPase
  misc_feature: SWISSPROT Homolog: EC 3.2.1.23 Beta-galactosidase
ccatataaaacatattatttaattttttcattatccaaatgatggcaagtgctggtagtaacagtcacggctgccgctaaagctgctgcggcttattccgtagttaaaaaaataattgctggtacaaggagaatattattattcctcacctgttctgacaataataaatacaccgatgagcataggttggcagcactacttctcagttcttcacggtgatgacatgcctaagaagcagatggatgacatctgagaagatgcttgcctgctgctggatgagctgtactattgtcgccgttgtctcttcctcaagacggttgatcttcccacaagagtcaccgctgctctctgcgatcttccgctggaactcagcctccatctgggcacagtattctattatttccctcgctgcctcctctttctctcgacgacgccttgatgacttaactattgaacagaggaaaccttcatggctgccaacaagttttaaaaaacaacatttgtacaccccgggggggggtactacgcagatgactcgagggggcccccgccacccaagtcgccctatggggagtattattacaaatcgctggtcgtcttactacaacgtggcggctgaaaaaacgctgtggctacacaaattaatcgtgtagcagaacatccctctttcagcagctgtcgtaataacgaagagggccgcaacgatcgttcttaccaacagctgcgcctgctgaatggatgatgcaaattgtaggcgataatatgttgtaaaacatcgcaataaattgttaatcagcacctcttttttcaacaagacgacgtaatcga

SEQ ID NO: 10105 - DNA, 639 bp, Zea mays
  misc_feature: Ceres CLONE 687130-R
acagctggagctccccgcggtggcggccgctctagaactagtggatcccccgggctgcaggaattcttttttttttttttttttctttttttttttttttttgaatgccaaagctatacacagacaaatcacttaaccagacaatgtcttgggttcgcgaccactggcaactgaaaacacacatacaacattcaacagaacaacacggatgagagattgccagttacccgcactcctcatttaaagtatcacatgcacaataaatgcattgtctataaaagtaacacatgctacggatgacagttaccctcactactcatagtccggatccaaatcaaagtccgaatcatcacttaactcgaccacttcatcctcaggattgatttgactaatatacagatgtttcttcttatccctggctgtccttctaggttttgctgcagcaactggctcttcagacctaccagacggtggggaagcttcacctatattttcagagcttatagaaacgacaatcgagactctctgtcagattgagccactcttcttgtttaacggagagggcataatattcccgaccttcctctcacgggacaaagaactgctggtgttagccttagtgaccctgaccatcccatc

SEQ ID NO: 10106 - DNA, 808 bp, Zea mays
  misc_feature: Ceres CLONE 687601-R
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (19)..(19): n is a, c, t, g, unknown, or other
  misc_feature (22)..(22): n is a, c, t, g, unknown, or other
  misc_feature (29)..(29): n is a, c, t, g, unknown, or other
  misc_feature (37)..(37): n is a, c, t, g, unknown, or other
  misc_feature (39)..(39): n is a, c, t, g, unknown, or other
ttttnnnnnttgtgttttnggntgtcgcncccccccntntttttctaaactggaactcaccgcggtggcggccgctctagaatagtggatcccccgggctgcaggaattcttttttttttttttttttgatgtaaatacaggcgacattttgtattctttgaagcatccatcactcagtttaccataatatcgggggaagactcaggaactagatagctaatcaaagaaatatgtagaaatatgtcaaaagatagaacaaagaatatcatcagatggttttatgctacttttcacttttcttcttcaggaaaccaccgaatctcttcagcaaaggcttcttatgctgttgcggctgtttagttgatgctctgccactgctctcattagttgagtgcaacccattgctgtcaagacctgtattggggttggttgattccaaatcaacctgcgagtcaccatcatcacccttgttcttagatgaatcacagtcagcaaacttgccgttctcccacattttggcaactaccacaacaggtttatcatcctcttcagtacccccccttctcattatctccttccttggtgtttccatttatcaagggtatcttttacatttaccaagcttggaaagaaagttccttaacccttctccagaagctgcctaattccttttgactggcagggcccccagatccccctgtttttatgttccgggaaatatcattcctctgggggtccaaataagggttcttcctttttcatccgcaaatgttttcaagcgcctgtggatttcaccccacgccaaaa

SEQ ID NO: 10107 - DNA, 859 bp, Zea mays
  misc_feature: Ceres CLONE 688251
  misc_feature: Encodes the peptide sequence at SEQ ID NO. 10108
agggcggaagctgtccagatcgcgtgattccgcatcccgttcgcgagcgcgacacacgctgacagctcacggctgaccttcccgacggcctccagctccatcttgattcttgaggcgaagccccggtgagccaagcccatcggccaaccactagcaatccagctgcttccgcttcaacgctccatggctcgattcagtacggtttcggaatttggctgcgaaggactaactctttcggagggggattttgtctcaggtgcgtaagagtctgccatggccagcgagaataaggtctttgggttcgaggaagtcgccaagcacaacgtcaccaaggactgctggatcatcatcgccggcaaggtgtatgacgtcactccgtttatggatgagcatcctggtggagacgaggttttgctagctgtaaccgggaaagatgctacagctgatttcgaagatattggccacagtgattccgcaagggacatgatggagaagtaccacatcgggcagatagatgcttcaacaatcccagcaaagcgtgctcatgtgcagccccagcaagcacccagccatgcagacaaggataatgacctccccatcaagatcctacagttccttgtgcccattatgatcctgggccttgcatttggtatacggcagtacaccaaatcagagtagtaactattcttagaggcttgcctttggagcctgtcttatggtaatggttcgaataaaaacagttcaataattgcgcattgtatttgtcaggtcgatgttgtctcattagtcacatgctactctgtattatggacatccatgttgaaatgtgcgcttttcccccaaaaaaaaaaaaaaaaaa

SEQ ID NO: 10108 - protein, 134 aa, Zea mays
  misc_feature: Ceres CLONE 688251
  misc_feature (7)..(81): Pfam Name: Cyt-b5 Pfam Description: Cytochrome b5-like Heme/Steroid binding domain
  misc_feature: SWISSPROT Homolog: EC 1.7.1.1 Nitrate reductase (NADH)
MASENKVFGFEEVAKHNVTKDCWIIIAGKVYDVTPFMDEHPGGDEVLLAVTGKDATADFEDIGHSDSARDMMEKYHIGQIDASTIPAKRAHVQPQQAPSHADKDNDLPIKILQFLVPIMILGLAFGIRQYTKSE

SEQ ID NO: 10109 - DNA, 757 bp, Zea mays
  misc_feature: Ceres CLONE 688573-R
  misc_feature (47)..(47): n is a, c, t, g, unknown, or other
  misc_feature (56)..(56): n is a, c, t, g, unknown, or other
taaaaaaataacgatatagggtttaaaaaaactcataacataaaagnaaaaaaatnttcaaaactggaactccccgcggtggcggccgctctagaactagtggatccccccggctgcaggaattctttcttttttttttttttacctaaacccaggctccaaagactctggcctggtgcgattattttactattaaaacatgcacccagatggtagtttcaaacataacatttagcacacggacaatataaaacattacagagttgcaaataaaatcctatgtagcatctaacagctgttgcgacgcctactgcttaatccactagactgggggttaagttacaaaaggaacatctttcaaacaaggtgctaaggttgtccaacagcgatctaaggtgtatatttcaaacaagctctcctttccagctcaaactaaacactggttcacctcaatcatcaagatggcatgtatgtcaacacaacaatctgctcaggcccctcctttatactcaacctgaaacctctcctgcacttgattgagaacctctgaatcatatgaggaacaaaccaaacgttattgcaagtccccttgttaccaaaaacgatccttccacaaacaaaacctaatgcaggtctggtaatcatactaaaatcattgctccatcaaaagggtaacaaacaaacgcttgaaccacgctccaaacgggtcgtgatcccccccgtaccttagacccaaatatcccaaatctatcccgcg

SEQ ID NO: 10110 - DNA, 945 bp, Zea mays
  misc_feature: Ceres CLONE 695550-R
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
ccaccaaaacccccaacacccccccacttcggccccccgtctcaacccccnnnaccattggatgaatatgaactgatgaagatttctcaatgtaactggataaataaagaatatcccaatgaacaaataggacatggtatacaatcaacctgtatgtcagaaaaggagtatctattcacaaggctgaggttcagtattcgaaactgctatctattgctgtatgcctggaacgtgatgcagaagcaccgagcagtactaggcatcctatgacccacatgtatatagaggatatagccacaacgatgtatgaccatgctaccaccaacggccggaggcccaagcgtacaagcaatatgattgcaccattaagaaacgatcccccgacgggataccaaaacaacaaccaatgcttctttccagggtaccatatcctaaggagacctcgagcatccaaccatgagctacagtgaactgcgtaaaagaaaatcatactaatctctccacagcgaagcccgatcctgcggaacaatttcgacaacaaacgcatctatgaatgatggaacaagaaccatcttcgcaaaaaaacttgtcagcatctgcctagaacgccgcatgcccacaccagtcagcaaacttcctccatttgtcctgcaaaaaatggcctcggggacgccgacccacccacacttgtatttcaggaagagtccccacgaacactacttcccccaaatggtgaacgggcatcacaaaacaccccgcgccgatgtattaaaacccccggggatgggacaaaaacccggggggacaaacccctaattaaccctgaccgtggcaacacactaccccacatttcggccaggaagagttctcaatttactcaagagaggacgcggccaaagaatcgccccttttcgccagacacttttgtgtgaaggctccggaagt

SEQ ID NO: 10111 - DNA, 735 bp, Zea mays
  misc_feature: Ceres CLONE 695944
  misc_feature: Encodes the peptide sequence at SEQ ID NO. 10112
atcccatattcccatccggaaaacaaagcagagctgccgctgcaactcctactgtttcttccggccgggcactaccggtcagaacaatggagaacaaatcagcctcctcctcgtgcgtcatcagcccggcggccacgtccaccatgtcatcagccggcggcgagagcagctgggccgtgcacatcgcgaacttcctggcctccatgccgcaagacgacatcgcaacgacggatgatccgcaagcggcggtctctggcggcggcggcagcttctcttcttccttcgattcctttggcgacgcctcctcctttatcacgtctcagctcatgtgcggcggcgacgacgacgagtccctacaggacaccgcctgctcttctgcagctggccaaaagatggctaccatggagagtttcggcttcaagcaaatggcagccatggatggcgcgaaagagtccaacatgccccaccaccacctgcagctcatggccaagtacgtggaagctgtgggttcaaaacagcaggtgactggcgtgggggatcaacaagccatcaacagttcaagtaatagcgagaaggcgctgctgtgtgagagcaacgagctgaggaagagagggctttgcttggtccctatctctatgttgataaactatctcggctgattctttctcatgtataccaccagcagtatattcaatacagcgcgctattatggttcacaaaaaaaaaaaaaaaaaa

SEQ ID NO: 10112 - protein, 190 aa, Zea mays
  misc_feature: Ceres CLONE 695944
MENKSASSSCVISPAATSTMSSAGGESSWAVHIANFLASMPQDDIATTDDPQAAVSGGGGSFSSSFDSFGDASSFITSQLMCGGDDDESLQDTACSSAAGQKMATMESFGFKQMAAMDGAKESNMPHHHLQLMAKYVEAVGSKQQVTGVGDQQAINSSSNSEKALLCESNELRKRGLCLVPISMLINYLG

SEQ ID NO: 10113 - DNA, 645 bp, Zea mays
  misc_feature: Ceres CLONE 697665-R
  misc_feature: Pfam Name: CRS1_YhbY Pfam Description: CRS1 / YhbY domain
ggagctccccgcggtggcggccgctctagaactagtggatcccccgggctgcaggaattcttttttttttttttttttaaaatgaattgcatcttcaacatgtcttgcaacttcaacaactcttaccattttttcgcatgattttcatcaactttacttccattattagagttagcgtccagagtctctcctagagtaccagctacagtagattgctcatatgtctcagcacttcaaaaataatacgttgattttcgtcgtgcttcctcttcatcatgaagtgactttgctaacctttccctctctagtagcgcctttgcaagttatgaggacaagaaatccttcccctttgtagaagactatgaactcattgtttcttgaaagcatcacaacacctattaattttttaatatctttgacatcctctcacttgtggtaagctatactcctctcttcaaagcaattttagcaatagaacttttctcccacaactttactatagcattagctaagccttggagttgtctgcttcatccatatcaaaatgaggaagcagacaccgggcaagacaatgtaaattggtagttccccttcagccaaaagatggtcgaacaccatacgacagaactctgaaagggggctttt

SEQ ID NO: 10114 - DNA, 1092 bp, Zea mays
  misc_feature: Ceres CLONE 697854
  misc_feature: Encodes the peptide sequence at SEQ ID NO. 10115
acaccaccaccaccggcagcaagaaaaaacattctttgtcctcttctcctccgctccccatttctcttgctagggtttctacccctccatatcctcgctccacggtcatggcgaagacgaagcagggaaataaggacgtggattcgtacaccatcggcggcaccaacaaggtcgtctatgtgggagactgcgtgctgatgcgggcgtcggactcggacaaccagccgtatgtggcgcgggtggagaagatggagggcgacgggcgtggcagcgtgcgggtgcaggtgcggtggtactaccgccccgaggagtccaagggcggccgccggcagttccacggcgccaaggagctattcctctccgaccatttcgacctgcagagcgcccacacaattgaggggaagtgtgttgtccactctttcaagaactataccaggcttgacaatgttgggcctgaggacttcttctgccgattcgagtacaaggcggccaccggttcgttcacccctgaccgcgtggcagtgtattgcaaatgtgagatgccgtacaaccccgatgacctcatggtgcagtgcgatgcttgcaagcactggttccatccatcttgtgtggctatgaccattgaacaggccaaaaagctagatcactttgtttgctcagactgtttcaaagaaaatggttcaaagagactttcaaatgcatatgccacttcaccaaattttgagcctaaggctgaaccaaaaaggcagaggaggtaacaaactgtgagtggtaacatccatatgggtaaggggagatgtgctgcttctgtggtgaatcagcccttgccctttgctgtggtgagagcagaggtgtacagtgtactagaccagtgtttgctgttaggggaacgggttttgttcgatgtgtagaccgtgtggcatggcatgcagttgttggtagaggtcaaaagaacagtcgttgtgttcacttggtcagcttagcgccttagcccttgttaatgtgttaatgcactgtgttaactcagcgagccccccttgtggctgataatgcaagtcatgcagttgttgatacaaaaaaaaaaaaaaaaaa

SEQ ID NO: 10115 - protein, 216 aa, Zea mays
  misc_feature: Ceres CLONE 697854
  misc_feature (21)..(136): Pfam Name: BAH Pfam Description: BAH domain
  misc_feature (140)..(189): Pfam Name: PHD Pfam Description: PHD-finger
MAKTKQGNKDVDSYTIGGTNKVVYVGDCVLMRASDSDNQPYVARVEKMEGDGRGSVRVQVRWYYRPEESKGGRRQFHGAKELFLSDHFDLQSAHTIEGKCVVHSFKNYTRLDNVGPEDFFCRFEYKAATGSFTPDRVAVYCKCEMPYNPDDLMVQCDACKHWFHPSCVAMTIEQAKKLDHFVCSDCFKENGSKRLSNAYATSPNFEPKAEPKRQRR

SEQ ID NO: 10116 - DNA, 926 bp, Zea mays
  misc_feature: Ceres CLONE 697985
  misc_feature: Encodes the peptide sequence at SEQ ID NO. 10117
accagctcgccatagttgattcatacacaatacaagcatcctctctactactgaagagatcaaattccattcagggtagatagaaatggcatcctccagcttttatcttctcagcgttcttctcatcgtgatcgcttctggcgcctgggctacggatcctagtcctctccaggacttctgcgttgcagacaaagaatcgcctgtacttgtcaatgggtttgcctgcaaggatgctaaggatgtcaaggtcgacgacttcttcctagcagccgacctcgacaagccaagggatacgacgatgagcaaggtcaagtcaaatgtcacattgatcaatgtgatgaagctggccggcctaaacaccttgggcatctccatggctagaattgactatgcccctcaaggacagaacccaccacatacgcatccccgtgccactgagatcttaactgttcttgaaggatcactctatgttggttttgtcacttctaacccagacaacaaattcattagcaagctactcaacaagggagatgttttcgtgttcccacaaggtctaatccactttcagttcaatccaagtcatgacaagccagcggttgccattgccgcactcaacagccaaaaccctggtgccattaccatttctaacgcagtatttggatcgaaaccaccaatcgcggacgacgttcttgccaaggcatttcaggtggacaagaaggttgtggattggctccaagctcagttttgggaggacaaccataactaagtgaagaggctattgcccttgtttttacacaccgatgtaataagtaacaccactgttttcattcatttgtttgatgtagcaaactactatataccttttgccatacatatattatgttaaaatgtcaaatgaccacagttacaaaaaaaaaaaaaaaaaa

SEQ ID NO: 10117 - protein, 226 aa, Zea mays
  misc_feature: Ceres CLONE 697985
  misc_feature (62)..(214): Pfam Name: Cupin_1 Pfam Description: Cupin
  misc_feature: SWISSPROT Homolog: EC 1.15.1.1 Superoxide dismutase
MASSSFYLLSVLLIVIASGAWATDPSPLQDFCVADKESPVLVNGFACKDAKDVKVDDFFLAADLDKPRDTTMSKVKSNVTLINVMKLAGLNTLGISMARIDYAPQGQNPPHTHPRATEILTVLEGSLYVGFVTSNPDNKFISKLLNKGDVFVFPQGLIHFQFNPSHDKPAVAIAALNSQNPGAITISNAVFGSKPPIADDVLAKAFQVDKKVVDWLQAQFWEDNHN

SEQ ID NO: 10118 - DNA, 967 bp, Zea mays
  misc_feature: Ceres CLONE 701790
  misc_feature: Encodes the peptide sequence at SEQ ID NO. 10119
ggtgttgccaaatatgaacgacagtgtccccaccccacccacttcttctcgagaagaagctcaccaatgcatgccgggcagggaattcatcaggaggagaacatacttgaacagaaggtttcgacatgagcaggccggagcagctagctaatagagggagatgagggggtaagtgttctctgacggacgttctggcgcatgtgcctttgacggacggtggacaggtttgtaaaacacgacgcgacactcatgatccttatcatgttgattggcttgggcttggcttgcatctccagttctccgcaccacagatctaagattattctctgcactgctggctagcctgacctgacctgacctgacagctactgtgcagtcatgtctttgttgtttgagcggtaatctctgccgggcaatcctatgtacagctccgtctccacgtccatcccgacatccttcggccccgtgtgatcgatggctsccggcgctggaggcggcggaggagccatcagcataggcggcggcggcggcggctgcttcttgcactgcacgcatggcttggatcaggattataccatatgcgtgcatcatgatgttgcagaaatggggagactgtatgcacataagatatcacagcacaggaagtcgagattcatctcctgtttggtggttgacgcaacaaggcacaagttaggatgtattctgatgtttcaatgcccgatgtagcctgtaggacacgaagctgacttaccttctccttcagcttatggagttgctcctccagcagctgagtctgccatgtacgtaagaccagatacgcatatgtatgtatgcagctttcaattcatttgttaaaacatcatacatatactgtatgcataaaacgacatgaggaaagtaactaacctttcttcccctgatgcaatgaaggctcttttcgagtttcaccaaaaaaaaaaaaaaaaaa

SEQ ID NO: 10119 - protein, 83 aa, Zea mays
  misc_feature: Ceres CLONE 701790
  misc_feature (3)..(3): Xaa is any aa, unknown, or other
MAXGAGGGGGAISIGGGGGGCFLHCTHGLDQDYTICVHHDVAEMGRLYAHKISQHRKSRFISCLVVDATRHKLGCILMFQCPM

SEQ ID NO: 10120 - DNA, 931 bp, Zea mays
  misc_feature: Ceres CLONE 705570
  misc_feature: Encodes the peptide sequence at SEQ ID NO. 10121
  misc_feature (531)..(531): n is a, c, t, g, unknown, or other
gacggcagcaaaagcacaaacgcgcacgctcatacgcaaaccacacaacccatggaagcgtcccttgccgccgccgccgtcggcttgttccctccaccgcgaatccgcatccgaatcaccaaatcgagtcccctcccacgccatcggtgcctccaatccggaccctccaagatctggacctccggttcgcgggcatgcctggtcgcggcctccgcgtccacaccgccggcgccgggaggcggcctctactcggcggcgacgtacgagctgaccccggaaaacgtcgaccgcgtcctggacgacgtccggccgtacctcatctctgacgggggcaacgtcaccgtcgttgccgtcgaggacggtgtcatctccctcaagctcgaaggagcttgcggcagctgccccagctcgacgacgacgatgaatatgggcatcgagcgtgtgctcaaggagaagttcggcgacgctttcaaggaaatccgtcaggtgttcgacggggaccagccggcggcggaracaacggccgaggcngtgaaccggcacctggacatactgcggccagcgatcgcgaahtacggcgggagcgtggatgtgttgsccgtcgatggcgaggactgcctggtgaggtacgacgggccggaatccatcggcagcggtatcaaggcggccatcaaggagaaattcccggacatcaccagtgtggkgtttaccctgtaaaacaccgactggggctatgcatattcggggcagtccacagcaaatgaacatgctgatcgaacttcatacttgtaatttgcaaagatttttgtgttgtgggcgggcgtytcatccttgcatttgcgatggtgcggtaattgcacatytactcagtgcggatgtttcccttcccgtcacctgaattcagttgattagcaaaaaaaaaaaaaaaaaa

SEQ ID NO: 10121 - protein, 221 aa, Zea mays
  misc_feature: Ceres CLONE 705570
  misc_feature (78)..(146): Pfam Name: NifU Pfam Description: NifU-like domain
  misc_feature (155)..(155): Xaa is any aa, unknown, or other
  misc_feature (160)..(160): Xaa is any aa, unknown, or other
  misc_feature (174)..(174): Xaa is any aa, unknown, or other
  misc_feature (183)..(183): Xaa is any aa, unknown, or other
  misc_feature (218)..(218): Xaa is any aa, unknown, or other
MEASLAAAAVGLFPPPRIRIRITKSSPLPRHRCLQSGPSKIWTSGSRACLVAASASTPPAPGGGLYSAATYELTPENVDRVLDDVRPYLISDGGNVTVVAVEDGVISLKLEGACGSCPSSTTTMNMGIERVLKEKFGDAFKEIRQVFDGDQPAAXTTAEXVNRHLDILRPAIAXYGGSVDVLXVDGEDCLVRYDGPESIGSGIKAAIKEKFPDITSVXFTL

SEQ ID NO: 10122 - DNA, 889 bp, Zea mays
  misc_feature: Ceres CLONE 705572-R
  misc_feature: Pfam Name: DUF1950 Pfam Description: Domain of unknown function(DUF1950)
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (340)..(340): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaactgggactccccgcggtggcggccgctctagaactagtggatcccccgggctgcaggaattcttttttttttttttttttcgcatcactagattggcacttgctattttagcaaatcaaagtgtgcaggcttacaccatggaaacaccaaaaccccccaactcataacggttgctactccagctttacggacgcaaacacgggatctacgtaagcatgatacaagggatctgaagcccnagaggctagccagtgctggccagaagtggtcagcctatggacctcttcaatggccccaaccaaggtctcaactcttgcaagggtggatgaaaaccgtccaaaaccccgtggttcataaatcgtttcccaaacctttggccggggcccactttttttaaaaaggcactttggtaaaggtaatatgcaagggggtttttctaaaaaaatggtcttttacaaaaatccgggggaagttcccccccccccccaaggggaaaaggggggtttttaccaaaaaacccccctttaaacccgggaaaacccccgaaaggggggcccccccgggaaatggggggaaaaaaaaattttttgccccccccccctctgaaaaaaaaaaaaacccttttttttgtcctccaaaaaaaaacactttttttttagaaaaaatattattggccccccccccaaagagaggtttttcataaaaagattttttttccttccctcccccccgcgggtttttttttttaaaaaaaaacacaaacacccccggggggggtgggattcttc

SEQ ID NO: 10123 - DNA, 839 bp, Zea mays
  misc_feature: Ceres CLONE 705688-R
  misc_feature: Translation starting site: 61
tgatgggcccccccagcacgcaccgccccgcggcagactaaaaatcgcgccgggcaaagaatggagctcaccccgggtgggggcggctctagaactaggggatccaccggaatgcaggaattctttttttttttttttttcgggaaatttaataaacttcattgacaacggtaagcttagatagttggccgaccataaaggaccaagcagacaatgtaactcacataaaaaaaatatgcgaaacattgcaatgtttagacaaacaagacctcctagaccctcgaggggattccgacatctagcctgcgtagccatatctagagatcttccagaccctgacaaacccctcggcgcacccagggtaaagggggctaccatcagcgctccaactcaagctggggcaataaaggatatggcgccgtggagatctgcccgacagggtaggagagccaggaagaacggggtttggcagccaacggccccaaatcttcacaccgagccaagggggaaaaacggaagacccagacaaacgttagagtcgacaaaacccgaggccagggggatcgatgcggaacccccaatctccagaaaagaaaaagccattcgtcccccgcacagaacaaaattgccaacccaaagacgtaacctccgttctttcccccgtgcggagggcgtcaaaaacgcaaaccaatcgggggttatacacggaagcacgcgggtcaagacgataattttataaagggacccccccgagaaggagcgagatgtacacctttgagaagcgtgccggaccgcggtacgtaaaaccgctgcgcgcgggaggagaccaccccaacaaa

SEQ ID NO: 10124 - DNA, 786 bp, Zea mays
  misc_feature: Ceres CLONE 705933-R
  misc_feature: Pfam Name: Remorin_C Pfam Description: Remorin, C-terminal region
tttttccgttcggtctgtactgccccctgatttgggttaatgcacaatttccaagaaagctactcaacacgcaggatgaatatcagctcaatccggattctgactagcatgaagctcgtgaaacgaaactgatttaccgggtgtacagagtcatcgtcgcaggctatacagcatacaatagtagtccacaccattagctacatgagtggatttagctcgatgactttctttgtctgctgctccataataatatcttgttcatcagattgtgcaaatcgcattgacaattaggccatgtagtcaaaatccaactgacttcacatcaataactgttgcctgagaagagctcttgagaaagatagacacttctttgtctgctgctccataataatatcttgttcatcagattgtgcatatctcattgacaattaggccatgtagtcaaaatccaactgacttcacatccataactgttgccgcatagaactatatccattgctgaatccagtggcaccagctgtgccacaactagcaagcacggtaggtaaagcagcagctgaaaggcttgccagttttgacaaggaaagatgtcttcttggttgtcctcgcaccacaatgaacttcactataagaaactacacttcgcatgtcatgtgctttcttctgagcagagcggagtttgcctagaattctgtccattgacgatgatcttttcttttcaagtttcatctccagcttttcaaaggcagcctctgcttttgctttctgtaaattttcccaagcaga

SEQ ID NO: 10125 - DNA, 876 bp, Zea mays
  misc_feature: Ceres CLONE 705963-R
acccgcggtggcggccgctctagaactagtggatcccccgggctgcaggaattctttttagatttttttttctaatttttttttttaaaatttttttattttttttgttttttttagaaatgaactgtgtattctctcttctgcaaccgaagacgactcgatggaagggcccgcctcctggaatgaaaactaacctttttacttcctgacggaccgcatggcgctgcggctccttcttttataagggcccccccccggtaaatacccgccttttgaaggtgataactttggggatctttaaaaaacaaactcccgtgaaggtttacgccacacaccttgtgtggggtgcaggaatgtttccccttctcctcttcaagaaaagggcgggggaagctatacattcgaagccttttttgttggacagtccagcctactgggggatcacctaagctggctggcgttgtttttcttatagttaaaccaaaatatgtgcctcttttcacgttcgggttttgttcgggggacgatttctctacaggaatttgtaataaaccttcctaacattgatcttattcggcaattgaatgggccactgaagccacttgtatcaatttccccgtgatggtatcatgtgggaaattccaaagggtggctataaagtccattttgaaaaaacacaaatttgacagcttggttcttatttggggagggtggtaaaatccaggggatgtctctttgtattttccaatcactctttttttgaagatagaatagccgggttcctttattggaaactttcggaattttattgttttacagggccagtaaataagccaagtggggaaacccttttttttaataaacccttttgggaaa

SEQ ID NO: 10126 - DNA, 974 bp, Zea mays
  misc_feature: Ceres CLONE 706019
  misc_feature: Encodes the peptide sequence at SEQ ID NO. 10127
gctagaccgcctactctccccatccctcgccgcctcgcttcaccccacctatggtcgccgctgctcgcatcgccctgcggcccccacctctctctccctttctcctcgcaacgccgcccccgtttgtccaccaagtcaccacgcgcctgggagatggatcaaggggcgcgcagcagtccggtcaagacacgctcaacgaaagcttcaagatagcacgggagatggaagccccaccatcggctaggaatcgttgcatcacgtcatccgattcctctcccttccgttcctttgctttcgtggtggatgagaagaaagcggcgaagggcgcatcggaaaagagagcctggaggaggaggcacaccatccttcctcttgcacacggagtcctcaagctttctcctcaccttgctggaattccgggtgccatacatcatctctgtcggcaggcatgttgcccttctgcctcgctcgcagttcttccaagggctgcccgtctgtgtggtctggtttggtttggtgatgctaataccccttttgttagttcgtcacctcccaacctgctacacgaagggataaaatttcattcccaagctgctaaatggggcataagtggtttcatctcagaataaaaaacgagtgctgctggagtattatgatgcctttctaggcacatggtcttattctacgggctacctgctatgggatttgactaaaacacacatttaccttgcttgtggtgagctctttggtgggaaacgtttgatgaagccatgtttccatgtttagagaatcacatcacagtcggacctggaactctggaagagaatacctaagggctagcaggatcaacaattgattacatggtttctgtaattttttgtactgaactgaatttaagcatttatgttatattataaagttcaatttagaaggtaaaaacaaaattgttttgtgctaaaaaaaaaaaaaaaaaa

SEQ ID NO: 10127 - protein, 192 aa, Zea mays
  misc_feature: Ceres CLONE 706019
MVAAARIALRPPPLSPFLLATPPPFVHQVTTRLGDGSRGAQQSGQDTLNESFKIAREMEAPPSARNRCITSSDSSPFRSFAFVVDEKKAAKGASEKRAWRRRHTILPLAHGVLKLSPHLAGIPGAIHHLCRQACCPSASLAVLPRAARLCGLVWFGDANTPFVSSSPPNLLHEGIKFHSQAAKWGISGFISE

SEQ ID NO: 10128 - DNA, 649 bp, Zea mays
  misc_feature: Ceres CLONE 706522-R
aaagctggagctccccgcggtggcggccgctctagaactagtggatcccccgggctgcaggaattcttttttttttttttttttaagtatacacaacacgagccttaactaatgaattacatgatgttggggagcggggagaaaatgggcagggtccacatataaggcacatgaaacattatgtaaacattcaaaacttcacagcccagataagcatgtcaactatattcatcaactctacaagctacagccgattttagacagaaacatacacaacgacatttcttctgtcaccaatatgaagatagcctcaatgcccaaatcaaaaccctaagcatgagagaaggtaacctcttacaaaggtttgaagatgtacacattgacaatcgtcatcgccaagaatagaggcaagcatctcttactaaagtaaatccaggataggttgttgtcctgatgacgagttcgaatgaggaggccttgatgctcgggagagtgctgattgtccttgatttctaccacgccctcttccaactgaagtagatggaggaggggcaagtctgggtgggccatttgcggcattattggccgacatggacagtgatccaaaatcagattttggttgcatcatgctcaggcctgtactggaact

SEQ ID NO: 10129 - DNA, 669 bp, Zea mays
  misc_feature: Ceres CLONE 865397-R
  misc_feature: Pfam Name: TraB Pfam Description: TraB family
caattgggtaccgggccccccctcgaggtcgacggtatcgataagcttttttttttttttttttctcaaaatctattgcttttcgcccggcatatatatacaaatataaagtgtgctacacaaaatgcatcttctttttttttgcccaaatatgaaatggcaaaaaagtagaaaaatacaggtagtgttttgttgtcctgtgtagatgtattcagaagataaaaacagcacttgacagttcatgtacaggtactttaatcaagtcatcaaccttgtgaagaacagggactgtatcaagttcatgtacaggcacttcgatcaagttttagatttccgctggtaccggatctcagttccactgtttcagcttgtaagaagttgagagcagtacctagtttgtgtgccttgtggaagtctgaaccatctacagcacagcctgcagctgttcatacagagcccaaaggaccagaccaattacagtgtcccttaccaggcccttgacgagtgagctgacccatgtatcagatgatgctctaccaacaaggtctcggaacctcagatccccctggtcagagatcagcgcgtacacgatgccattgatgtgccccttccctacaactccgacgacagttctgctcttgttcacagccttgctcctcttcagcgaca

SEQ ID NO: 10130 - DNA, 631 bp, Zea mays
  misc_feature: Ceres CLONE 865643-R
  misc_feature (631)..(631): n is a, c, t, g, unknown, or other
tgagtaccgggccccccctcgaggtcgacggtatcgataagcttttttttgtttttttttctttttttttttttttttttttttttttttagccatgcagtaaaaatattttggtacttttctcacaaagacataaatacctaaagttgtataatctgacatgacaagtaacataacccataagaaaagttgaacagaaatatgtccccgctccccgcaagccaaacacgtgcttcctctccttcaacacaagtagagtccatcccatctagatctagtcgagcctgataacaccgtacgattccatcggtgctgcagtggcgttctgcgcagcggggacgaacatgaagagtgagatcgacctgaatgcgtcttatgatcatagaacttcgaaccacctacaataaagtgtgaaaaaatatagaataaaatgaaacaaaaaacgaggtaaatgcatgtagttcttttttgaacacacacctcctttgttttgttttctttcgtttacttaaaatataacatgactttgcccccctctgtagcctaaaggagctgcaaataataactacttggtttaatgtgttcttgctttgttaagctctgttctttattatggtgtagtgtgacattn

SEQ ID NO: 10131 - DNA, 648 bp, Zea mays
  misc_feature: Ceres CLONE 865692-R
  misc_feature (648)..(648): n is a, c, t, g, unknown, or other
cgattgggtaccgggccccccctcgaggtcgacggtatcgataagcttttttttttttttttttagatcgaatgtatctctcagcgcatgaggttgtcataaaacacatcaagaaatttcgtaaattggtgtaagatacaacaagaagtgatctgaggtaattgtagcgtaaaatgcaagctaaccatctacatgagaactgtttcagattttacaatatgatatcagagataattattcctgttcatgttgcccttatattttgtgtagagttccttcaaatccgttttctcagaatctgaccctctatatttagcttcaaattcttcaaagtcagcctccatgactttcttgtacattgttctgaagtactcctgaagattgtttgcagcttctcccaccaatgcatcatcatcagtgatgctagtcatatcatataaagctcttttctctgcatctccaagaatggatataaccttctgcagctgctgaaacttctctttggcttcctcatccccaggattcttatctgggtggaggcgcagagccaatttgtgatacaccttctttatttcttgttgagaagcggtcttctcaactcctagaatccccaaagcaggacaccaaatatatctattgagcgagatn

SEQ ID NO: 10132 - DNA, 596 bp, Zea mays
  misc_feature: Ceres CLONE 870739-R
  misc_feature: Pfam Name: Zein Pfam Description: Zein seed storage protein
agtttattatttatatgatggaatagttcagaattcatcgagataaatctcaatcaatatattgattacttctaggaaacacatgccggtatgagggcaccattatcgagtacatctcatatgtaatctaaaagatggcacctccaacgatgggttgctgcctcgacaagacatggttcatcaaagagaactggttgtatggcagcaattgttgctgctgttggaaggcaacgaccaatgggttagccactgccaatggattaagtaagtgttgtcgatgttgtaggtacgtagcagagttcgacacagtcagttggttgaatggaagcagctgttgcaagtagacagcagggtttgccatagctagctgagtcagagctggtacaatatgttgcaacaattgttgttgcaggtatgtaggtgcattggccatagcgagcgggctagatgaaagcagttgttgctgttgtaggtaggcggcagggttcaccatggctagttgactgagcactggcagaaactattgcagttgttgttgttgctggtttgcaactacatttgccagagcaattgggttggatgcaagcagttgttgt

SEQ ID NO: 10133 - DNA, 730 bp, Zea mays
  misc_feature: Ceres CLONE 870761
  misc_feature: Encodes the peptide sequence at SEQ ID NO. 10134
tttgaaatgggtgatcatcggccacctcctgtacattcgatggaatatatgggtgctgatagaatgccatacttgtatggtgttgaacaaggaggtcctcgcccttttctagaacagccttcgccaagaacctgccctcctgaggcaccaaggacaaacagtgaagttcccagaaacatgtctgatgcagtgccagctacagatttcagaaagggaccagtggcaattgaaaaccaagtggctacaccaacaggcacaactgaagttatcattccttgcaattatataggctttgtctgtggaaacaatggcagtgaaattgaagaaatagagaagatgtcaggtgcttcaattacagttcatgatcctaaagctggcgacgcaaactcaaaagttgttatatgcggggatcccgaagaaacaaagaaggcacagagcctgattcatgccttcatattctgtggtctgtatcaaacataattgatgacttgatcactgtgcagtaccatcgtcgtttatgttcttgaatctagagtagttcccatgggcagatttcagcccttgattggatgtacatgtaccgtcgctaccggggtggatgtaggtagggctgatgcatgccttgtacaaacaacgccgatgtacatttctgtagtcctgtgttttagtttgggggaatggcaccaaaaaaaaaaaaaaaaaaaaaaaaaaaagaaaaaaaaaaaaaaaa

SEQ ID NO: 10134 - protein, 157 aa, Zea mays
  misc_feature: Ceres CLONE 870761
  misc_feature (84)..(146): Pfam Name: KH_1 Pfam Description: KH domain
MGDHRPPPVHSMEYMGADRMPYLYGVEQGGPRPFLEQPSPRTCPPEAPRTNSEVPRNMSDAVPATDFRKGPVAIENQVATPTGTTEVIIPCNYIGFVCGNNGSEIEEIEKMSGASITVHDPKAGDANSKVVICGDPEETKKAQSLIHAFIFCGLYQT

SEQ ID NO: 10135 - DNA, 660 bp, Zea mays
  misc_feature: Ceres CLONE 894609-R
  misc_feature (660)..(660): n is a, c, t, g, unknown, or other
tcgaggtcgacggtatcgataagcttttttttttttttttttgcatgcatgaaacattaattctgctcatgatctaccacgacacacaccaattgattcacgcatgcaagctgttttttttattctgaatattccgaggagcggggacgacgactacgtcctgctgctcctgcatgcatgtagtcctctacgcaggacggcggtcggcgcatctctgcgcgggatcctactcctctctgggcggacgggctggcaattaggcgctcataaacaacggctgacagtgcggttccgaccatgtttccccgacggtagctccatgggcgtctccaactacggtagcacatgactttggcttccaacgcgcgcgccggatcatcagtgtggcctacttcaccacgctggccaagacgtctcttcccggcctggagagctatacgcaatggtgtaccacatgcattggtggagctccatcgtctcctctccagagtcccctagctggaggtcttgttccttgggcatttcttaaggccacattgaaatgatcctctcctggtctgcccccacaccgtaggcgaatcacgtctaagtcccgccacctcgcagggacttagcctgaccgcctgggggataatccttcgggcccgcctgttcatcttn

SEQ ID NO: 10136 - DNA, 784 bp, Zea mays
  misc_feature: Ceres CLONE 894631-R
  misc_feature: Encodes the peptide sequence at SEQ ID NO. 10137
  misc_feature (764)..(764): n is a, c, t, g, unknown, or other
ccgattgggtaccgggccccccctcgaggtcgacggtatcgataagcttttttttttttttttttatcaacactgcaatgtccacttaatatcaccatcacataatatcatgtaatattcaacgaagctaatccatccatcatcacatcacataatatcattatctccattcacacgtacagatagacattataatataaaaatagagtattaggaagtttggcagtagaataagacatctaaaacatgcacaccacgtgtcaacttaatgcgttttagtttcatgccagcttccttctccatatctgcttcatgtggtgcttccacttaacacactaattttcctcttcaaccaaagtaatctagcattgtgggttttttgacctcataaacaccttcccggtttatcgcaaaattcaaagaactcccattgggaaatggaacataccccctctggggaacccctcaattttttttccaattggggtaagacctttttccaaaaaaacatttttaaaaaaccctaaagagtttttgggaggggggcccccccttaaaaaacccaaaaaaattttaaggggggggcgccaaattgggggttgggggggggttttcccccttttcccccccttaaaaagggggggggagggagggcttttttatatttttttggaaaaaacaaaaaaaaaaaaaaatgtttttttttgtgcgggaaaaaaaaaaaaaaaatttttttttttaaaagaaaccccccgccctcgtgnaagggggggacaaaaaaaat

SEQ ID NO: 10137 - protein, 37 aa, Zea mays
  misc_feature: Ceres CLONE 894631-R
RLGTGPPLEVDGIDKLFFFFFYQHCNVHLISPSHNIM

SEQ ID NO: 10138 - DNA, 2211 bp, Zea mays
  misc_feature: Ceres CLONE 895044
  misc_feature: Encodes the peptide sequence at SEQ ID NO. 10139
tttcccgatttcaaatagctggcccgcggtgcctgcagtgcagcactgcactgcacgcctccgccatactgcgacgccgccgtgcatcgcttcacgcagagcagtgatggaatcccatcacggcggcgacgggaaggcgcgggacaagttctcggtgtaccagaacccgtccctcacccgcgccctagactcccgcagcgcccgcccctccgtcacagtcctcctcgtcctcgcggtcatatccgtcgcctccgcatcctccttcctcgccctcacctcccgggaggagcagctcaccaagctcgccggacgagcgggtatctctgtccttgctgctgtttttgtcattaggttggtggaagcagcactcggtcttgttgcacttttcacactgctggggttcttcagggcactgatgttatacaatgggcagaaggcactggccaaggccgacaaggttgtcttgtctgatcgccaactggggcttcttgggttaaagatggcaggttcagaaggaggtgggaaaggtgagcaaatcaaaaggcctcccaagaccaagccatcaacaccatcggaaccaattgtgcctatcaggaggtcttcgttcagctatacaccatctcggccttcggggcaatctaggattggttccagccatttgagccctggtggtgagagactgatcatggcattgccaatgtcaccctccacaccattgcagaagcatgtctcttctccttcaactccatggtcaaggaaaagctcaggcagtgccaagggcatacagacagaggcaatgctggaccagttcttggctggcttggatgtaaacattgacaaaatcatggatccagagactaagactacaacacctccagcaaccattacaagctttggtgttgctacccctgtttcaattaccacatcgaccaccccttctggtgctgcaaggagcacacctctgagacctgtgaggatgtctcctggctcccatcagaaatacagcacgccaccaaaaaagggtgagggtgaacttccaactccaatgtccttagagcaagcagtggaggcctttgagaacttgggtgtatatcctgagattgagcagtggcgagatagtctcaggcagtggttttcttcagttgtgatgaacccacttgtacaaaaaatcaaaacaagccatactcaggttaagcaaacaacagctactgttggggcttcagttactgttagccaagttggaagtgatctgccaagcacaacaccaccagttgccttgtctcctcttggtgggactaaagattggcaaccgactgtcacggtagatgaggatgggatccttaaccaattgcactctgcactcctacattctcgagatgcccctgttgcgcaaacttttggcagtttacaacagccacaacggaacccccaccttccagctattcaagcatgtattgatgcaatcacagagcatcagaggctcaacactctgatgaagggagagctgataaaaggcttgttgccacagagtagtgtccgtgctgattacactgtccagagagttcaagaactcgctgaaggaacatgcttgaagaattatgattacatgggtcatggaaatgactatggtaaatcagaaaagaaatggaccaccgagctacctactgactcacaccttcttctgtatctgtttgctgctttccttgaacatccaaaatggatgcttcatgttgaccctacctcgtactctggttcccagtccagcaaaaatcccttatttctgggagttcttccaccaaaagagaggttcccagaaaagtatgttgctctgatatcaggtgttccagcaattattcacccaggggctcttatactggctgtgagcaagcagaatcctccaatttttgctctatactgggacaagaagcagcaattttctcttcagggaagaacagctctgtgggatgccattctacttttatgtcaccaaataaacgttgggtatggcggtgtggttagaggaatccatatcggttcgtctgccttgaatctcctgtcagttatagattcagattcagaaagctgaaagttagtttggtagtcttgaggggatgaattatgtcaagctagtttactggtgttaatgttgtaatttacactagcatgtttggaattgacatagctttatctagctgaaaaaaaaaaaaaaaa

SEQ ID NO: 10139 - protein, 659 aa, Zea mays
  misc_feature: Ceres CLONE 895044
MESHHGGDGKARDKFSVYQNPSLTRALDSRSARPSVTVLLVLAVISVASASSFLALTSREEQLTKLAGRAGISVLAAVFVIRLVEAALGLVALFTLLGFFRALMLYNGQKALAKADKVVLSDRQLGLLGLKMAGSEGGGKGEQIKRPPKTKPSTPSEPIVPIRRSSFSYTPSRPSGQSRIGSSHLSPGGERLIMALPMSPSTPLQKHVSSPSTPWSRKSSGSAKGIQTEAMLDQFLAGLDVNIDKIMDPETKTTTPPATITSFGVATPVSITTSTTPSGAARSTPLRPVRMSPGSHQKYSTPPKKGEGELPTPMSLEQAVEAFENLGVYPEIEQWRDSLRQWFSSVVMNPLVQKIKTSHTQVKQTTATVGASVTVSQVGSDLPSTTPPVALSPLGGTKDWQPTVTVDEDGILNQLHSALLHSRDAPVAQTFGSLQQPQRNPHLPAIQACIDAITEHQRLNTLMKGELIKGLLPQSSVRADYTVQRVQELAEGTCLKNYDYMGHGNDYGKSEKKWTTELPTDSHLLLYLFAAFLEHPKWMLHVDPTSYSGSQSSKNPLFLGVLPPKERFPEKYVALISGVPAIIHPGALILAVSKQNPPIFALYWDKKQQFSLQGRTALWDAILLLCHQINVGYGGVVRGIHIGSSALNLLSVIDSDSES

SEQ ID NO: 10140 - DNA, 682 bp, Zea mays
  misc_feature: Ceres CLONE 895348-R
  misc_feature: Translation starting site: 269
  misc_feature: Pfam Name: Put_Phosphatase Pfam Description: Putative Phosphatase
  misc_feature: SWISSPROT Homolog: EC 3.1.3.75 Phosphoethanolamine/phosphocholine phosphatase
tcgaggtcgacggtatcgataagcttttttttttttttttttgccatgtctaatccattattaactttaccttttttagtaagatacaacgagtcgtaaccaattcagcagcaacagactcgatcaggacggatacaccacagacgcacaaaattagtgaaacgctactaacggtacgccgtgcctcgcccggaatttgttggagctctaaccggcgacctcaattctgaaccagagacagtatcagttcttgacgcccagcggcacgatgggcataccgtcctgcgcggcgacgggcatggactcgagcttgcagtcgagcggcggcggcggcggcggctgcagcgcggtgtcctttaagaccgccctccgcacgaggcgcagaatcgtctcctccccctcggtgccgtcggtccaggggtgcacctccgactgcagggcgcgcggggtcctcgcagatgaggtcccagacggggtaacccctgcggggcatcacgaagtctgtgcgcggcagccgcaacgccgggcaataatcgccacggccgtctcccaagaaaatgacgcgcggcttcccggatgatgcggtctcgacctcggcctcggcctcccggaggatgcgatccagcacgaggcctatgaacatgttgggcgggcaagtgcctaccccccccctgtgtggtgc

SEQ ID NO: 10141 - DNA, 624 bp, Zea mays
  misc_feature: Ceres CLONE 895614
  misc_feature: Encodes the peptide sequence at SEQ ID NO. 10142
accaggctgtcagagacacgacacctcacgtccgctgccacctctctccttcgccggtcgccgctccagctgaacttgaaggagaccgacggatcgatggcggccgccgcggcggtatacaggcgggtgctgaaggcggtgcagaagcacgtcggcgggggcgccaccaagcagcatttccgcgacttcgtggcggccgagttccgcgcccccgtcggctcgaaggccgacgctagggccaggctgcggctcgccggagattacgcctacctccttaccagcgtccagcaccacaaggacctgctgttgtcgtacaatatagctgtggaccgatccgacgaaatgaagaagatattgaacaaatccgctgccagtgtaggcctccagctccctgatgtctaccagccatgagggcttcttttcctcacgtatgtgtgatccatgatactgccatttagctatggaatttcattttgtgtcctacattccattttccttgtttccaattctactcttctttcagtaacgagaaatgtcattggtttattaatgatgtcattcaacaatgtatggattctttctactgaagtcaattgccaatttgctgtaaaaaaaaaaaaaaaa

SEQ ID NO: 10142 - protein, 104 aa, Zea mays
  misc_feature: Ceres CLONE 895614
MAAAAAVYRRVLKAVQKHVGGGATKQHFRDFVAAEFRAPVGSKADARARLRLAGDYAYLLTSVQHHKDLLLSYNIAVDRSDEMKKILNKSAASVGLQLPDVYQP

SEQ ID NO: 10143 - DNA, 725 bp, Zea mays
  misc_feature: Ceres CLONE 895848-R
  misc_feature: Pfam Name: tRNA_int_endo Pfam Description: tRNA intron endonuclease, catalytic C-terminal domain
caattgcggaccgggccccccctcgaggtcgacggtatcgataagcttttttttttttttttttcataaattggaagctcttcagataatatttcagcgttgtacacaagtacactgcaaaagaattgtatacgcttaacactacggagccaatagctaaacactacacccccacttgtatgctcttgttcttcaatgcttgaaactgcgatgcaacatttttgtctttgcccagccctgttgggttcatcactacatggcttgtcctgaagctcactgcgctgcagatgggatccatcacacagagcgtcctctcatgaacaatcatctgctccaaacaatcgaaggatcccagctcgcagctctggatgctgatggtaaaaacaatcaaagtcttggcaccaattccagaggcacgaagcgcacatagtatttcaaaccaaaactccgtgcgggcacacctgttttcaattaggatgttctaggtaatgctctcgtgagaattctagcattccggcgaatccaataaatctacagtgcccgccaccgactagaacctccagcttttgttcccattactgagggttaattgcgcgctaggcataatcatgttcacacatgtttcatgtgtgatattgctatccgctcacaattccacacaacatgcaagcccgtaggcctacagcgtacacccagccgcgcctaatgagtgagctaactcatat

SEQ ID NO: 10144 - DNA, 649 bp, Zea mays
  misc_feature: Ceres CLONE 895884-R
  misc_feature: SWISSPROT Homolog: EC 2.7.1.158 Inositol-pentakisphosphate 2-kinase
cctattgggtaccgggccccccctcgaggtcgacggtatcgataagcttttttttttttttttttggtacaaaggacatatctcacatatggtagcctgtgagggaaacttcagccctcattttcaacttgatgttacaatgagtgattgccacggtaagcagttcagttgtctcaactaacgctggacatcttcggaaattactgtgacaagccacggtgtatgcactagtttgagttacaacagcgactgacggacaacacagctccctccctgtgccctttccaggcgttaagggtcgagcctcccaaccttgggactgtactcatgaagttacaacagcagcaccaagcagcaggaacaacaaccaacactccctgatgcacccttctccacatgtatacaggaagagaggctccccattcttggagctgaatcctcgaagtgtctttggtattactgccctttggagatggcaagacctcccccatttcttgtgtagaaattgactatcctctgatccagtttaaaataatgctccatcttatccagaggtttcacatccagatcaaggaaatatgccttgtactcataggttcgcttcgctgattcaagaaacactgaatcatagtcagaatctgtactacca

SEQ ID NO: 10145 - DNA, 1146 bp, Zea mays
  misc_feature: Ceres CLONE 895903
  misc_feature: Encodes the peptide sequence at SEQ ID NO. 10146
accagaacaggcaacgcactactcgttcgtatctttaagcttgctgctgcagcgtaagaaaaagcagtctgcactcggtcggtcggtcgctctgttcagctagctgcatgctcggccaccatatctcctccagtacgttcgtcgttctccacgccgctatctggtctgcggtaagcagcagctagaggccgttgtgtaggctacacagaagatcatcgaggaggatgctggtgaagaagaacaacagcacggcgatggcggcgggcgtgctgccgctggcgtcgctgaaccacatcagcatcgtgtgccggtcggtggaggcgtcgctgcgcttctacgcggacgtgctcggcttcgtgcccatccgccgccccggctccttcgacttcgacggcgcctggctgttcaactacgggatcggcgtccacctactgcagtcggaggaccccggcagcctcccggagaataagggcgagatcaaccccaaggacaaccacatctccttccagtgcgagagcatggtggcggtggagcggcggctcaaggagatgggcatcccgtacgtgcagcgctgcgtggaggagggcggcatcaacgtggaccagatcttcttccacgacccggacgccttcatgatcgaggtctgcaactgcgacaacctccccgtcgtcccgctcgccgccgccgccgaccagcgcgcgcctgccgtcctcggcgcctgcaagcgggccgcggcggcggtcggcgtcaagcagcagcagcagcaaagcagcggcggcgccgtgccttcttccgccgccccggcggcggccgcgcagcgcgtgccgtcggcggcgcaggcgcccatcgtccgcgtcgccgaggagtcgacgtcgcacatttcgtgcgcgtgattcttcatgccaaatggcgaggacggtcagtgtcgtgccggcctgccggatgccgtcaccgcgacggtgaccgcgcgcactgcatgtctgcgtcgagccgtgacgaagcaggcacgatgcgtcgagtcacggcaaaaagcgtctagcgcgtcgtctctgtatatgcgagtgcgtcgtcgtgtagctccatgtgcaagcaaactactgcccttttgtagtaaagaataaaaccatgtgaaaaaaaaaaaaaaaa

SEQ ID NO: 10146 - protein, 222 aa, Zea mays
  misc_feature: Ceres CLONE 895903
  misc_feature (20)..(140): Pfam Name: Glyoxalase Pfam Description: Glyoxalase/Bleomycin resistance protein/Dioxygenase superfamily
MLVKKNNSTAMAAGVLPLASLNHISIVCRSVEASLRFYADVLGFVPIRRPGSFDFDGAWLFNYGIGVHLLQSEDPGSLPENKGEINPKDNHISFQCESMVAVERRLKEMGIPYVQRCVEEGGINVDQIFFHDPDAFMIEVCNCDNLPVVPLAAAADQRAPAVLGACKRAAAAVGVKQQQQQSSGGAVPSSAAPAAAAQRVPSAAQAPIVRVAEESTSHISCA

SEQ ID NO: 10147 - DNA, 671 bp, Zea mays
  misc_feature: Ceres CLONE 895926-R
  misc_feature: Pfam Name: Ldh_1_C Pfam Description: lactate/malate dehydrogenase, alpha/beta C-terminal domain
  misc_feature: SWISSPROT Homolog: EC 1.1.1.37 Malate dehydrogenase
cgattgggtaccgggccccccctcgaggtcgacggtatcgataagcttttttttttttttttttggaagaacaaaactacactaccatttccatcgtcaaccggtacaattgcaagtttttttcaataaatgtcgtgcaagtcatcaggccaaaaaggggctacaagccctcgtagtctcgtacacgctgggcgaagccagcaacacgcctgcacagcgacgtgcagcagttctgagtgagaatctatggacggagctggagtttcttttattcaaaacacagggggtagcaattgctctctgggtgtggtataatttactcgaggcatgagtaagcaagcgacttctcttccgacagctcttgggcagtggcatccatcttcttccttgagagctcgtcgatcgggaggccttggacgattttccattcaccgccactgcatgttactgggaatgagtaaataagtccggaaggaacaccatatgaaccatcggagtacacacccatggaaacaaatgtcccctcaggggttccaagaacccaatcacgaatatggtcacaagcagagctagcagctgagagagcgctggagaactttctcgctttgatgattgcagcaccacgctgttggacagttgtgatgaattcgccattgagccattcatcatca

SEQ ID NO: 10148 - DNA, 676 bp, Zea mays
  misc_feature: Ceres CLONE 896088-R
caattgtgtccgggccccccctcgaggtcgacggtatcgataagcttttttttttttttttttgaaaacaaaccgcactttgcgcatgtagattcccagcacatatgcgcatacccagtaattggggtgtttcgtcagatccagagatacatgtgaaagaaacttttaaagtgtgtcgcatcacatcgattgaaatagagcgccacttgttgacagcgcatatgtggcatctcctaatagaatatctgaaaccgagccttggggccatcacaatcaggagcctttcaaaaccatctccattgacaaggatgcactatgagagtgtcctgccctaacctttaattaattccggcgcgacaaccctgtggcctccccggatcaacatgcatcactgtcggctgctgttgctggtgggcagctggttgctgttgagcattgggctgactcccattggagcccgaaccataccagatacgaccgtggaggcgagcagacccacagccataaccctgcttaccctggcgatgatctccaaagcctcctgccctagcagctgcagctccccattgtttggattcctggtgaggctgactcctcctagttagagggtcttctaaccggcgaaactcttacatcctgcgggccagtagtgcccccctggagccacttaaagcgt

SEQ ID NO: 10149 - DNA, 681 bp, Zea mays
  misc_feature: Ceres CLONE 896143-R
  misc_feature: SWISSPROT Homolog: EC 1.11.1.7 Peroxidase
  misc_feature (363)..(363): n is a, c, t, g, unknown, or other
ctattgggtaccgggccccccctcgaggtcgacggtatcgataagcttttttttttttttttttgcggtgatagacgtgccacttgtcctttattatattaatgatttctggctagagatttccacggagagtaatacgagcgtctacaagagtcttatttgcactcgcgagagtagttttttttctctctcttcaaaatctctatttttagctctataggtagtctctcgaagtatgtggttgcaatagctagtagtgtgggttgacgacgaagcacttttccctgatctctccctcatcgccggtgagcacctgcaccttgcccatcttgaccatgggcttgacgaacctgacctgccacngccttctcgactgcggcgttaaatttggagatccccgggcgtccaggggtttgcccagcagcgtgtttgccggaaacgaaacagggaccttgtggcgccaagccccatttcctgaaaagaactgggttggtccaaaaaggcccccccgccctttacctgggggtccctgggggggaacccccccggggggggggccccactttggggccctccccccttggaaggggggccctgggggggccccccccccccccttttgaagggggccccccgcgggctttttaggggggggggggggtgctaaaaaaagaggaaggg

SEQ ID NO: 10150 - DNA, 672 bp, Zea mays
  misc_feature: Ceres CLONE 896264-R
caattgggtaccgggccccccctcgaggtcgacggtatcgataagcttttttttttttttttttaataagtatcattagtgattatattatcggagtttcagaaataataatcataaattttaatgcagcagaataactaacggagaaaatcgagtaacatggcgaagcctggccatgctactcctcctggtcctctcccgcggaagcagtaaccctctcgaccatctatcccggtggcagggatgaaggccaagtcacaccatcaaccaaatcaaggaggtacctttaatttaacacttaggtagtgtttgctgggggaggtactcgcttggcgagcatctactggtcatgtccatcattcttcaggtcgtccaccaactgcaacttgtgggtggcaccacatcactggctcgatcatcatctctcggtcctgtcaaactcggattcgagtcgcgcatgtcgttcacggtttaggcacttcaccgaatcatgcatcgtgcgaggcgtgacatcgacaagggcatgggtttcgacgacgacgcgcaggcgctacaaatcgggcaacgcacacgacgctgaggggatgtcgaggctgttggatcttgtgacagccatggggagcagcagggcgtgcagcacgagcatagacacgcaaccgcccgtcaaccatt

SEQ ID NO: 10151 - DNA, 650 bp, Zea mays
  misc_feature: Ceres CLONE 896371-R
cgaattgggtaccgggccccccctcgaggtcgacggtatcgataagcttttttttttttttttttgggatgataaactgagtaatttccgacgtggactgatcatacggtacaaagaaataactcattttgaaagagcgcctgttttccgaccaaacagggccaggggcgcccaacctgaacccgatgtctttaaaatctgcaacggacgactaataacaacacaaagcaccagctcctcaagggccatggcgctcgtacagataacgtatatccagctacacaggccacgctgctgatacgatatacgagagggccccgacacgaacccaatgggaccatgtcgaattattgctgcatactgaaaaatgctctagttttcctgggcaccttcaccagcagcagcggcggcggcggcttccttctccttcacagcctccgcggtcgtcgtagtcggcgccttctcggcctcggtggcggcctcgctggttccaggggctgtgcttgcggcgctgctgcggtcttcaacggtgacggtcttcgtgacagtacccaccttcacgtacttgctcatgaacttgtattcccagtcctgcagggcgtcgagctcaaacgggcctaggccagtgatggcgccggtcagatcctgtc

SEQ ID NO: 10152 - DNA, 658 bp, Zea mays
  misc_feature: Ceres CLONE 896688-R
  misc_feature: Encodes the peptide sequence at SEQ ID NO. 10153
cgattgggtaccgggccccccctcgaggtcgacggtatcgataagcttttttttttttttttttattttttttttttttttttttttttttttttttttttttttttttttttttttttttttttttttttttttttttttgaaaaaaaccagggaaaaaaaaaaaaaaagttgatcgtttttacagccatttccccctttattcccccccccggagggaaaacaaaaagggcccccccccccgaaaaaaaaaaagggcccctgatccggggccggggccaaacccccaatgcccgcccccacagcaggggaggggaaccctggccccgggccggggggggccccgaaactgggggaggccacccccccccaggaggggcacatggaaagggggggggcccggaggggcatttgcaaaaaggggggcccccccttgagcgcgcggaactcggctagctccttggggaacccccggttctcccccgtcagggtctcccaaaaacgcttcagggggtcgcaatccacccccggctggttcaacttcctcctggacgcgacgcgggacccccccaggcaccgggtttttattatatttttccattaagaagttctagggaaagggcccgggggaattcctgcaccccgggggaacccctat

SEQ ID NO: 10153 - protein, 151 aa, Zea mays
  misc_feature: Ceres CLONE 896688-R
RLGTGPPLEVDGIDKLFFFFFYFFFFFFFFFFFFFFFFFFFFFFFFFEKNQGKKKKKLIVFTAISPFIPPPGGKTKRAPPPEKKKGPLIRGRGQTPNARPHSRGGEPWPRAGGGPETGGGHPPPGGAHGKGGGPEGHLQKGGPPLERAELG

SEQ ID NO: 10154 - DNA, 658 bp, Zea mays; identical to SEQ ID NO: 10152
  misc_feature: Ceres CLONE 896688-R2
  misc_feature: Pfam Name: HALZ Pfam Description: Homeobox associated leucine zipper

SEQ ID NO: 10155 - DNA, 666 bp, Zea mays
  misc_feature: Ceres CLONE 896776-R
  misc_feature: Translation starting site: 439
  misc_feature: Pfam Name: DUF689 Pfam Description: Anamorsin family
ctaattgggtaccgggccccccctcgaggtcgacggtatcgataagcttttttttttttttttttgtgtagaggcgcttatataccatccgaaagacaagtcactcacacgcacattcgcattggctaacagaagctatttggaatgcagttcagtcgactaacaacgtaggtaacccccgtctccttgttttgccgatgttcacttgcatctggcgatgccatcatatgtcagcggcaaggaagttgccagacaaggaaaccttctcgccaggcttgaatggtggaagacctctgtagggacaggttccacagcggaaggcatcacccaacccacaactgccacaagctgactgagggttattgatctgctccgcagtgagctccagcttcccaaccttctcctcggcctcagccctgccacaagtacagttcttgcatgctttctttgctgcccccacctcacagtccccaactggtgaaaacatcacttaactgtttaggatccaaacctaaactggctattgcttacggagttgatctaagttgacggattttggtgctctaccaactggaagttgtggtttcttcaggtcctcctcagtcaagagactgtcttcatcaatcagatcagagtcgtcgtcaattggaatcttgggaagggctt

SEQ ID NO: 10156 - DNA, 1321 bp, Zea mays
  misc_feature: Ceres CLONE 981163
  misc_feature: Encodes the peptide sequence at SEQ ID NO. 10157
cttcgccgccgccgccgccgcccccagtgaccaccttgccgaccggagcgtgtgaaccgtacggagtcgcccgcgtgagatgacggccacctccgcgttcgagtcgtccccggaaatggagcggttcctctgcgagcggctgctgaacacggagcagcccatcgcggagcgcttccgggcgctcttctccctccgcaacctccgcggggatgcgccgcgccgcgccctcctccaaggtttagactttggcgtttctgtgagatacattttggtcagcaccaaagaaagagctgcaagggatccttctaacttgcttgcccatgaggctgcatttgcacttggacaaatgcaggatgctgaggctattcctgcactggtggcagttctcaaagatctttcgctacatccaattgtccgccatgaggcagcggaagctcttggagctattggcctggaaaagagcatccctgtgttggaggaaagtctaacaactgatcctgctgtggaggtccaagaaacttgcgagctggcactaagacgaatagaggagaataagaaagttaatggggctgagagtacaaccacttcaccctttctctcagttgatccagcgctgccttcaaagcatgggctttcagtagatcaattaaggggccttcttctcaatgagcaagagagcatgtaccaacgttatgcagctctttttgcgcttaggaatgatggtggagatgctgctgtttctgctattgttgcagctctgagcgtcaatagtgctcttctacgtcatgaggttgcttatgtgttaggtcagctgcaaaacaaagccgcttcagatgcgctttctacagtcctgaaggatgtctgtgagcatccaatggtcaggcatgaagctgctgaagcccttggctcaatcgcagaccaagaaagcattgcccttttggaggagtttgcaaaggatcctgagcccatagtctcgcagagctgtgaagtagctctcagtatgctcgagtatgagagatcggggaaatcctttgagtttctcttccttcagactcctcatgtgcagtcctaggttcctcttcgtcgatgatcactcaatgcgaagtgactgaaagcttcttgtattggttaatgtgactggaccagccatatatccaccggctttgatgatactctttatcctgataggatatgttttttttggttaatcgtgatatggagattgaaacacggagcagcatgaaaacaaatggaaaagaaaccatgaaaactatgaaaacttatagatttcgacaaaagaataacaaaaaaaaaaaaaaaa

SEQ ID NO: 10157 - protein, 330 aa, Zea mays
  misc_feature: Ceres CLONE 981163
  misc_feature (79)..(105): Pfam Name: HEAT_PBS Pfam Description: PBS lyase HEAT-like repeat
  misc_feature (267)..(293): Pfam Name: HEAT_PBS Pfam Description: PBS lyase HEAT-like repeat
  misc_feature (112)..(138): Pfam Name: HEAT_PBS Pfam Description: PBS lyase HEAT-like repeat
  misc_feature: SWISSPROT Homolog: EC 1.14.99.29 Deoxyhypusine monooxygenase
MTATSAFESSPEMERFLCERLLNTEQPIAERFRALFSLRNLRGDAPRRALLQGLDFGVSVRYILVSTKERAARDPSNLLAHEAAFALGQMQDAEAIPALVAVLKDLSLHPIVRHEAAEALGAIGLEKSIPVLEESLTTDPAVEVQETCELALRRIEENKKVNGAESTTTSPFLSVDPALPSKHGLSVDQLRGLLLNEQESMYQRYAALFALRNDGGDAAVSAIVAALSVNSALLRHEVAYVLGQLQNKAASDALSTVLKDVCEHPMVRHEAAEALGSIADQESIALLEEFAKDPEPIVSQSCEVALSMLEYERSGKSFEFLFLQTPHVQS

SEQ ID NO: 10158 - DNA, 984 bp, Zea mays
  misc_feature: Ceres CLONE 982992
  misc_feature: Encodes the peptide sequence at SEQ ID NO. 10159
atcacccataatattttgagcattcagaaacacaccaagcgaagcgcactagcaacgacctaacaacaatggctaccaagatattagccctccttgcgcgtcttgccctttttgtgagcgcaacaaatgcgttcattattccacaatgctcacttgctcctagtgccattattccacagttcctcccaccagttacttcaatgggcttcgaacacctagctgtgcaagccaacatgcaacaacaagcgcttgcggcgagcgtcttacaacaaccaattgcccaattgcaacaacaatccttgccacatctaacaatacaagccatcacaacgcaacagcaacaacagttcctaccagcactgagccacctagccatggtgaaccctgccgcctacttgcaagagcagctgcttgcatccaacccacttgctctggcgaacgtagttgcaaaccagcaacaacaacagctacaacagtttctgccaacgctcagtcaactagccatggtgaaccctgccgcctacgtacaacaacaacaactgctttcatctagcccgctcgctgtgggcaatgcacctacatacctgcaacaacaattgttgcaacagattgtaccagctctgactcaactagctgtggcaaaccctgttgcctacttgcaacagctgcttccattcaaccaactgactctgtcgaactctgctgcgtacctacaacagcgacaacagttacttaatccattggtagtggctaacccattggtcgccgccttcctacagcagcaacaattgctgccatacaaccagttctctttgatgaatcctgtcttgtcgaggcagcaacccatcgttggaggtgccatcttttagattacatatgagatgtactcgataatggtgccctcataccgacgtgtgtttcctagaaataatcaatatattgattgagatttatctcgatatatttctaaaaaaaaaaaaaaaa

SEQ ID NO: 10159 - protein, 266 aa, Zea mays
  misc_feature: Ceres CLONE 982992
  misc_feature (1)..(266): Pfam Name: Zein Pfam Description: Zein seed storage protein
MATKILALLARLALFVSATNAFIIPQCSLAPSAIIPQFLPPVTSMGFEHLAVQANMQQQALAASVLQQPIAQLQQQSLPHLTIQAITTQQQQQFLPALSHLAMVNPAAYLQEQLLASNPLALANVVANQQQQQLQQFLPTLSQLAMVNPAAYVQQQQLLSSSPLAVGNAPTYLQQQLLQQIVPALTQLAVANPVAYLQQLLPFNQLTLSNSAAYLQQRQQLLNPLVVANPLVAAFLQQQQLLPYNQFSLMNPVLSRQQPIVGGAIF

SEQ ID NO: 10160 - DNA, 919 bp, Zea mays
  misc_feature: Ceres CLONE 983095-R
  misc_feature (919)..(919): n is a, c, t, g, unknown, or other
gctggagattcttgccttgcccttagcatcataactgaaccaaagatgagttaacagaaaacaacaacacaaaaaatagacagggaaactaatggtgtgctgcaacagcaggggcaccctcagcttcctccttggccttacgagcagcagctctgatctgatgctgctcctccttgcagatcctgctcctgcgctggaactccttggagtggtggaggcactcgaggtagtcctcgcggaggaggccgcagtcggagggctggcggcagcggttcatgcactcgctgacctccacccagaagtcgtaccagtggcccttgttcccggttgatgtcccagccggacgccatcgccgccctccctctttctggctcctcctccgtcccggtagggttctctcccctccccctctcttccccactctaggacctaacccacacccacccaccgcccccgttccggccctgcctctctgttctttatcccacctaaggatggttccacacggaaatggaaccccaatggcgaaactcctctgccaccacccgggggggatactccgccttagattcttaaaacgcgcccccctcccaccctaaccgcgcggcgggcccccacccttttttgcgcttccccctccccacctacgggcgcttaacttcgcccccgtctctgtgcacaaaaaccatggggctcctaaaacctggtgtcccccggacgtagtaaatttgtgattccccctctacaccccatttctctctgtaatatttcgcctcgccctaaaacttactcaccggtgaaatgatatagaggagtgccccccccccctctttattcccctccccccaatatttctgttcggccccaatgttgatgtttttctcaagtcagaaaaaacccgcgcaataatcacgttatn

SEQ ID NO: 10161 - DNA, 1009 bp, Zea mays
  misc_feature: Ceres CLONE 983641-R
  misc_feature (71)..(71): n is a, c, t, g, unknown, or other
  misc_feature (88)..(88): n is a, c, t, g, unknown, or other
  misc_feature (1009)..(1009): n is a, c, t, g, unknown, or other
gagtaatgaaaatctcaaaaaaaacaaaagaaaggtggggggaagcaggggggtcggggggtgagggaggnagaatataaagaagaangcaatggggtccggcgcccccctcgaggtcgacggtatccataagctttttttctgttttttttcaggcaagcactgcggtatttgatggaggttcttaggagcaaaaacaccaagcaccaacttagtacatattaatggacgccaagcacatggtgatcgatcggtctatatagaaagacaagcgggtactagagaggaagagtggcctccaagcaacacacgggatgctactaactagcagcaggcaagggcgaggaatggcaagcttttcatgtgctcgggggaacggtgttgtccgttccggcgctcagcccgccagagcggtagctgagcaccagcagctgggtccctaacgcggccccagtcagggacgagagaggagcaaggtgtttggaataccatctaacaatccccccccagcttggccaatgtcgtcaaggagcccccacaccgcccagacaacccgtggaacataagaagtatatttaacaagacccgtttgaggtatttatctactagggcaaatccctgacgtaacttacccccccgggaattctctgggttaaaagccaggattctataatgtccgggtcccgtagattttaagcataatcacatagtcacaggaatgtgacgccagtgtagcagatttctgccacataagttccctagaggagtactcctgcccctcctatgaaggtgtcgagcgactcagtctctgtgtatagatcattctgtccccaagtattggagaaatactctatttccaacgcccaggggaatagcacatttgcgcgtgaccagagacgttccaccaaataaagcgatatggattcctagcgggactaggtcaagtatcccaaacagaggtccaataaaccgtcctaaaaaaatgaggcatcatgtgcctccccccccn

SEQ ID NO: 10162 - DNA, 708 bp, Zea mays
  misc_feature: Ceres CLONE 983814
  misc_feature: Encodes the peptide sequence at SEQ ID NO. 10163
aattacaacttcccacagatagattccgcgggctgcgagcatcccccacctcatcggcccccgcgtgcggcggcggcgactctacctgacctgtcctgcgtcctcccgctttccagccagcaagccagactccgcccctctccgaaggctccgatcgtctggtttcgtccagatccggctccgctgaggctctagatcgcgtcgcgcacgatgccacgcgacctgtcgcggtcgcggtctccgccgcgccggcgtcggcggtcgccatcacccgagcggtaccgcggccggaggggccgtagggaccgaagccctagccgtagcaggtccccctatcgcccctcgtatagaaggaggagccctttgccttccccgagaaggcgtgagagctgttctccatctcctaggaggcgcaatagtccacctccatcacggaagcgttacagaagaaagagcagtccgagtgtcattagctctccagttactgcatctcaaagttcccaccttgggttggaagagaataagaatgctattgatacgcaaaggctagaagaagaaaagaaaaggtgggaagtatctgctttactatgcagtctacattattttttcctacagagtcaaatgtttactgttgcaccctttgcataactcttctgtgatgctaacaatgaaattgtgctgatttagttgctaaaaaaaaaaaaaaaa

SEQ ID NO: 10163 - protein, 145 aa, Zea mays
  misc_feature: Ceres CLONE 983814
MPRDLSRSRSPPRRRRRSPSPERYRGRRGRRDRSPSRSRSPYRPSYRRRSPLPSPRRRESCSPSPRRRNSPPPSRKRYRRKSSPSVISSPVTASQSSHLGLEENKNAIDTQRLEEEKKRWEVSALLCSLHYFFLQSQMFTVAPFA

SEQ ID NO: 10164 - DNA, 615 bp, Zea mays
  misc_feature: Ceres CLONE 984012-R
  misc_feature: Pfam Name: Brix Pfam Description: Brix domain
  misc_feature (615)..(615): n is a, c, t, g, unknown, or other
cgaattgggtaccgggccccccctcgaggtcgacggtatcgataagcttttttttttttttttttgttgtaagccgtcgcaacgcacggtaaccgactagtatatatataataggagagagatctggaccagtttctagacaatagttaacaaattccacataattagatagataactacaagtacatagataaccacatacgagataaagataatcatccgaattaatctaatcgcggaggcacgaactgttcagaacttaggatcggaccgtccgccaacacactcacgccgaaaccagaacaataaaaaattaaaaaaaatccgtatcacttgctgctcactggatggttccacaaaactgcttcagcaaaacaggggtcaaagtctttttttaagaaaagaagttccgcaggatggacttggggcatcacaagaagaatctccgcctgctcgtatccatatccggcttgtgaacccactcgtactccccgctcctcgtgtcgaaggtcccatgctgcaaggtgagcagcttgagggtgaagcgaggcccacattcctgaagccgacaaatcacttgctgcttctcagatccgcttttgcttccagatgtcn

SEQ ID NO: 10165 - DNA, 1012 bp, Zea mays
  misc_feature: Ceres CLONE 984052-R
ttttttgaaattgggtaccgggccccccctcgaggtcgacggtatcgataagcttttttttttttttttttggcatagttacgattgcgtatatcaatatttatttattatatattccatcggcgatgagatttctatgatagacatacctgtaatttttctggggccccttttgatggcgatataacctatcagccaaaaccatccgaagatttaccagaaatgtagggattttttatccatgattcataaaacctggctttggatatttgtgcctaacataaaggctatacttctctgccaacattctggactctgtggcaactttcctcatacataacgccgaactcgagtcccgggccaaaggctttgggtacaccaggcaaccccaacgggtttgatcaccaaattgtttttcgttgaggccccccccccaaaaaaatgacccccgtcttagccctccctgggatggaacatggtcccaccatcctcccgggcccatggatagggttttgttttcccccccgtacccaggtgatgcgccccgaaaaagaaatgcgggaaaccttcgttttttttatattgaatagggaatctattgtttggtttctagcactaaaagataaccctgagaagaattcccacccttagggttctctctgagatcttattgtgacacacaaccctcctcctcggctgggtcctagtagctacgggcattatttgtggaggaagaaaaccccgatcttccgaaccccactctctcgcaaactatttttcccgatccttcgcaccatttactcccatatgggagataaagggggccttccgggcagttaaattatttctcttgtaaagcacacctgtgttttgaatcccctcccatgtcttttcttctgttatacagtattcccccttccaccccgtgaggaaagaacctcccccaccgggtttattttgtttccccttgttatatttaagaggcgtataattttgttgtgcgcgctctggg

SEQ ID NO: 10166 - DNA, 807 bp, Zea mays
  misc_feature: Ceres CLONE 984159-R
  misc_feature: SWISSPROT Homolog: EC 2.7.11.1 Non-specific serine/threonine protein kinase
caaccaaaatctaaccacgaacaagcagcgaaccagaagaggagggggggagaaataccaacaataataaaaagaaaaaaaatatcccaattgggtacgggccccccctcgaggtcgacggtatcgataagcttttttttttttttttttatcaggacttgctatgccacccttatcaaatctcgtcttaatatcatacatatatatagtcacgacattcttgaagctaggtttctattgataatactatcttggctttccccctttcaactggggaaggtggtacattgttgatcggcatctaacatccaaaatcataaggaaccaatccttgtaactctggaccgttgagcctgctgttgttctcgaagcttcggagaggaaaggttgagaaaggcccatcaacaggaatagttccacagagatcattgttagacaaatcgatgactttcaggttggagagcttggcaaactcccttggaattgatcctgtaagcttgttgttgttcaagcgcatgaatctgagtgagtcgagcttggagagtgacttggggattcctcccgtgagcttgttggcatacagatccaagctgatcaggttccttgaaggtggcccaaattccttgggggatctcgcccgtaaaaggtgggtttccctgtaaaacctcccagggaaattttggaaggttgaaaaaaaagcgggcccaaaaccttcaaggggccccaaatgggaagcccccggaaaaacacttttgggaagattttggccccacaaaatttcacaaagggacgggtaaacgaaaacat

SEQ ID NO: 10167 - DNA, 801 bp, Zea mays
  misc_feature: Ceres CLONE 984308-R
  misc_feature: SWISSPROT Homolog: EC 3.6.1.1 Inorganic diphosphatase
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (101)..(101): n is a, c, t, g, unknown, or other
  misc_feature (663)..(663): n is a, c, t, g, unknown, or other
  misc_feature (751)..(751): n is a, c, t, g, unknown, or other
gaacccaacgacaaaggagagagaagagaaaccctgtggtgctttgnnnnnnaaataattctgtgtgtnnnnttagtnnnnnnncccgattgggtaccggnccccccctcgaggtcgacggtatcgataagcttttttttttttttttttatgtatcacaaaagcgaatgaatattacgataccaatcacgtacaacatatataggcagtcaggccagaaaataatatttcgccaaccttgttactagcttcacctactaccgactccgactccccaggggatttcggtctttgattgagggttcactactagcagtatacacgacacaaataaaataataacggtactcgttccatgcggtaaatggtctcccagtttttcgtcaacatcctccccacctttcctagccatcagaatcctacctcctcaggccctcaacgatgtatgtagcatacaggtccatagagtgctgtatggcttcataagcggcgctcgctggtagaaagtcattcacagcaacctccttgttctcattcttcttgtagtcctcgaagaagcgcctgatttcagccaagcggtgaggtgggagctccttgatatcattgtaatgcctgtactcgggatcatcagcgcacactgcaatgatcttgtcatctgcctcntccctgatcaatcaatcgggcataaggcccgatgggcctttccgcacggtaggaaaacaggcctgggggattaacagggcttccctgncattttataaaaccaagggaacattcccaaaagggaattccacctggtca

SEQ ID NO: 10168 - DNA, 605 bp, Zea mays
  misc_feature: Ceres CLONE 984695
  misc_feature: Encodes the peptide sequence at SEQ ID NO. 10169
atcgacaagtcaattctcatacactggtgtatcgacaaaggagagatgaatgcgaagaggctgacaccgattctcctcgccgttctgatgatgacatgcctcgtgtccgctgcaaactgtggcggccatgacgtggagacgacaccggctagcggtctccggtggccgccgtcgccggacgcagagaagacgatgttggaaagcagtgacatcaacgtcatattgtgtttgaaggctcagtgcgccggttacaagagctgttactgctgcttcactttacctggtttgccgtgctggcctgatcagaagacgtgctggcaagagtgtcccagtcacaagcgactctgatccacccgatttatgaagcacaccgacgcgatgccctccataggtcccagcgggttctcatgagaaaggatctagcctccaattctctggctcggagtgacaatttgtgatatcatgtcatacatggcaatgtgaatgtaggataataataaataagcaacattccatgcaacagtatgtcgtatgggaacatcttgattcatgagattaaaaaaaaaaaaaaaaaaaaaaaaaaaaaaagaaaaaaaaaaaaaaaa

SEQ ID NO: 10169 - protein, 100 aa, Zea mays
  misc_feature: Ceres CLONE 984695
MNAKRLTPILLAVLMMTCLVSAANCGGHDVETTPASGLRWPPSPDAEKTMLESSDINVILCLKAQCAGYKSCYCCFTLPGLPCWPDQKTCWQECPSHKRL

SEQ ID NO: 10170 - DNA, 930 bp, Zea mays
  misc_feature: Ceres CLONE 984829-R
  misc_feature (12)..(12): n is a, c, t, g, unknown, or other
  misc_feature (13)..(13): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (774)..(774): n is a, c, t, g, unknown, or other
ttttgtctgggnnacccaaaacaaaaaatattctaatatgggaatagggtggaaattataagaaaacaggaaggggaaaaannnnacccaaatgggtacggggccccccctcgaggtcgacggtatcgataagcttttttttttttttttttgggcaacatgggctttttttttcttacttctaccatatgaagtacgagcttccaaatacggaggaaagtatcatagaggaagcagcaagcaggctactgccgagtttgatcgttcataacgcaaaggcgaccatctacaataacacgtgacaacctcgtgggcaaaatggggtgtcttacagtagggccacacacatctcattgcacatgtgggggttaccaaaaaaaaagagagagagagagacttaaccggagcacttcacgtaaaaacaccgctcccttcagcgccatgtaaactctgtcctttcctttcagttcacgaactctgcatgccgggggaacgttcccttaggtctggtcccaaatatactgcctccgggggaatcttggagcttccaagaaagaattggaataccatggccaggggggccgcaagaaaccggcgccatgatttcctaaaggttttcccggcacagagtggtcggtgggaaacaaacaccccccggggggtagggaggcgccccaaaccgaaacatcttcccagtgttaagggtttcctggttatttgtttcgcatcgggtccatacggacccggggtggtgcggttgggtccttacgaacnacggcacagtgtgaccccccgagcaaaagagcgggattgagagagagaaagaggacggccacatcgtaatagcacggcttcacgggtttaggcgaatttataatccggtattattggtgggggccttgtgtgcgtcggctacagggcccgccggcc

SEQ ID NO: 10171 - DNA, 790 bp, Zea mays
  misc_feature: Ceres CLONE 984988-R
  misc_feature (17)..(17): n is a, c, t, g, unknown, or other
  misc_feature (58)..(58): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (73)..(73): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (117)..(117): n is a, c, t, g, unknown, or other
  misc_feature (127)..(127): n is a, c, t, g, unknown, or other
agaaagaaattattttnattgataagagatataaggaagagtggttttgtttttttgnannnnnnttattgtnaatgtgtttttaagggggggnnnnnngcgtattgggtaccgggnccccccctcnaggtcgacggtatcgataagcttttttttttttttttttagcaaatttagtaagcgtttcgggtgaaaaaaaatgatgtgcctgttccgtaaatatgacagaagttaaatacgatgaatgcacccactacacggctacgcgctacttcttctactggtaccgacaacaacgaatttgtctatgtacatggcagatggcgacacaaattcctattgctaatcacccctcctccaccgtcgtcagtgtccgaccgtccgtccatccatggcgtcggtgcctgttgatgacggacgacgacatttcctctcgagtacaacatcatgcccgacccgaatttcactctgcttgcgcggcgctccatgtcgcggtgtttagttgatgccgtcggcgccggttcctcgatcttgtacgtacacagtacggcaatggcgggtgggtctccttgagaaaccgcccgtgtctttcttggggccgagccgagcatcacgcttcacgagcacgactttgatgaggcccgaggttggtacagggtttccgctttcacgaaggttgccggagggtagaaccagccccaaagggccggcccgcccggtgggtccaacgggtccggccaagggtacccggggccctgggcggggaaaacacccgcccgcgggggcggga

SEQ ID NO: 10172 - DNA, 905 bp, Zea mays
  misc_feature: Ceres CLONE 985022-R
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (17)..(17): n is a, c, t, g, unknown, or other
  misc_feature (20)..(20): n is a, c, t, g, unknown, or other
  misc_feature (44)..(44): n is a, c, t, g, unknown, or other
  misc_feature (522)..(522): n is a, c, t, g, unknown, or other
  misc_feature (905)..(905): n is a, c, t, g, unknown, or other
atgccacccannnnccnaangtccaacccatcccacaccacccncaaattcacccatgcgtacgggcaccccctcgaggtcaatgtatcgatatggccctcttcagtgaccacggcgaccgccgtctccgtggcgacggcgcggcgtaagaggggcacggctgacagggccgcctcgccggggcgcaccgacaggaagtcgctgcgtactatcccgagcgaggacacagaccgcgcggccacatggtagaagaggccgatggagttgaggaagtagcgcacgaggtcctcctgcgtgagccagcagaagtcgccggcggcggcgtagcctccgccgccgccgaactgccttcttcgctccgtacccgtgaagacacaaccaaccacatcctgagccccgcccgagaactgtatcaagacgtctttatatataataaaaaacaatataaaaggaaaacaaaaaattaccccccgcgaaacatccctcataggtggtggtgggagattattgatatggaacaantaataaaaagccgcatactacccccccatctacccttctgttttcctgcaccgctatatacgcatccttcgacctcctgaaccaaacatagggactaaactatgtggcacgaatacgccatatgcccggtctttattttctccacaaacattagtctagctattacttcacctccccccccaacatccgaggtggtcgtttctccctgccatacaccccccccgcccaacattctcatcgcatagcccattatataaatgcgggtcgcctctaccatcacgataagcatctcagcgccagaaacgcaccatagaaaatatacactgctcctatattctccctaaaccgcaactacaaaccgcactcgcaattgcccttccccn

SEQ ID NO: 10173 - DNA, 658 bp, Zea mays
  misc_feature: Ceres CLONE 985084-R
  misc_feature (551)..(551): n is a, c, t, g, unknown, or other
cgaattgggtaccgggccccccctcgaggtcgacggtatcgataagcttttttttttttttttttatccaaatatatattgcttagaatatatattgcttattaactagttgggtaacaagtccgcaacctttgcttgactcttttttgttattatagctcaaagggagatttgcattggctttggaacaacatttggttcaagctcaagcaaaccctaatagcaataccatactatccctaataatggtatggcatctcaagaagaaagccatgcatgagaatgggagatgaagacatctagctagcatcatgaagacatctaactaaacatggagatgatggaggtagtaccatttttatatattcgacatgagcatgcatgcaattaggtatttgagctacgacgaccaatcgagcgagatgatctgcccgcctcctgcggcggcgtgctagctatgctgccgcttgcatgttcatgtccgagacccgtcgcctcttgggccggtctccggcggcgcctggcctctctaccagagcccgcagggcttnccttgaggaagtcgccgccgccgccgtccgtggcgccgcccgccgagtcagcagcgcgtccaccgtatccgtcatcacctcccgcgacggcaccgccgccgccgtcg

SEQ ID NO: 10174 - DNA, 772 bp, Zea mays
  misc_feature: Ceres CLONE 985107
  misc_feature: Encodes the peptide sequence at SEQ ID NO. 10175
acggcatcgttgtccacgccgagtcgccgactgatcacttctcttccagcgagtacacacatcacacagcgaagggcagcgcatcgtgctgcggcggccggaggtgatcgacaagcacctctctaggaataataaataatggcgcagttggtggacaaggcgaaggggttcgtcgccgacaagctggccaacatccagaagccggaggcggagctggccgacgtcacggtggggcacgtgggccgcgatggcgccacgctggcggggcgcgtggacgtgcgcaacccgtactcgcacgccatcccggtgtgtgaggtgacctacacgctgcggagcgccgggcggacggtggcgtcagggacggtgcccgacccggggtcgctcgccggcgacggggctaccacgcgcctcgacgtgcccgtcaaggtgccctacgacttcctggttagcctcgccaaggacgccggcagggactgggacatcgactatgaratgcgtgtcgggctcaccgttgacctccccgtcgtcggcaaactcacgctgccgctcaccaagtccggcgagctcaagctccccaccctctccagcatyttctgatcgatcgatctgcgtgctgctcgctcgatccgtaactgcggccttgcgtgttcatgactgatctgcctactcgataatatgtaaaccgctctcttgagtgttgttgttgtgctgcttgagtagtacgagacctaataataataaactacagtgatgtgtaaaaaaaaaaaaaaaa

SEQ ID NO: 10175 - protein, 152 aa, Zea mays
  misc_feature: Ceres CLONE 985107
  misc_feature (2)..(152): Pfam Name: LEA_2 Pfam Description: Late embryogenesis abundant protein
  misc_feature (118)..(118): Xaa is any aa, unknown, or other
  misc_feature (151)..(151): Xaa is any aa, unknown, or other
MAQLVDKAKGFVADKLANIQKPEAELADVTVGHVGRDGATLAGRVDVRNPYSHAIPVCEVTYTLRSAGRTVASGTVPDPGSLAGDGATTRLDVPVKVPYDFLVSLAKDAGRDWDIDYXMRVGLTVDLPVVGKLTLPLTKSGELKLPTLSSXF

SEQ ID NO: 10176 - DNA, 799 bp, Zea mays
  misc_feature: Ceres CLONE 985503
  misc_feature: Encodes the peptide sequence at SEQ ID NO. 10177
atcacagtacgcacgcacgcacacaccagcccagcagcagaagcgcccctcggccctcgctcccacaacaagctcaagccagccttctctctctgctccaatggcgcgcttccagctcgcagccgtggccatggccatgctcttcgccgcggcggcggcgcaggccccgaccgccaccccgacgccggctcccaaggcgtcccccccgccggcgacgccgccgccgacccccgcgccggtgtctccgcccgtgccgcccccgaccatgcctcctccggcgcccgcgcccgcccccaaggccccggccccggcgcccgaggcccccaccccggcgcccacggccgaggctcccactcccgacgtgagctccccgccgatgcccacggagggccccgctccgacgccctccgcggaggctcccccagcccccagcgccgccgtcgccggcgcctccccctccgccaagtggttcgccgccgccgcagccgtggccgccgccgccgccgccttctactgagagagcgggagatctgcgccgtcccctgctgtaatttatcgctatccgtgctgagccgttgattccttttttttttttttgttgttcttccctttcatccatattccattcggcattcgattcagtaggactggcatatctgttcgtgttactacagtgtaggatcgtggcttggacagattggtttggctggctggctggttgggtgggcccggtggtgttgtggcttccgttcctccatctgtataataccctgttgattttccaaaaaaaaaaaaaaaa

SEQ ID NO: 10177 - protein, 138 aa, Zea mays
  misc_feature: Ceres CLONE 985503
MARFQLAAVAMAMLFAAAAAQAPTATPTPAPKASPPPATPPPTPAPVSPPVPPPTMPPPAPAPAPKAPAPAPEAPTPAPTAEAPTPDVSSPPMPTEGPAPTPSAEAPPAPSAAVAGASPSAKWFAAAAAVAAAAAAFY

SEQ ID NO: 10178 - DNA, 1076 bp, Zea mays
  misc_feature: Ceres CLONE 985657
  misc_feature: Encodes the peptide sequence at SEQ ID NO. 10179
acacataaccagcacacagctctcgccttctctctcccatcggcacacccgagctcgctccctccttccacgtcgaggtccgagtcctgctttgatggcgaccgacgtggctgagactcccgcgccgttggtggatgcggccccagaggctcccgctgacgccccggcggcgcctgctgcggacgcgaagccggccaaggccaagaaggccgccgcaccgaagaagcgcgccagcccgacccacccgccgtacgccgagatggtctcggaggcggtcacgtcactgaaggagaggacggggtccagcagctatgcgattgccaagttcgtagaggacaagcacaaggacaagctcccacccaacttccgcaagcttctgaacgttcagctcaagaagctcgtcgccggcggcaagctgaccaaggtgaagaactcgtacaagctgtcgtccgccaccaagccgaatcccaagcccaaggccgccccgaagaagcccaagaccggcgctaagaagcccaaggccgctgccaagcccaaagctaagacccccgccaaggtgaagcccgccacaaagcccaagcccgccgcgaagccgaaagccgtagtgaaaccgaagacacccgccaagcccaaggccaagccagctgccaaggcgaagcccaagaccgccggcgctaagccgaagccacttgctaagaaggccggccgccccgccaaggcggcgaagacgtcggccaaggacacgccagggaagaaggcgccggtggccaagaagtccgctgctgccgcgaagaaggcccctgccaagaaggccgctccctcgaagaaggcggcgaccccggtgcggaaagcgccgtcccgtaaggccaagaagtaaagcggccaagaaggggggcgcgatgctgtaaatttgatatcggagaggctcgggtacactggtcattcagtatccgagaccgatagctgaggctagtggcgatggaggactgtgttattactactataaactggtggttgtgtttctgtaactggtgaatgatcaagttggaagcttttagccaaaaaaaaaaaaaaaa

SEQ ID NO: 10179 - protein, 260 aa, Zea mays
  misc_feature: Ceres CLONE 985657
  misc_feature (49)..(119): Pfam Name: Linker_histone Pfam Description: linker histone H1 and H5 family
MATDVAETPAPLVDAAPEAPADAPAAPAADAKPAKAKKAAAPKKRASPTHPPYAEMVSEAVTSLKERTGSSSYAIAKFVEDKHKDKLPPNFRKLLNVQLKKLVAGGKLTKVKNSYKLSSATKPNPKPKAAPKKPKTGAKKPKAAAKPKAKTPAKVKPATKPKPAAKPKAVVKPKTPAKPKAKPAAKAKPKTAGAKPKPLAKKAGRPAKAAKTSAKDTPGKKAPVAKKSAAAAKKAPAKKAAPSKKAATPVRKAPSRKAKK

SEQ ID NO: 10180 - DNA, 716 bp, Zea mays
  misc_feature: Ceres CLONE 985754-R
  misc_feature (216)..(216): n is a, c, t, g, unknown, or other
  misc_feature (217)..(217): n is a, c, t, g, unknown, or other
  misc_feature (224)..(224): n is a, c, t, g, unknown, or other
  misc_feature (226)..(226): n is a, c, t, g, unknown, or other
  misc_feature (227)..(227): n is a, c, t, g, unknown, or other
  misc_feature (234)..(234): n is a, c, t, g, unknown, or other
  misc_feature (252)..(252): n is a, c, t, g, unknown, or other
  misc_feature (322)..(322): n is a, c, t, g, unknown, or other
  misc_feature (325)..(325): n is a, c, t, g, unknown, or other
  misc_feature (326)..(326): n is a, c, t, g, unknown, or other
  misc_feature (327)..(327): n is a, c, t, g, unknown, or other
  misc_feature (328)..(328): n is a, c, t, g, unknown, or other
  misc_feature (329)..(329): n is a, c, t, g, unknown, or other
  misc_feature (330)..(330): n is a, c, t, g, unknown, or other
  misc_feature (331)..(331): n is a, c, t, g, unknown, or other
  misc_feature (332)..(332): n is a, c, t, g, unknown, or other
  misc_feature (334)..(334): n is a, c, t, g, unknown, or other
  misc_feature (335)..(335): n is a, c, t, g, unknown, or other
  misc_feature (336)..(336): n is a, c, t, g, unknown, or other
  misc_feature (337)..(337): n is a, c, t, g, unknown, or other
  misc_feature (338)..(338): n is a, c, t, g, unknown, or other
  misc_feature (339)..(339): n is a, c, t, g, unknown, or other
  misc_feature (340)..(340): n is a, c, t, g, unknown, or other
  misc_feature (341)..(341): n is a, c, t, g, unknown, or other
  misc_feature (342)..(342): n is a, c, t, g, unknown, or other
  misc_feature (343)..(343): n is a, c, t, g, unknown, or other
  misc_feature (344)..(344): n is a, c, t, g, unknown, or other
  misc_feature (345)..(345): n is a, c, t, g, unknown, or other
  misc_feature (346)..(346): n is a, c, t, g, unknown, or other
  misc_feature (347)..(347): n is a, c, t, g, unknown, or other
  misc_feature (360)..(360): n is a, c, t, g, unknown, or other
  misc_feature (377)..(377): n is a, c, t, g, unknown, or other
  misc_feature (384)..(384): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (411)..(411): n is a, c, t, g, unknown, or other
  misc_feature (412)..(412): n is a, c, t, g, unknown, or other
  misc_feature (416)..(416): n is a, c, t, g, unknown, or other
  misc_feature (417)..(417): n is a, c, t, g, unknown, or other
  misc_feature (425)..(425): n is a, c, t, g, unknown, or other
  misc_feature (426)..(426): n is a, c, t, g, unknown, or other
  misc_feature (428)..(428): n is a, c, t, g, unknown, or other
  misc_feature (429)..(429): n is a, c, t, g, unknown, or other
  misc_feature (432)..(432): n is a, c, t, g, unknown, or other
  misc_feature (440)..(440): n is a, c, t, g, unknown, or other
  misc_feature (565)..(565): n is a, c, t, g, unknown, or other
cgattgggtaccgggccccccctcgaggtcgacggtatcgataagcttttttttttttttttttgctaagactactacgttcactactcattgcacaacaccaacaatggagaaatggtcagccgagaggtaccttcagtgacaacgtttacagactagagggcggggcccatggcaatgtcaacactcagcacatgagacatgccacgcattagnnacaatgncnnttagggngtcgaaacagccttaaantcaacagaaataaaacaaccaataaaatggaaaaaaatgggcgggggcgttttttttttttttttccagnggnnnnnnnntnnnnnnnnnnnnnntcccttccccctnttttctcgttgggtggntgggtgntgggcgggtggaagggnnnnnnggggnntggnntcgggagnntnnttnttggttcncttcccttcttctcccgtgttgtgtggggttgggctgttgctggcgtttgggtgcttttcgggttgggtgttgctgggtgttgggttttggttgggggtcgtgggggggtttgtggtttttttgngttctgtcttttctggcccttgtttgtttcgtggttcttgttgtgtttttcgcttctctctcccccgccgtgggccttcttcgcgttctgttttgttttgcggggtggcggccgttgtctgtcttgggggcctgggcggggcaacgcgctg

SEQ ID NO: 10181 - DNA, 886 bp, Zea mays
  misc_feature: Ceres CLONE 985844-R
  misc_feature (23)..(23): n is a, c, t, g, unknown, or other
  misc_feature (25)..(25): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (75)..(75): n is a, c, t, g, unknown, or other
  misc_feature (76)..(76): n is a, c, t, g, unknown, or other
  misc_feature (81)..(81): n is a, c, t, g, unknown, or other
  misc_feature (82)..(82): n is a, c, t, g, unknown, or other
  misc_feature (86)..(86): n is a, c, t, g, unknown, or other
  misc_feature (93)..(93): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (139)..(139): n is a, c, t, g, unknown, or other
  misc_feature (465)..(465): n is a, c, t, g, unknown, or other
  misc_feature (474)..(474): n is a, c, t, g, unknown, or other
  misc_feature (482)..(482): n is a, c, t, g, unknown, or other
  misc_feature (483)..(483): n is a, c, t, g, unknown, or other
  misc_feature (507)..(507): n is a, c, t, g, unknown, or other
  misc_feature (539)..(539): n is a, c, t, g, unknown, or other
ccccccggggggggggcgggggngnggnnnnnnnnnnnnnnnnnnnnnnnnnnnnnncgnnnnnnnnnnnngggnnggggnngggnggggggngggnnntggggggnnncnnnnnnnnnnnnnnncccggacnnnnggncccaattgggtaccgggccccccctcgaggtcgacggtatcgataagcttttttttttttttttttcacgagacgacagctggtttgtttttatttattcactcgcagaacacaacacactgagtcggggagctcaccgaacagcacaatgtacagacgatgaccacgaaacactgaacagcacacgtacacaccagacataccaaagcagagcaaccacagtaccagtaccacacacacgagtcgcgtcgctgaaacccaagacccgacgccgcgacgcgaacgcgacgcgaccattcacctcgcgtccatgtcttcttcagccnggagatctnggatgctnncttaacctcaggggcttcttgaancctcggccttggggcacggggtggaccgttgnaagcaccgcccggtttcctcccggcggggggggcccctttaaaccttttcctttggggtcctttgggggggttttcctcgggggggaaagggcgggaaaaaccccccccccaccaaaaaattgggggccccctttttttttgggcgccccccccagggggggggggggccccccttttgtggggccccccccgtgggggggccccccccctttttttcccccccgggggggggggggcctttgttccccccccccttttgtttatagataagacaccccccccccccctgtttttggtgggggggggggttcctctcccacccacacccccccgggtgtgcccccgc

SEQ ID NO: 10182 - DNA, 670 bp, Zea mays
  misc_feature: Ceres CLONE 985886-R
  misc_feature: Encodes the peptide sequence at SEQ ID NO. 10183
  misc_feature (1)..(1): n is a, c, t, g, unknown, or other
ncgattgggtaccgggccccccctcgaggtcgacggtatcgataagcttttttttttttttttttgcagtgaccgttgggtttttattgcgctgtatagtaggaccaatacatctcaatcatggccagttacaaacaactttagctcgctactattacaacaagatcgacgcgttactagggtcaagacgcagtatttctatgtactgttgcgccttgcatgacattcgttagccaaagcttccgatcaaaagacaaggcaagccctgtcgaggtcgtaccccatcttctccaggcccgggcgcaccgtgcactcgatcatcgccggcggcccgcacacgagcgcaagcgtctcgctgtctcccaggggcaggtgctccctcaagacttgctcgtccactctccccacgccgtattcccacccgtcctccggccgtgccaccttgctcaccacgtaccacaccttgagccgcgccgggtacgcggcaacccaacggttgatctcctcacgcaggagcatgtcgtccaccgtccggttcgcttacacgaggtgcatctccgtgtcgtcgtcgggctggtccctcagcacggcctggatcacctggtacaccggcgtgatgcccgtcccaccggcgaccatggcgagccttcgcgcgaaccggcgctcaccg

SEQ ID NO: 10183 - protein, 51 aa, Zea mays
  misc_feature: Ceres CLONE 985886-R
MSSTVRFAYTRCISVSSSGWSLSTAWITWYTGVMPVPPATMASLRANRRSP

SEQ ID NO: 10184 - DNA, 1076 bp, Zea mays
  misc_feature: Ceres CLONE 986002
  misc_feature: Encodes the peptide sequence at SEQ ID NO. 10185
gtggcgtgcgcaaagatttgatttttttttctcggggaggagccggagtccgagcagcagtggcggctggagggaggagatcctgatctgttgtcgcagcggggaggggaggaccggaggaggaagatggctgcgcaggagcaggagcaggagaagcagcaggcgaagacgagcaccacgagctcgctgccctccagcagcgagcgctcctccagctccgctcgcaacaacctcacggaaggaggggcggagagcgacgaggagatacggcgggtgccggagatgggcggcgcgtcggcgtcggcctcgtcgggcgccggcgcggatgagcgtcccaagggggaggacggcaagcaggggcaggtggcggcgggggcgcagcctccggcgggcgggaagaagcgcgggcgcaccgcgggggacaaggagcagaaccggctgaagcggctgctgcggaaccgcgtgtccgcgcagcaggcgcgggagcggaagaaggcgtacctgacggagctggaggcgaaggccaagggcctggagctccgcaatgcggagctggagcagcgggtgtccacgctccagaacgagaacaacacgctccgccagattctgaagaacacgacggcgcacgcgagcaagaggtccggcggcggcgccggcggcaagggcggagacggcggcaagaagcaccacctcgccaagagctagtgagaaatgagagagggagttggttcgtgccctgctcgcgctcgcctgatctgaccattgctggcgtgttgctgttcctgacgacgccttctctttttcttcttttctcctactgttacccgtgggtttcgtctcttgcctcgctgatgcactgttttaactgttagccatcccgtctactcaccagtgaacaccgctgctagttaatttctcggtggtttagggtgccgtgccagaacgccgtgtaacttcgttcttgtactgtcctgtagtccagccttgcggtttggcaattcgattcaagattactgtacgctgccagctcttggagaaaaaaaaaagaagttttcggtgcaaaaaaaaaaaaaaaa

SEQ ID NO: 10185 - protein, 192 aa, Zea mays
  misc_feature: Ceres CLONE 986002
  misc_feature (99)..(162): Pfam Name: bZIP_1 Pfam Description: bZIP transcription factor
  misc_feature: The sequence is a functional homolog of SEQ ID NO 206 in the 10/225,066 US patent application
  misc_feature: The sequence is a functional homolog of SEQ ID NO 2356 in the 10/374,780 US patent application
  misc_feature: The sequence is a functional homolog of SEQ ID NO 827 in the 11/479,226 US patent application
MAAQEQEQEKQQAKTSTTSSLPSSSERSSSSARNNLTEGGAESDEEIRRVPEMGGASASASSGAGADERPKGEDGKQGQVAAGAQPPAGGKKRGRTAGDKEQNRLKRLLRNRVSAQQARERKKAYLTELEAKAKGLELRNAELEQRVSTLQNENNTLRQILKNTTAHASKRSGGGAGGKGGDGGKKHHLAKS

SEQ ID NO: 10186 - DNA, 1020 bp, Zea mays
  misc_feature: Ceres CLONE 986191
  misc_feature: Encodes the peptide sequence at SEQ ID NO. 10187
aacgttattttatttcgtgttgacctaacaatcaggccccgcaccttttaacaagttccagtcgtggcgccgagccctactcctcccgccgccgccgccgccgccgcagactcttcctcgcgactcgccgctcgcccgactttccgagctccgacaccaaggagcaccatgggagagtcgagcaaggagctcctggacctgccctccgaccccaggcctcccgcctccttcatcgagtcgcttctcgctggcagggagcagcagcagcaggataaggagggaaatcgtaagttgggggcgtccactgatcccctgcccaaaagccaagttatcgggaaagtgaaggatttcttgggggagattgcaagggccaaccagaagttgcagcttgatgcacagaacaagcctcctgtggagtacgatattgaagcccttactgggaacgaggaggaatacattgagatggatctgcttctaggtgtcgctgatcttcattcagagcaggctgtggaggcagctgaagcaacaataaacggccgccagacttcagaaatgtcatttgcttgcagctcatctgactcggaagatgatagtgatgacaacgatgaagatgctgatgacaaacctctcacttctgacaaagataataaatgtaaaagtcctgatgacgcggagatgggtccagcgaaaggaaagaagcccaataaaagacagaaaattgttgttctcaactagtacccttgtcttctgtacacctaagaacaagggctggagcgcaagtggtgaatgtgttggcctggtattatcagaagttacggaggggctctctctgttcttttttatttgtcacggtttagtttaaaaatgaacgagcgacaaatattcgagaagggaggttgtatttttttcagtgttgtgcaatgttcaggccagctagggcaacttgcacgggggctaaaagaagtaatgcatattccagtttatccaaaaaaaaaaaaaaagaaaaaaaaaaaaaaaaaa

SEQ ID NO: 10187 - protein, 188 aa, Zea mays
  misc_feature: Ceres CLONE 986191
MGESSKELLDLPSDPRPPASFIESLLAGREQQQQDKEGNRKLGASTDPLPKSQVIGKVKDFLGEIARANQKLQLDAQNKPPVEYDIEALTGNEEEYIEMDLLLGVADLHSEQAVEAAEATINGRQTSEMSFACSSSDSEDDSDDNDEDADDKPLTSDKDNKCKSPDDAEMGPAKGKKPNKRQKIVVLN

SEQ ID NO: 10188 - DNA, 1047 bp, Zea mays
  misc_feature: Ceres CLONE 986663-R
  misc_feature (84)..(84): n is a, c, t, g, unknown, or other
  misc_feature (706)..(706): n is a, c, t, g, unknown, or other
  misc_feature (721)..(721): n is a, c, t, g, unknown, or other
  misc_feature (866)..(866): n is a, c, t, g, unknown, or other
  misc_feature (1033)..(1033): n is a, c, t, g, unknown, or other
gaagtataggaataaattaaaggaatgaacaaaatatatagcgactctgtcagaacaaatggtgtggatatttaagtttttttntcaattgggtacgggccccccctcgagtcgacggtatcgataagcttttttttttttttttttagatgaatatgtagttataatataatggctatctttcaaagggtcacctacacagaaacacaggcgtgggtaaaaggcttaaagggtcatctacacaaaaaccataacataaaaagctgggaccctttatttaaaggcaccattattttaatttgttcaaaccttactttagaaacagaaagtctcagtcccacctgatactattaggcggaaccagatcttacgcggcggcatcaacagcatggttgccaacatccttttccacaaaatccttgacatattgattgtcttgcacggcagatggacattctggacaattgttgtggagtcataaactagggtcatcaaccccccccctttggcaaaagccttaaaatgtgagttagcttctacaatcaagtaggaaaaggcgaattgatctcaattccccaggcaagggtataggaaagaatcaattttcccgacccctatttctttagaaccccaacaactctccagaaaattccagaaagccaattccaatgttggagccagaatgtccctctctcaacacaatctncatgaataaaattancctcccacaacgttttctcgcaaggggcgagtggcaaaactaaacaagaagtcgccggagaaatccatctctccctccacaagactcaaatcgtggtatacacaaaagcaatagagtgttcccgttgtgcagaaagaagcaaacngccacatactatctagaaaatatattccgcctacatccccaacgaaaataatcattaagctctaatacagttttttatcctggagtggcgtagaagaaaacgctctcatgcaaagataaccaatatactcaattggcacaacgggattggtaataacacccctccgntgcaagaaataaaa

SEQ ID NO: 10189 - DNA, 1316 bp, Zea mays
  misc_feature: Ceres CLONE 986698
  misc_feature: Encodes the peptide sequence at SEQ ID NO. 10190
atctcggggatccggcactcgcctcccttttccctttccgcgccccatcaccattgccacaaatagcaaccaaggcagtaagcctagccaagccaaccgacggcggcgagagtatatatacacacacacctgacgcctctgctgctgctgggatcaacgcggcagcttagtgacgacgacgactcttctgtctctgcgttgattaatggacagtaacagatccatggcgacgagcggcgtggctccgttcgtggccaagacgtaccgcatggtggatgacccggcgaccgacggcgtggtcgcgtggggcagggacaacaacagcttcgtcgtggccgaccccttcgccctctcgcagacgctcctgcccgcgcacttcaagcactccaacttctccagcttcgtgcgccagctcaacacctacggcttccggaaggtcgatccggaccggtgggagttcgcgcacgtgtccttccttcgcggccagacgcatctcctgggccagatcgtccgccggagcagcggcggcaagcgcaaggacgacggcaacggcgccggcgccggctccgccgacgacgaggacgcggtggccatggaggtggtccggctgaggcgggagcagcgggccatcgaggagcaggtggccgcgatgtggcgccgcgtgcaggagacggagcgccggcccaagcagatgctcgcgttcctcgtcaaggtcgcgggcgacccgcaggtgctgcgccgcctcgtctccggcgccgggggcgacgccgtgttcgccgccgcggagccggaggacggcgcgagcatcaagagggcgcggctgcttctcgatgccggaagcggcggcgacggcgccgtcgacttcagcgggctctatagcacaaccgccggaagcgaagacgacggcgtcgggttcggcagcgattacctgcagccgccaccgccgtacgtgttccccgtcaacagcggcggctactgactgatggcggtctggtagtccagcatctatccgagcgatgtggcgtgcttcgtcgtcgttagttgcccctcccgagtgacgtgttggactgaagtggcaacggcgccgacggacggtgagcaaccaacccaagataattagctaggaggtggtacaaagtgtaaagcctttggtttaggcaggtctgcggtgatctttaatttgcttgttgcaatgttttccttccctaccttgtcaagtgaatgctacggatcagcggcggcaaaagccgttagctgcagctagtttgccgctgctcttcatacagctgcacgccgttaaaaaaaaaaaaaaaaaa

SEQ ID NO: 10190 - protein, 257 aa, Zea mays
  misc_feature: Ceres CLONE 986698
  misc_feature (13)..(167): Pfam Name: HSF_DNA-bind Pfam Description: HSF-type DNA-binding
MDSNRSMATSGVAPFVAKTYRMVDDPATDGVVAWGRDNNSFVVADPFALSQTLLPAHFKHSNFSSFVRQLNTYGFRKVDPDRWEFAHVSFLRGQTHLLGQIVRRSSGGKRKDDGNGAGAGSADDEDAVAMEVVRLRREQRAIEEQVAAMWRRVQETERRPKQMLAFLVKVAGDPQVLRRLVSGAGGDAVFAAAEPEDGASIKRARLLLDAGSGGDGAVDFSGLYSTTAGSEDDGVGFGSDYLQPPPPYVFPVNSGGY

SEQ ID NO: 10191 - DNA, 1382 bp, Zea mays
  misc_feature: Ceres CLONE 986701
  misc_feature: Encodes the peptide sequence at SEQ ID NO. 10192
aggccctcaattccactctgcccgagcaagccgaattgtcgtccgaattcgctcgcggggagcacttgctacctcgcgcccgccttctgtcgcgcggattcgttgctgcgcctggagatggacccgatggacatcgtcggcaagtccaaggaggacgtctccctccccaaattaatcttgtgagatgatacgctaggaagcttgaattttgaagtgatgctatgaggaaagttagcaacaatgtttaagataattaaggagatgcttcctcctgatgtacgagtggcaagagatgcacaggatcttcttgttgaatgctgtgtagagttcatcaatctcctttcgtctgaatcgaatgaagtgtgcagcagagaagagaaaaaaacgattgctcctgagcatgttatcaaggctctaagtgatcttggcttcagagagtacattgaggaggtttatgctgcatatgaacagcacaaacttgatactttggattctccaaaagctggcaaattcactgggattgagatgacagaggaagaagctgttgctgagcaacaaaggatgtttgctgaggctcgagcaaggatgaataatggagcccccaaaccaaaggagacagaacaagagccgccacagcaaccacaagcacaaccccaacttcagctgcatactgaaccacagcaacccgtgcaatctcaagtgcagttgcattcgccaacacagcattccctccaacctcaagtgcagctgcacccccagccacaacagctcccacaagtgcaggtgcactctcagacgcagctgcaccctcagccacagcagccccaagtgcaggtccatccgcagctgcagcaactcccacaattacaggcccactcgcagccaccgcaaccccaagtgcaaatccacccacagccgcagcagcccccacaagtgcagttgcagtcatcagtccagcagacctcccaaccccaacctcaggtacatctctacaatcacagggggggctcacaagcgcagctgcagccccaactgccaggtcagctgcagacacaggggcaaaccggacctggcattgacagttagagactactgctggcatatactaggaacctgtatgcttgcttgtgactcgttagatcctgatttaggtttctgtgcttcctgtacaatgtaaatccagtgtgattgcagttgccttgttgctaataatgcgaaaccgttagttactgatgatgtccttactgtgtcgaatactgaatgtcatggcgtggcttatgtgccatgctgaatgatgttctgtggtcattgtaatagcctaacttgacatctgtccatgatgatagtgattgatttgaatgagctcaaaaaaaaaaaaaaaa

SEQ ID NO: 10192 - protein, 281 aa, Zea mays
  misc_feature: Ceres CLONE 986701
  misc_feature (1)..(59): Pfam Name: CBFD_NFYB_HMF Pfam Description: Histone-like transcription factor (CBF/NF-Y) and archaeal histone
  misc_feature: SWISSPROT Homolog: EC 2.7.7.7 DNA-directed DNA polymerase
  misc_feature: The sequence is a functional homolog of SEQ ID NO 824 in the 10/374,780 US patent application
  misc_feature: The sequence is a functional homolog of SEQ ID NO 2190 in the 10/374,780 US patent application
  misc_feature: The sequence is a functional homolog of SEQ ID NO 24 in the 11/375,241 US patent application
  misc_feature: The sequence is a functional homolog of SEQ ID NO 715 in the 11/479,226 US patent application
  misc_feature: The sequence is a functional homolog of SEQ ID NO 92 in the 10/374,780 US patent application
MFKIIKEMLPPDVRVARDAQDLLVECCVEFINLLSSESNEVCSREEKKTIAPEHVIKALSDLGFREYIEEVYAAYEQHKLDTLDSPKAGKFTGIEMTEEEAVAEQQRMFAEARARMNNGAPKPKETEQEPPQQPQAQPQLQLHTEPQQPVQSQVQLHSPTQHSLQPQVQLHPQPQQLPQVQVHSQTQLHPQPQQPQVQVHPQLQQLPQLQAHSQPPQPQVQIHPQPQQPPQVQLQSSVQQTSQPQPQVHLYNHRGGSQAQLQPQLPGQLQTQGQTGPGIDS

SEQ ID NO: 10193 - DNA, 625 bp, Zea mays
  misc_feature: Ceres CLONE 987014-R
caaattgggtaccgggccccccctcgaggtcgacggtatcgataagcttttttttttttttttttaagatcccagaacacaatatcacaatacaactactggggcaagtatacattcatggctttacaaaacttatgattttttgacaataaatggtaattgagcaggtttatctggacatgaatggtcatccaatgtagtcgggagtaagatcaatcaggtgaaattctcccttcatgcatctttctctccagccggcctatcctcgacggaggccagaattatgtgctgtaacccgccccctgttgaactagaacctaaaggggaaatcgggaaaccgaaatggccctaaaatccccgctacgagtagagttttcaccttcacccaggaatgcccttttgggactttgtaggggtaagggaccccagggagctttttttttccccccgggaaaccccaaataaacctttttcaaaaaaaatttccccttttaaaatggcccagggggccctttttaaaaaaaaaactccccccccccccccctttttgggaaaaaaaattttgttacccccggttccccaaagagggggggccccccccccctctttttttttttgcggggat

SEQ ID NO: 10194 - DNA, 1234 bp, Zea mays
  misc_feature: Ceres CLONE 987286
  misc_feature: Encodes the peptide sequence at SEQ ID NO. 10195
aaaaccgattcccttccccgattccctccggcgtttcctggtgagtttacgccagcgccgacttctccgatcaggtcccatcggttttgggtgcgcgcacctcgtttggcttcgcgtcgttcttcggtgcgcgcacgcgattcgtggatccggcggtcggatcccgcgccgtccgcagcgatggctgctccccaacccttgcttctttgcgcgcaccccttccccacggccttttagtttttacatggagaggggcgaccctcgctagccgcagggtccctctccatcctcaccgctttcttcctctgcaggtccttagtgcaagcaaggacaccgctcctctagcgagctctgttctgaagcggcaagaaagatgattaatcttttcaaaataaagggtcaaaagaaagaagaggcagcaagtactgctggaaaggcccctgttaagaaacagtctgctggggagctccgtcttcataaagatattagtgagctcaacctgccgaagaccacatcaatttcttttcccaatggcaaggatgatctgatgaattttgagaccaccatccgacctgatgaaggatattacatgggcggcactttcgttttcacctttcaagtgtccccatcttatcctcatgatcctccgaaggtcaaatgcaagaccaaggtgtaccatccaaatattgatctggaaggcaatgtctgtctgaacattctgcgcgaagattggaagcctgttctcaacatcaacactgttatttatggcctgaatcttctttttacgcaaccaaacgacgaggatcctctgaaccacgaagctgcagttgtccttcgcgacaatccaaagatgtttgaggcaaatgtgagaagagccatggctggaggctacgtcggccaacactatttccaaagatgtgcttgacttgatgtggtggtggcttgaaaacgatcaacagagcccctccccctgtatcagcaccagcgcgcccagctttgtgtgcggaaagtgcttctggaagcaaaatccaaaccgttcatggtgtgacatctgtttgcccgcctttgtgatgtgtggtatagtggtggtgcataatgacagggaaatgcttctctaactgtatcattcattccataaatcctaaacgaggaatgggaagtggattgttaagcagattccttctgcagatgttgatgtcgtattcggcgtgtattcaaaaaaaaaaaaaaaaaa

SEQ ID NO: 10195 - protein, 183 aa, Zea mays
  misc_feature: Ceres CLONE 987286
  misc_feature (33)..(169): Pfam Name: UQ_con Pfam Description: Ubiquitin-conjugating enzyme
  misc_feature: SWISSPROT Homolog: EC 6.3.2.19 Ubiquitin--protein ligase
MINLFKIKGQKKEEAASTAGKAPVKKQSAGELRLHKDISELNLPKTTSISFPNGKDDLMNFETTIRPDEGYYMGGTFVFTFQVSPSYPHDPPKVKCKTKVYHPNIDLEGNVCLNILREDWKPVLNINTVIYGLNLLFTQPNDEDPLNHEAAVVLRDNPKMFEANVRRAMAGGYVGQHYFQRCA

SEQ ID NO: 10196 - DNA, 607 bp, Zea mays
  misc_feature: Ceres CLONE 987324-R
cgattgggtaccgggccccccctcgaggtcgacggtatcgataagcttttttttttttttttttgggcacgatgaacactttctccaaattcgaatgcagtctagaaatacaagcctaacacaaatcaggtcctgccttgacaactacaagcgcccaaagtcatttagtcaatacttaaaaaagaaacgttgtgctcctgcctccacaattgtatcaacagcgatgtgtcaagggaaacccaaaacactggaacaaaatctcagactccatcctacagaattacagttgtggcgaccggacaggcaaaacatgctgggggcccctagcattttccagcatcttggggcagctaagacaatctaacgcgtcattggcatatggggactcgacacgttgtggctgctgtcctggggatccactatagcttcttctggcatcaggaggtggtggaggccaactgctcacttctcgggctgccagtggagacctgctcacgtctcgggctgccggtggtgacctgatgttatttctaggaggacgtggcggatgcgacctgctcacttctcgggctccacgtggagacctgctgttatttctggcaagagg

SEQ ID NO: 10197 - DNA, 669 bp, Zea mays
  misc_feature: Ceres CLONE 987374-R
  misc_feature (336)..(336): n is a, c, t, g, unknown, or other
  misc_feature (343)..(343): n is a, c, t, g, unknown, or other
ccaattgggtaccgggccccccctcgaggtcgacggtatcgataagcttttttttttttttttttctttttttttttttttttttttttttttttcacaacccctgcaagaagcatggatttactgaaatggtaataattacacaagtgaacttcatgtcaccatcacacatacgctttccatttcagcggaggcgatctagcaggatgcgcattgcctagtacagtacaaccagggagggtttcttctgaccgaaggaggggaagaccattccagcgagaatcgatggatatctcagccaaaaaagttaaaaagacgaggggggggaggaggaantgaaacnaaatgggaaattctgccgttggcgtacgtgaagatgaagggaggaacaaataagctccctttctcgtgtcgcataataacagagagagtgtgttttcctttttcccttttgccggttcactcttctcttctcctctcttcactgctggtgggtcggcgttttcttggggccccgtcaatgcgccccagacgggggcgggaggaaggaaccgggcccaggcccggggggggccccacggaaaaaaaggggcccggttaagtaaaagggaccccccgaaatggtaaggagtacattcttcgggataagaggggttaaatactataccc

SEQ ID NO: 10198 - DNA, 777 bp, Zea mays
  misc_feature: Ceres CLONE 987491-R
  misc_feature: Pfam Name: GTP_EFTU_D3 Pfam Description: Elongation factor Tu C-terminal domain
taataatatcagtttattgctcattattagaactgttgtgagatgttgtatgccagtaataaagattcactacagtacatggctaaaaacccatagaaacaatctatatgtgattgcgtaattcgtaggtgtagaacaccacctaacctgcttcatgctcaaacacttatcaattacaatactataggacaatatgatgctgcaaagatggggcaaaaccatgtttcacaaagttgttattataattatcgacacaaggcctcattgatgatcatccttgtcatagtggccgtttggataaccaccatcaccaatgaccttgagcatggttagcgtagatgtaactccttcgccaccagatcagccaactgttctcttgttattgtaggattcaatcatagtcggttcctccatggttagcgtagatgtaactccttcaccaccagatcagccagatgttctcttgttattgtaggattcaatcatagtcgggtcctctttagtaccgaaaggggccggcgggaggatccatgtcaaattgcttcttcccttggagaatcaggtcaatgccaaaaaatagtcaaacttcttggctttcaacatctctgaacacatttgcattgtctttgtggaatcgaacttccctggcttcagaaaacagggtcaagaagaacaagtgatatcaactcaaaaatcgtaggtacattgtcaccgggcaaaaccatcttcatctccccaagcaaactcactcttcccagtgacatcagtttgtcctga

SEQ ID NO: 10199 - DNA, 672 bp, Zea mays
  misc_feature: Ceres CLONE 988042-R
  misc_feature: Translation starting site: 182
  misc_feature: SWISSPROT Homolog: EC 4.2.99.18 DNA-(apurinic or apyrimidinic site) lyase
cgaattgggtaccgggccccccctcgaggtcgacggtatcgataagcttttttttttttttttttggccaacacgggcactttcaacatttaaggagataacattgtcaattacaccaacatggtttgtctactaaaacataatgcactaaaataataagcagaagcaaaacttgcggcggatggacgataagagcggcttagtcgtcgaacaggctgaagcccatttcctcgtccgactcctcggcaggctctggagccttctcttcctccttgggggcagcagcagcactagagtccgcagcagctacaggagcagcaacagcaaacttgctcgggtccttgaggtactccttgatcttgtcggcgtgtgggtacgagtagtcagtctccacagcaacagcaagcacgttcttgtacccattgataaacatgtggggcacagcagcaagggttgggtacgatagtgccagggaaagagaagcgaccatggagacaccagtggcgaacttctcgattaggtcctcctcagaaaggtcaagcacctcagggctgaacacagacccatcctcgtagacgctggtgacctggagaccgtacgagaagggggcggatgcccagccttgccaaacaaaagcaaaaatcccgaaaaaaaaccccccctttttttttt

SEQ ID NO: 10200 - DNA, 666 bp, Zea mays
  misc_feature: Ceres CLONE 988169-R
accgggccccccctcgaggtcgacggtatcgataagcttttttttttttttttttcttacacagacaacaagagtcagccatacagagcaaagcagtgccaactacctaccaaagtgtgtaactgaatgaaagaaaacagaacacaagaagaagaagaaggacaccacaccacagacggacaacgtaagctcggattggttgctcgttcaccagattacagattcctcatctctctttacagttacagtctacacaaacacaaacaaacaaaaatcctaatccacggctggcttcaaaggctccagacgccatgattcgccggcgggcgggcgagcgggtgggtgggtgggcaaaaaggttgctgggtcaataataccaagctgcaagcagaaaccagtcgtcggctggctcggctgccccgcgcggtcggtcagtgcgccgcggcggcggcggcggcggtgcagcggcgctggcagaagttggggacgcggtccatgcactggtacaccggcgggtcggcgctgaggctggacttgacgcagtccctgcaggccgggtggcacccgcggggcgccgcgtccaggcactggcaccgcggcggctccgatctggtgcacccgccgcagctgtcacagcacggccacgcgcgcgccgccgccttcgcc

SEQ ID NO: 10201 - DNA, 716 bp, Zea mays
  misc_feature: Ceres CLONE 988301
  misc_feature: Encodes the peptide sequence at SEQ ID NO. 10202
agccgtcatcgtttcgcgtccgcctcagcccgccgcaaggagaggtaagttcaggagacatcttcgagaagctgaaatggctcctaaagtttcattagctgctcctgccaagaagggtgatgccaagacccaggccttgaaggttgccaaggctgtgaagtctggggcagccaagaagaagaccaagaagatccgcacgtctgtgacatttcaccgccccacgaccctgaagaaggctagggaccccaagtacccacgaatcagcactaccggaaggaacaagcttgatcagtaccaaattctcaagtacccccttaccacagaatcagcgatgaagaagattgaagataacaacactctggtcttcattgttgacctcaaggcagacaagaagaagatcaaggctgccgtcaagaagatgtatgacatccaggcaaagaaggtcaacaccttgatcaggcctgatgggaagaagaaggcttacgtgaagctgactcccgactatgatgctcttgatgtggccaacaaaatcggaatcatctaagtgctgcattaggcatctgttgtttcctagttcaatctgttgtgtcctagttctatgtgaaaccagagttttgtagctatggatctcaatcgttccattaccatgtgttatgcacacttctgaatttgatatcatccaagtgaccggttgaactaaaaaaaaaaaaaaaaaa

SEQ ID NO: 10202 - protein, 155 aa, Zea mays
  misc_feature: Ceres CLONE 988301
  misc_feature (73)..(152): Pfam Name: Ribosomal_L23 Pfam Description: Ribosomal protein L23
  misc_feature (14)..(67): Pfam Name: Ribosomal_L23eN Pfam Description: Ribosomal protein L23, N-terminal domain
MAPKVSLAAPAKKGDAKTQALKVAKAVKSGAAKKKTKKIRTSVTFHRPTTLKKARDPKYPRISTTGRNKLDQYQILKYPLTTESAMKKIEDNNTLVFIVDLKADKKKIKAAVKKMYDIQAKKVNTLIRPDGKKKAYVKLTPDYDALDVANKIGII

SEQ ID NO: 10203 - DNA, 827 bp, Zea mays
  misc_feature: Ceres CLONE 988911-R
  misc_feature: Encodes the peptide sequence at SEQ ID NO. 10204
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (20)..(20): n is a, c, t, g, unknown, or other
  misc_feature (27)..(27): n is a, c, t, g, unknown, or other
  misc_feature (55)..(55): n is a, c, t, g, unknown, or other
ggttgtttttgnnnnnnncntttgttnttttttgtgtttgttggtttataaaaanttgcgtttctctttttttttttttttttttttttgccgattgggtaccgggccccccctcgaggtcgaccgtatcgataagcttttttttttttttttttgtttttttttttttttttttttttttttttttttttttttttttttttcacccaacaaatgatactgcattgttacttttaaaaccattctttaatgtcttgcccaaagcttcatttacatgagaaatctgccccaaaacaacccttccattaaaaacacattctttagccctggccccctacatacgaaaaggtcgatcagctacttttaacacaccagtaccttccacctccagcttacatacacatggggctttactactgtcaaacacccacaaagccagtttgttttctactactaacgtaatcgaagcctaagcaaacccccttgtttcttaaacagctccctacttacaattacctgtagccctgcacagccccaaaccccccaaaaacacgaactcggatcattcaaattttcaaatccttttgttaccaaccccccctaagtaaaagaatgagctttgccagctcctgagagcactgtcccctgtagctcccccgactcaaaaccccctgggacaaattaaaaaaccccccttgccaaaaaaccccccaaggaggccgggttctcttaccctcttcaggcggttccttttttttcgaatttttcccaatgtggaattttgtgggtttttgttggggccttcgcctctggggcaaatttttatt

SEQ ID NO: 10204 - protein, 71 aa, Zea mays
  misc_feature: Ceres CLONE 988911-R
  misc_feature (4)..(4): Xaa is any aa, unknown, or other
  misc_feature (5)..(5): Xaa is any aa, unknown, or other
  misc_feature (6)..(6): Xaa is any aa, unknown, or other
  misc_feature (7)..(7): Xaa is any aa, unknown, or other
  misc_feature (9)..(9): Xaa is any aa, unknown, or other
  misc_feature (18)..(18): Xaa is any aa, unknown, or other
VVFXXXXCXFLCLLVYKXLRFSFFFFFFFCRLGTGPPLEVDRIDKLFFFFFCFFFFFFFFFFFFFFFSPNK

SEQ ID NO: 10205 - DNA, 624 bp, Zea mays
  misc_feature: Ceres CLONE 988991-R
ccgattgggtaccgggccccccctcgaggtcgacggtatcgataagcttttttttttttttttttcgcccaacatccagtttatgtaaatataaaatacccaaaattggcttccagaggaagaagaccagagccacctagaatatatgaatccaacattacattaactcggtactgattaatcacaccaaatactatactacttagtattatatcatgctcatagatccatttcacgaatatatttccactagacgaaaactgcaataatatctatccatcatccgcctccctcatctatacaccaaccaagacgaatcgataaaaatctaatacgcacgcagaactcaggcatctgcaataataatcaggaaccagagatgtgaagccgatgcgcctaggaagagtgtgccccaccttcgggaggcagcgatggcatcccctccgagttgtagttgtagacgaccgcgcgcggcggcgcgtacatcatcggcgggaacgcctgcatgtgctgcgggacgccgtagacgccgccggccgcgtgaagatctccgccaggcgcctcgcttcctccgccaccgacaatgtggtagaccgggcgaggcatgtagccgccctgcgcaga

SEQ ID NO: 10206 - DNA, 668 bp, Zea mays
  misc_feature: Ceres CLONE 988994-R
cagattgggtaccgggccccccctcgaggtcgacggtatcgataagcttttttttttttttttttcaagaacaagccacggtaatggcaggtttcaaatttcgaatggtatataacagtttagagaacaactgaattgctttctaggtctgaacatcggtgaggtgctaaaaatgttacaaaagttgcacgcagcaccagccttgatagccagaagcctgggagaataagtcataattcaaacatacaaaatttggaccttgaatgcacgcacggcatgctatccctatgtatgactacatgtatcaataccttcatccaaacattcttacatagaggaggtggtgtatccagctccccctcgacgaggcaagacaacatgcctagtcgaacagagcactaactcttttttttactaaattcgtatgtggtacacctctgaatgcagtaggcagcagtgcaaaccccaagcagtaggcattctgtcctggcaagtaagcttaatgtggctgggggaacagccccagcgagccatttctggttatttgacctggctgctttcacgctatacaaggggcgaatagattttgaacccgcccttcattaattttgggtgggacataaaaactgtccccccggccttgaattatctttgcccattttccatga

SEQ ID NO: 10207 - DNA, 666 bp, Zea mays
  misc_feature: Ceres CLONE 989214-R
cgacgtcgacggtatcgataagcttttttttttttttttttagtttacacttcctcttattttggccaattgtattcacaaggtatgacgctactgatgaaactgcacaaagtccaccgaattgacaggcgcccttgggtacatagcagtgagactggaaaggtaacaaatggaatacggatacgtagataaccacggagacccagcaatgctaaggtattgtttggtcactgcataaccgacgatgatggtcacaacgcctcgtgatgcctcgtgccttaaaagcacccggatgatctctgggtccggttgccccccaccacgtccccggaatctgttttttccccccccccccgcgggggggggggggggacaacattttttccccataaattggaagggcccctcccacaaaattcccctccttaaacagaagtcccgaaggagcggaatgttcccttttggaaagaccccaagtctctttcccttttttctcaaaagaccccgcccgctaatttccgactatccttacatgcacctgttggttactccctctgccacccatagcggggaaccttactccccacttcctccaccggccataaccttagaattacaaaaagctctcacctctctaagcatatcacacgccctcggcaacacaag

SEQ ID NO: 10208 - DNA, 613 bp, Zea mays
  misc_feature: Ceres CLONE 989304-R
  misc_feature: SWISSPROT Homolog: EC 6.1.1.11 Serine--tRNA ligase
gatcgataagcttttttttttttttttttagataagtaccattcaatatctcataaataaatattttcaaataactcatacataagtgtactgtaaagccaaaactaaatactaattgaaaaacttggttatcaactgtttgcactaatattgagcctaactaagtatatatgaattcaagtctccacacttgtgcggccaccaaaatttgagttacattccatcttttccttctctgaaactttgctggaagcaggcgcgctgacaattggtgagacaattatttttgccacatttgagcaaaacttgcatttgggtcaagcagatttgacggaccaagaaatagtatatgaagaagcatccgacactctcccatcctgtgacaccagcagtacatggagtagagttggcatgatctcatttgtccccttgatcataagatgtctgcagaaggttatctatctgagacaatggccttttccaatgcgacaatatcaagcatcctgcaaaggtccacgtggttcttcaaattatcctctactctcttctctccaaatgcccgtacaattttattgtttgcctcgccatcgctgaatggcacagactcatgcac

SEQ ID NO: 10209 - DNA, 654 bp, Zea mays
  misc_feature: Ceres CLONE 989407-R
caaattgggtaccgggccccccctcgaggtcgacggtatcgataagcttttttttttttttttttctttttttttttttttttttttttttttttttttttttttttttttttttccaaacaatagcagggcttccattgacggaagggctccttccactagtatagtattcccccatgtttgtttcgcaaacacataaacgagccctttcaaaggccaaaaaataaacctgcaaacggatcctatcattgcaagggatccgttgcaccgtattatttagctgaaaaaactaagctttgtttccccccgtcaaccccctcaggttgctcgggcaccagctcacgctgtgccacaactgcaccgtttcctttcaccgtaaccgattgctgggaaagcacccccccgaggatggggaacagcaagcaaaccgaaccttacgccctggcatgcttgtcccaaatcatgacattgatggccacggggaggaacttgttcacgaccccggtcacggggaacgcggtccccaatacaactctcctggctgcgaagccaaaaaaactgatgagcagcccaaaaacgcacgaaagcgccaccgccacgacggggtccagttgaaaccagccttcgcccctgagctccatcgctgcgaagacc

SEQ ID NO: 10210 - DNA, 1042 bp, Zea mays
  misc_feature: Ceres CLONE 989525-R
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
actctaagcttttgttagggaaggggggtggaggaaaaaagcgaaagagggggggggataattaaataaatgcatggnnnnngggggagggggtcgggtcccccctcaaggtcgaggtatcgataagcttttttttttttttttttgggacagcaccttcttgatcataatataagaggaaagatgaaaacaatcaccaaacccaaaagtgatcctgtactattagtacattatatccacaaggggcagaagactggttcctaatcgaccaaaaaaagggggggggtaaacggggggggggcccccccccccccttccggaggttcgaacggggttaatctcgggaaaaataaaaggccccccgtggtagaggataatagttcgttggtatttgctatcttgtttttgggggcccccggaaaaaaaatttttttttttggaaaattttggggggggggggggggtttttggggggggaaaatttttgtgggggggggagaatttatttttccgggcccccccccggtatgttggtttgtctttctgggggggcatatattataaaaaataaagaagacggtatgattggtcgtgtttgtttgttttatccccccccccaaaaaagagggaggggagggcgtgagtaaattaatgaaaaggagggcggggggggcgcccaacaacggtgtaaatatgaagagaggagggagtgggggaataaaatttcttgtcttactagggggaaggggaaaaacacacacacgggggcgggcgccccccacaaaagggagggggggggggaggtgaaataaataatgtataaggtggtaaaagaagagaagaagtatgaggttggggtagcgccggagtaaagtttaaagtagacccaccctctgtgttagggagagagatagaagtaggggctgccgtagccgtaggccggggtaattaatgtgcggggtgggataggaaggcgagaaaacacactctatttgggtggggagaagggggaggggtagaagggcgcatacatagaaaaaag

SEQ ID NO: 10211 - DNA, 1668 bp, Zea mays
  misc_feature: Ceres CLONE 989534
  misc_feature: Encodes the peptide sequence at SEQ ID NO. 10212
atggtcctgtgtgtttgttagtgacgctgcattttgcaaaaggtgacacctgctcttcttcaccaaccccaaattcttcttcgtgttcatcgttcacctcatccttcccttcccttctctccccggctccaccagcagccgctcatcgaaaccttcccccactatccaccagcatcaagcagagatttcttccgccttctccagagctcgcatgcttccgtttcgtcctccgcgttcgcttccctagagcagagcaggtaggtagtcagtggccagcaatgatccgcgagttcctggccgtggcggcacgcgcggcgctggagtgggcgctggcgtcgctgctgctcgccaacggcgccgcgttctgcctcatcgccgccgccgccgcgcgcctccgcctcggcccgccgtgcatcgtctgcgcccgcgtccaccgtctgctctgctcctcctcctcctctgctgctgccagcgccaccggcgtggcacgcgacgctctccgcctcctcctctgcgacgcccacctcgccgccgtcgctccggatcgctgcgacggggatggtggtgtctcggagacggatgctgcgatggcggacgatgatccgaacacgttttcaggcatggagactcaccgcgacgtctccatcggcagcgagatatgcgagcaggaggaagacggcatcaaacaccacgccggcgaccgcatcgcaagaaccaccagcgccggcgacggttgcggcccgctcgtatctctcttcgagctggcgccgatcgtgtcgtcgcgaccacgggaggacgacgattccatagaccagctggcgaggacgatgccacagtcgctgaccctgaccgtggacggtgacgagagcctgacactcggggagctggtcaccgcgttcagggcacagaggagggaactggacgcgctgcgcgccgagctcgccgccgagcggcggctgaaggcggaggtcgaggagtaccagcgtcagctggaggagcagggcgagctcgaccgggaggctgcgcggctggccatgcagctcgtgtacgagagcgaggcggagaagcacggcctgcagcggcggcagctcgacgcgtgcggggccagggcgcagctgcagctgcagctgcagctctgccagtccgaccccgcggccgtggaggacgccggcggaggctgcagtggcgatggcaacaactaccagtcgctcgtggacttcttgccggggtcggtgcactcctcctcgccggacctggccaacctccttagactctacactgaatctggccatgccggccgtcgtccgggtccggggcacggttacgacgtgccggccattgcggtgggtgaggaggcagaggagggggaagaggccgtcgctgtcaccgtcactgtcacagctgccactgaatccatcgggcgtgttgatgctacatctgccgccactgtttctgaatctttacaagaaagctccaatactttccacgtcgaaacgacagcaacggaagccgcttaatttgccggtcatcacctcgggtctgtcgcccatggtggaaacatgcacgaaaacacggtggtagtagtagtagaatgctttctcttgtacatcgatttgtttttgtgaatattgcaaaatcggtttgtagaatccaaaaaaaaaaaaaaaa

SEQ ID NO: 10212 - protein, 412 aa, Zea mays
  misc_feature: Ceres CLONE 989534
MIREFLAVAARAALEWALASLLLANGAAFCLIAAAAARLRLGPPCIVCARVHRLLCSSSSSAAASATGVARDALRLLLCDAHLAAVAPDRCDGDGGVSETDAAMADDDPNTFSGMETHRDVSIGSEICEQEEDGIKHHAGDRIARTTSAGDGCGPLVSLFELAPIVSSRPREDDDSIDQLARTMPQSLTLTVDGDESLTLGELVTAFRAQRRELDALRAELAAERRLKAEVEEYQRQLEEQGELDREAARLAMQLVYESEAEKHGLQRRQLDACGARAQLQLQLQLCQSDPAAVEDAGGGCSGDGNNYQSLVDFLPGSVHSSSPDLANLLRLYTESGHAGRRPGPGHGYDVPAIAVGEEAEEGEEAVAVTVTVTAATESIGRVDATSAATVSESLQESSNTFHVETTATEAA

SEQ ID NO: 10213 - DNA, 693 bp, Zea mays
  misc_feature: Ceres CLONE 990028-R
  misc_feature (1)..(1): n is a, c, t, g, unknown, or other
ncaattgggtaccgggccccccctcgaggtcgacggtatcgataagcttttttttttttttttttgcttcatgtaaacaccagcgtctacattttagattgcaccactagcagttcgcttcacatatggcatatctgcgaggtagaggaagatcgagtgatgtcgcaggcacagtactacagcagcacagcaagcttccaaagcttggggacaacacacaaaggctcacccacccacgcaagcaacgcaagcgcaggcagcaggtgtcatgtcacggcgacggcggccagtcgaagccggcgaaggtctcgccgaagccaccgccgtagaacctgacctccaggttctccaggccctggccgtcgtcgtcccagacggcctcgtcgtcgtcgtcgtcgctgccggcggcgtagtcgtagtcgtcgtcgacgtcgtccatgagctccacgagtagatgggagagtcgtccgagtagtcgtcggagcactcctcccagtagctgttctcgtagcagtcgtcgacgcgggggtcccaggacgcgcagccccccgggtgggcggtcccgccgcaagaacctttgtcttccacccgcccagaaacccgcgcaaggttccaggaaacctgaagctccggggaacccgccccaaggaattttcggccacccgcccttccgttcgcccccccagaaagggt

SEQ ID NO: 10214 - DNA, 665 bp, Zea mays
  misc_feature: Ceres CLONE 990230-R
  misc_feature: SWISSPROT Homolog: EC 1.1.1.288 Xanthoxin dehydrogenase
ccaattgggtaccgggccccccctcgaggtcgacggtatcgataagcttttttttttttttttttaaattctaacaatatatttttattagaagtagaggtccaatctcatttgtattataagtaaaccttacaatggggacgagcgaggtacatttatttttagtttagaaaaccgaagggcgacgggcggaccttacaaagccggtgccggtgagcaatcatgaatttacggagcacactgtagtgtgcagtgtgcccccactgatgtctagaacgacgactgatgatgatagatcacccacgctgccacgcagcgacgtgactgcgacgggtcccactgatgtaccgcgcagtgacttcaatctttggacgttccagtggatggattcgcgacggagatcccgccgtcgacgaacaggttgtggccgctgatgtacctcgcgtcatcgctggccaggaagagcacggcggcggcgacgtcgtgcacccgcagtgcgcccacgcccttgaggttggccatgccctccattgcctgctccaacgcctccgcctcgaggcccatgtacctcatggtcagcggcgtggcgacccccgcgggggagacgcagttcacgcgaatgccgtgctggccgagctccgcagccgcgttctccgtcagagtca

SEQ ID NO: 10215 - DNA, 617 bp, Zea mays
  misc_feature: Ceres CLONE 990282-R
  misc_feature: Pfam Name: DUF1675 Pfam Description: Protein of unknown function (DUF1675)
  misc_feature (186)..(186): n is a, c, t, g, unknown, or other
caaattgggtaccgggccccccctcgaggtcgacggtatcgataagcttttttttttttttttttaaatcacgcataggaaggatcaaaacattgtcaaaacattatcaacaggttatgttaccacaatgcccaccaatttaatcgggcataagcaccgcaccacacagtctaacggtgacattgnctctgacgctaggctcaggtcctgagtctacagaacactatagcttgtgcacgggtctgcctggcctcacagtcacaggttcggggtagcgctgacgacaatgtgtcgcagcgggttatctaccttgccggcgccggcgtgctccacaaactccgaaggagtaaggaagcttccatggcagatgcacacgatcctcacttctcctttgctgtatttatacaggaagccttcgaccctgctgccgttggacaggggcccttggtgaaacacgcccggggcatctccctgggcatcaatcctccctttttccaccgtcccccccaatgccccgtttttggcccccttgggcaaccccaaccccccctggcccctaaaaaaagggctttttggggcccttccccggggaaaaccaaaggggtttgctggtttat

SEQ ID NO: 10216 - DNA, 1006 bp, Zea mays
  misc_feature: Ceres CLONE 990399-R
gggtgcggttccctcttcgagtccatgcattgtcaatcatccattgcaggccatattatcttcataatagccccatcacaactccacaagacccataaacatcattaaaggttcacattgctcaacaaaaagagtatcttattattaaccaaaagattgtgtgatagctatcacaaccaccagctcttctccatgaaccgtcatgcatcaacctagcaataaatgtaaaataactataccatcacacattcgcctcctgcttggatcaacctagtcgattcataggtccaaatcacttaaatgcttcaatacccatgactcaaatagagcatcctctaaagacctacgagacctttggttgagaccctgtggttctcagtggttctcatggtagtgaggtcaccccacatgacacatagagcatgtaaaagtatgttgaagtacctgctaactgtttctccggaacgcatgaattcaaacccaccctgacctatgtgtgcatcgatgaccaaccaaacttttaggaaacataaggaactatggttttttcatcagagaccattgagacttttatcccctctaaaaagcctacgaagaccttgaaatggtcttacccttacccttatgggaaaaacaaatttttgttgaatgggggggagtttaatataatataaaatttgggacatttcttgtcccaattattaaaaaccgggggttgaaaacccacctttatttctcgttcccaaaatatctccgttggtaaccaaagggaccttttattttaaacacctttttccgtaaggtaaacccaatttctttttttttccccaaggagaaaacctcccccacaatggggaatgtccaaaataaacccccttttttttctttgggggaggcaccggggagtttaataattggaacaaattggaggaaagagatcctcctgtcacacccgtttctttttaaatttgaggttaactctcgcccgcgcagaaacacgtatgta

SEQ ID NO: 10217 - DNA, 586 bp, Zea mays
  misc_feature: Ceres CLONE 990606-R
  misc_feature: Encodes the peptide sequence at SEQ ID NO. 10218
  misc_feature (310)..(310): n is a, c, t, g, unknown, or other
cgaattgggtaccgggccccccctcgaggtcgacggtatcgataagcttttttttttttttttttacgacacaagcatttttttaattaaatcaacgcagtttaacatcttccaattccaagctttcgaacaaacataaggaaatgcgcgacaatccgaccacaggcatcacagaaagtatcgtctttacagcataaagcattccaaatttaatcttccacaaaatctccagcctctacatctgagtcatcttcctcttgctctctagtttgttcggcgtattcatcaagtgatgcagcaggaaagatantcaccttctcgacttctgtcagcaatcttttgggactgacggtcccactctcccccacctttgccctttgttcaaaataaccaagaaagggtacgtcgttccctctcccaaacccttgaaaccccttttaaggaatggggttaattttccccccatttcccaaccctttccaaaaaattcgtttaaacattggggccaccttttaaaaaaattttcccaagagcctttgggaaacaagttttaggggattttttttccccgaaaaattttttcttt

SEQ ID NO: 10218 - protein, 45 aa, Zea mays
  misc_feature: Ceres CLONE 990606-R
ELGTGPPLEVDGIDKLFFFFFYDTSIFLIKSTQFNIFQFQAFEQT

SEQ ID NO: 10219 - DNA, 677 bp, Zea mays
  misc_feature: Ceres CLONE 990636-R
  misc_feature: Pfam Name: PAD_porph Pfam Description: Porphyromonas-type peptidyl-arginine deiminase
  misc_feature: SWISSPROT Homolog: EC 3.5.3.12 Agmatine deiminase
  misc_feature (595)..(595): n is a, c, t, g, unknown, or other
  misc_feature (643)..(643): n is a, c, t, g, unknown, or other
  misc_feature (644)..(644): n is a, c, t, g, unknown, or other
ccaattgggtaccgggccccccctcgaggtcgacggtatcgataagcttttttttttttttttttgatccacgcctgtgtggcgtttggccgtttgtgccgtatagtataatagtacattagtactcatacagtatttgtcaacgaactgctgggcgtggcttatttcgcgcgcgtattggtgagcgtgataacgacaggggagcaacgacccacctactcgcacgctcttcatcgcttcgcctcgacgccggtttcacctaagacgggcgcacgggctgctgctgcgtgatgcactgaatgttcccacctcccagcgcgatgtcccgtccgccttcgaccatcaccacctcgtgatgaggaaacaccctctggagaaacacgtacgcctcctcgtcccacctgtctgccaaagaaagcgccatgatcccccccttgggcgatgttgaaatagtaagtaccaagggggcgaaatcctggccccctgggcgccgggcaaaaaatgcccaataaaaaaaaaccccggggcccccttcccctgtcaaggcaaagggaccccgggaaactggatctttcacccacttgggagactgcgncccccttttgcgtcgaagggagatggggagaaaaaaaaaaaaggcctnnttccaaccaaccgttggagactgatggtccctt

SEQ ID NO: 10220 - DNA, 796 bp, Zea mays
  misc_feature: Ceres CLONE 991505
  misc_feature: Encodes the peptide sequence at SEQ ID NO. 10221
attgtacgtgtcctacagtttcacacgtggagcgcagtgcgacgcgggcgggcggccggcacctgccaccgcgataccgtaccctttctggagatttctcgccgccctttttatcacccacctcgcgccgcactgtgttcatccactgagcactcgcacaagcagggacaaggaagtgcaccggcggcgtcgccgtcgatcgagtagatactagatagtgtgtcaggttgctgtcagctagagccatggcgtccatgcagaagagccgcgagcagcgcgcccaggccgcggcgcagaaggcggccgacgagctccacgcgtcgaggcaggacagagtccccgaggaggcgcccgtcagcccccgcggcggcggcggcatcctgggcagcctgcaggaggggaaggcgaacgccaggggcgtggcggacgccgccatgggcaaggccagcgagacgaaggacgcggcggcggacaaggcgggtggcgtcagggacgcggcggcggacaggacgggaaataataaggcgggggccsccgagtcggaggaggacgtgatgctaagggtgaaggcggcggaccagatgacggggcaggcgttcaacgacgtcggtacgatgggggaggagggcaccggcgttccgcggagacgacgttytggctgatggccgctggatcggaactggcctggctggcgctgtgcttytcatgtaaaattagcatgcaacgacaaatgaatgttacataagaaactacaataaataaaagggtgtttggtttgacaaaaaaaaaaaaaaaa

SEQ ID NO: 10221 - protein, 138 aa, Zea mays
  misc_feature: Ceres CLONE 991505
  misc_feature (97)..(97): Xaa is any aa, unknown, or other
  misc_feature (137)..(137): Xaa is any aa, unknown, or other
MASMQKSREQRAQAAAQKAADELHASRQDRVPEEAPVSPRGGGGILGSLQEGKANARGVADAAMGKASETKDAAADKAGGVRDAAADRTGNNKAGAXESEEDVMLRVKAADQMTGQAFNDVGTMGEEGTGVPRRRRXG

SEQ ID NO: 10222 - DNA, 682 bp, Zea mays
  misc_feature: Ceres CLONE 991520-R
  misc_feature (275)..(275): n is a, c, t, g, unknown, or other
  misc_feature (317)..(317): n is a, c, t, g, unknown, or other
  misc_feature (318)..(318): n is a, c, t, g, unknown, or other
  misc_feature (332)..(332): n is a, c, t, g, unknown, or other
  misc_feature (461)..(461): n is a, c, t, g, unknown, or other
  misc_feature (500)..(500): n is a, c, t, g, unknown, or other
  misc_feature (682)..(682): n is a, c, t, g, unknown, or other
cgaattgggtaccgggccccccctcgaggtcgacggtatcgataagcttttttttttttttttttgacccacgacctcatgtcaccaatgtcactgaactgaggggtgacgaaataaacttggtcactgaccggctgaaactgacgggtgacgaaatacatttgacacgggatacatgcatgcacgtactgatgtacaaaccagaaccgagagatctgatgacctgacgagatgagcagacgatggactgactagctagctactaggtacacacngtacgtagtatacgtggtacgtcaacacacaccatatatatnnatatatgggtactnacttattacgtcatcacactccagcagcgcctgatatgatgacacatgtacgagctgcatcgatcagaatcctcagaccctggtgaccccccttgggctcgccggccgcgccgccgaacgccgtagtcngtggtcccggtagccaccgctgccgccgaagaaggccgntgtggagcatgagcacgtagaggagctgcgtgaaggcgaggattgatgacgaaggcctccagcacgcgcaggcgccagccgcggggtccgcccgatgtggatctccttgcaggccagcccgaagggcgagcgccgtgatggcccaggcgatgagcacgacgccggggcgttggtggcccagn

SEQ ID NO: 10223 - DNA, 855 bp, Zea mays
  misc_feature: Ceres CLONE 991697-R
tgaggcacagagcaatacaataaaacataaaaccatacatttggggagtatttaatttattacaacatcatcggagtttatcaaaagtagtgatcattgttcggaatgcagcggaatataactaacggtaaataatcggagggatggggaagcctatcccatcactcctcatgctcctcctctgccgacgtagggtcccactcgactgtccaacccactggcaagatggacggccaagtcactccatcaaccatgtcctccacagaaccttccaaagctggggcaggcagatcctcgatggcaggctctggtgctggctcctggactacctcctgagcaactccttgctccggaatgaggatgtattccccgtcagcgagattacagtctccgacgaagagcttgtaagtgatgccgcgggactgcgcgaggagcacgggtcgccaggccgcagatctccccctggacgccaaacagcgggaggtttcccgcagcgccgccatggccatggtcgcactttatgtccggaagtgcgagacggaagcacggaggcgaggtgtggagtgtacgcacaggtggcgtgtttttgatttttttttcgattagtatgttctaggtaatggtctcgtgcgaattcctgcagcccgggggatccactagttctagagcggcccgccaccgcggtggagctccagcttttgttccctttagtgagggttaattgcgccccttggcgtaatcatgggccatagcctgttccctgggggaaaattggtatccgctcaccaatccacacaacataccgacccggaaacataaaggggaaaacctgggggggcctaatgaaggagccat

SEQ ID NO: 10224 - DNA, 621 bp, Zea mays
  misc_feature: Ceres CLONE 991974-R
  misc_feature (1)..(1): n is a, c, t, g, unknown, or other
ncgattgggtacccggccccccctcgaggtcgacggtatcgataagcttttttttttttttttttggtttaggggtaaaatagtccgatcaattgatattttgtcaaataaccccctaaatgacattttgtctgtaagctagtgtttgagaatggcgtattaacgaagcacgttctcataatggcattcgagcgaatcctagatttgataatggcagaattccaattttctcctcacaaagttggtccacctgctcgatggatggcagtccacgaacgagctccctccgcggcatcttcctcagcgccagcatgttgatgtggccgaagcctggcatgccaacgccaggcacatttcttccgcgcgcgcttgcagggaacaccggccgttgcccttcaaactttaaacccattacaccggtttccctgccccggggaaccttggcaaaaatttgccccttagggttcccaaatttccttggccccccccccgaaaggggaaccccaaaaccgcctccccccaaaggggcaagggccccaaaaattccccccgggatcccggggaatgtgaaaaaacccccgggaaaaaaagaaaatccccccattttttggaattttaaaa

SEQ ID NO: 10225 - DNA, 1119 bp, Zea mays
  misc_feature: Ceres CLONE 992030-R
  misc_feature (1047)..(1047): n is a, c, t, g, unknown, or other
accccccccccccctaatcccccacgacaacacacccctttcccgaattggataccgggcccccctcgaggtcgatgttatcgataagcttttttttttttttttttgccaacgaactttactttaatctgcaagaggattcacaactccacaggattggattttatccctcgacaaagcggcctactgatcaacatagtacttggctagctagttttctagggctggacttagaacgtttcgcctcttcttcttttttttctcacttgttgggaagttgggagccgcagccgctgtaaaaaccagggcgcgccctcctctgccgttggtttctcttttcaccgacggagacacgatcaaacgaatgctgcaaagctgttgagcgaaggacgagcaagtatggcgtatgtcacgcgcctgaccgatcgggaggagagagtcgtatcgtacatgccatcgaggacgtttttcgccttgccacgaaaccgtattcctcgggggcctggctgtcccaaaaccttaagccacgcaaaaggaagaaaattactctggtagtccagcacgcccaatttcggggggatcaaagcaattatattccatggaccgtccgacataaagcggttctgggatggaaccacccatccaaccaaaaagcggtggaaaccggaataagaggccaactcaccctccgctaagacagagcctcgcgataaaaagtgtcccatgaggcctttctcgcgaaccgaagggaatataccaccggtcgcgccccactctaaactccgcgcacaccaaaaccgatatttccacccacaaaaaacgcggatacaagtgggtgcccattgtacccttagagcaccacctcaccttgatctcgagcaccacaaagacgcgcctatgaaaaagggtcttggccagaataaatttacaccaaaactcgcctgctaatatatcgctatcccgttcgcagcactatggcacagttaaagggtacctaatagagcatataccacgcaagaccacacgtatttaccgtatactcgccancgccatgcttataccacactacattcaccaccatcttactatacacacctcagaacgatgcggcgagccgag

SEQ ID NO: 10226 - DNA, 737 bp, Zea mays
  misc_feature: Ceres CLONE 992317-R
  misc_feature (16)..(16): n is a, c, t, g, unknown, or other
  misc_feature (17)..(17): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (51)..(51): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
aaaaaaaaaaacaacnnannnncnnnnnnnnnnnnnnannnnnnccccacnannnaacnnnaccnnnnnaatnnnnnnnnnnccaattgggtacgggccccccctcgaggtcgacggtatcgataagcttttttttttttttttttactaacaagtggcgtgtaatatataagatgtgccactagcacgtgatacaaacgaacaaacaacaatcacaaacagcacaccaacacatgcatggtacaaaataattaataatgatacaaaaagataacatatatagccaagttccagctataggcactggtggcgcgtcattgcatggccgtacgtggcgcctcactaacgcaggctagcgtacgtcacgtagctgtagtagtccctggtggtcttccgctgatccctcggcggcgcagcgttcatgtgcatggtagctgcggcagggcatgacacctgagtgcttgcctcctccgggcacgtctttggatggctctggaaaaccgcacactccgccgctggcctctggttggcaaagcccgaaatgcagttgttcttcacgtccaggacgcccgtctttgatcagcgctgcgcatgcccggcccgacggcgaaaaaagtagtttgcaagacaaaggttagaattgggaaagggcggccagccgggccccccgcgaagcctgcaagaagagccgtccggggaacttggggcattaaaagggcgggtttcccggggccaag

SEQ ID NO: 10227 - DNA, 937 bp, Zea mays
  misc_feature: Ceres CLONE 992374-R
  misc_feature (11)..(11): n is a, c, t, g, unknown, or other
  misc_feature (52)..(52): n is a, c, t, g, unknown, or other
  misc_feature (60)..(60): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (488)..(488): n is a, c, t, g, unknown, or other
  misc_feature (722)..(722): n is a, c, t, g, unknown, or other
cataaatcganggagggagaggagggggggggggggtggtgggcgccccccnccccctcntcnnnnnnnnnnnttttnnnnnnttacgattgggtacgggccccccctcgaggtcgacggtatcgataagcttttttttttttttttttaaacaaatcaggtcctgccttgacaactacaagcgcccaaagtcatttagtcaatacttaaaacagaaacgttgtgctcctgcctccacaattgtatcagcagcgatgtgtcaagggaaacccaaaacactggaacaaaatctcagactcgatcctacagaattacagttgtgccgaccggacaggcaaaacatgctggggggcccctagcattttccagcatcttgggggggctaaaagaatctcaggcgtcattggcatatgggggacccggcgcgttggggctggttgtcctcccgcacccagcggggggggggggggggggacccaaaaaaagtnttaatatcccaacccccccttaagtttttgggggattacccgttagggaaacccggctccaggccaccgggggaaacagccaggaaaggtggacacccatcgtgttaagatgggccgggggaaaggggagggggggtaaggggcaggcgagaaaccaatcacggcgaaaatgtgctcgctggggaaccatggaaaaagggtgaaaagggggggagaggtggtaatgataaaacnggggggggggaaaaaaaaaatcaaaaaaacggcaagggaaaaaacaagtggggggtggggtgcggggacctaggggggggggggggagaccaaaacataggggggggcgcagggtttgttcttatgtgagtaacagtccgggacaggagggaacaaccagaggagaaaacacgcccgaagggggtccccgcttcaatttcgtaaagaggtcgcga

SEQ ID NO: 10228 - DNA, 655 bp, Zea mays
  misc_feature: Ceres CLONE 992472-R
  misc_feature (655)..(655): n is a, c, t, g, unknown, or other
ccaattgggtaccgggccccccctcgaggtcgacggtatcgataagcttttttttttttttttttcgtctcacggatgctgctcaattcaagtgggtagcaaccactaagcacaatcctccacatatacggactagctcatgtgtaacaacgggcgcacacatccatcacacatgagagctttccggaggccggtcgccggcggcggcggcgacgggtacaggatgcgacggagacgcacgcgcggtcgctctcggccgcaatcgacgcacagaacccgcggtcggaccagcgacgggcatctcacaccaaatgatgagaaaaagtgggggctagctagagccgcgccaacgtgcggcgcgggacggggacacgattcccggcccgcagccgcgcgcgcgcacacacacgatttacagggcacgacgtatacatacacaacaagacccacttgtccctctctctcctgcttgatcgggaacgcgcccggccggtagcagtccactaaagattccagggaccgtacgtacagcagcggcggctagcgctagccaaagctgctgctacatgaaggacggcgaccggatgtccatctcctgcgtccaagcgctcttgtcctgggcgtggacgtgccagtagctctgtgccaccgcgtn

SEQ ID NO: 10229 - DNA, 598 bp, Zea mays
  misc_feature: Ceres CLONE 992803-R
ccgattgggtaccgggccccccctcgaggtcgacggtatcgataagcttttttttttttttttttaaccgccatggaaacctcaactccaaagctccattacaaaaacggcttggaaattggaattctactacgctttctaggctgcttagaaataccagaagaatacaaaaaaaacgaaaagaagcgcagctggatctctactccctctactgatctgcatctccttttccttgcctactacagtactagtaggaggatacgtacatctgacaagacgacacccgggcccaaacggaaacctcattcaattcaccagctggtgcgatggaaaagacatggagggggaaaaaaatcagtcgaaacgcattcgatccctgcgcggctttggctacggtgggccggccggccggccagcacgggcgctgcggcggagccgtagacccgtaagggactggtgctgctacgtcatgtcagccgttgggggatgcgcacggcgagacggttcccgttttcctcaatgcgggagctgctgcacctcctgagtggcgtcgaccgtggccaggagccagcggtctgacggggagcactgtgacctg

SEQ ID NO: 10230 - DNA, 983 bp, Zea mays
  misc_feature: Ceres CLONE 992981
  misc_feature: Encodes the peptide sequence at SEQ ID NO. 10231
  misc_feature (701)..(701): n is a, c, t, g, unknown, or other
atggaaacaacttggctctggcaaaggcgatggtagttgtggttcgtggcggcggcggcgactccctcctcgccaagaccacgcagggccataccgacgtcctcctcctcgactcgaacactctggcctgtgctataactcttaatcctcttcgtcaagaacccatccttactcccaagaaggacctccatccctgcaggctccccagcatataagtccatggcaatgaagagatattgagctaccataactatgtcttgatgaccacatatccattggagcatgttgaactgactgccaagaccaagagagataaatgcactacaagttgtgcatgtgtggattcagtcagcatcgacgccatactcgagcaacacctggacaatgttggcgtggccttggccgacgacaaggtcgagcagcatgcagtcagactcgtctatggcgtctgtagcacgtcactcgggctctctgtggttgagcacctccttgagctcctcgaccgcgctgtcctcgacaacaagctgcgtggccacagatgctcctacaaagctcgccctgattccattgtccacaaacaactgcttcattctcgttgagaaccactccaggttgactgagcccatcgttgtcatgggttccttcgccacgacgccggctgcgaccacgctgtgcatcctcgtgacatcatcaccaactanctctcccaccatcctttgcatccaacaaggtaactggtggtgatataaatcatgagattctagaatatggctctattatactgaattgattggttggaaaggacaggtaactactgaattcgtgtgatttcttgttagatgtaaatagctaatgattgcaactgaaatgtgtcgatttattattgcaaccaaaatatgtcaatttatctttatagttagtattattgtaaaggtttggaacaattttaaacaactatctcatttaaaaaaaaaaaaaaaaaa

SEQ ID NO: 10231 - protein, 112 aa, Zea mays
  misc_feature: Ceres CLONE 992981
MTTYPLEHVELTAKTKRDKCTTSCACVDSVSIDAILEQHLDNVGVALADDKVEQHAVRLVYGVCSTSLGLSVVEHLLELLDRAVLDNKLRGHRCSYKARPDSIVHKQLLHSR

SEQ ID NO: 10232 - DNA, 1057 bp, Zea mays
  misc_feature: Ceres CLONE 993596-R
ctgcctcccccccccctccctcccccaacacccccatacaaccaaaacgcccacgcatttggtacgggtcccccctcgaggtcgacggtatcgataagcttttttttttttttttttgccagctgtacctcgaaaccacacacgcacggggtctaatattacatagaaataatacgcatttgtttaccacttccaaagatatccctggaacttgcaacaaccgttgttcactgcgggtcacgatacaagaacataaaagtcataaaaaatcactaagacaggcaggggcaccagatgtagacgctgttttttaccccataaaactttcaattactgttggatcccatgacgggcccagtgaaaacttcgttagaagaatgtcccttctggaggccgcactaactttcaattctgggagggagacatctctttcttgaactggatgaaggaagttctccatcgtggaatcccgctgccagattcgctaacaaaccaaacttcctttggataaacccattccttgttttccgaataaaacgcatgtcctgggcgaatttcttgaataggcaatcactgaaaaaaggggggaacttcccccggaataggaccctttgcacaccacaaaacaccacttctatctgtggtacaaatggcgaacccctccattgttatcaagcaaatttgtagaagggagcctcatatggaataggcttttccctctctcccttgggatccggccaagtttaataacattactatcgccgcaagtcctcccaacttcccaaatatgatcacaaggtgtctacctatcgactcaaatgggacacctttcttcctctcaccgttttgggaacattccatcacaaactaaaacctacaaagatttataggctaaaaactacagacagatcttctatctcctggaatccgcgaatataactccagatgccaacccacccccccttcttcgaagcatacgcggagctactcccaacgacaaaaaaagattatcgggaacattcccccctccccctaaagaaccgaaaacctaacacat

SEQ ID NO: 10233 - DNA, 697 bp, Zea mays
  misc_feature: Ceres CLONE 993948-R
  misc_feature: Pfam Name: efhand Pfam Description: EF hand
  misc_feature (697)..(697): n is a, c, t, g, unknown, or other
ggaaccaggacgccgagacgactcggtaattacacccgtaacgcgattgggtaccgggccccccctcgaggtcgacggtatcgataagcttttttttttttttttttgtaaagaagaacaaaatccatgattggaaaagatgaaaatatatagatctcttttgggttcattcatctcgcacgacggagatgatacgagtagatgacaccgaaaaaacaggtccacatacaggtagagagattttgcaacagaagaaacacgcggagaccgacacaacccagccaggcacgacgacgccagaatcacgccccctgcatcatcatgcgcgagaagtcgaggaagcagacgaagccgtcgccatcgccgtcgacgcggccgatcatgcggcggcagccccctacggagcaagcggcgtccccgaccgcggagagcactgcgcgaagctcctcccgggagatcctgccgtcgccaacagcgtcgaagaccgccaacgcgtcgcggaactcggcctcgtactccgactccgccggacacggcctgctcggtcgcgaagcccgaactcctccgccatggaagagcaccgggggaagatctgcgactcttttgcgcaacatctcggttgtatcatccagatgttgggattccccaccgagggtcagcagccggcgcgcattccatacgcccccgccacggctan

SEQ ID NO: 10234 - DNA, 892 bp, Zea mays
  misc_feature: Ceres CLONE 994115-R
  misc_feature (19)..(19): n is a, c, t, g, unknown, or other
  misc_feature (20)..(20): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (800)..(800): n is a, c, t, g, unknown, or other
  misc_feature (811)..(811): n is a, c, t, g, unknown, or other
  misc_feature (821)..(821): n is a, c, t, g, unknown, or other
  misc_feature (827)..(827): n is a, c, t, g, unknown, or other
  misc_feature (828)..(828): n is a, c, t, g, unknown, or other
  misc_feature (830)..(830): n is a, c, t, g, unknown, or other
tcaagagacagggcccccnngttnnnnnnnnntttttttcgattgggtacgggccccccctcgagtcgacggtatcgataagcttttttttttttttttttagactcagaaccattgcaaactcattaactttagacgaaaaaacatcagtacccgctgttttttaagataaatgtattatttgaaaaaaactggcccccactcaaacaataaactccgaaccaagatgtttttttaaaaaactctgcttccaaaaaaacttttttcttgtattagaccttaaagggatttaaccttggccttccccagtacaacaaatttttcccaaaagtggaacccccctgttccttttttcccccaaactcctagaaaaacctggtaaccccctgggattttttttttaaaaaacccccacacaatgggggggaaaaattctgtgggggagaagttctctttttttttgaggggggcccctctttggaaataaaaaaggggggggcccccccccaaaaataaaaaaaaagtttggtataagtgttgaaccaccgaataattacccccccccccaaaaaaatattttttgtacccccccccaccactaattattaatatcggttttttgttcttttatggtgagggagggagagagagtatatattctcaacagccaagggcacacagaaatatagtggtggagaagtataatgtccccctcccccctctcattaataaaaaacaacctccccctcttgtattatattatgagaaaagagtttaaacccccccaccaaaaaaaaaanaacataataanaaaaaaaaanagaaannangttaaaataaataaaagtggggttggggggatttttcttactattcgggtggtgtgtatgga

SEQ ID NO: 10235 - DNA, 665 bp, Zea mays
  misc_feature: Ceres CLONE 994226-R
  misc_feature (629)..(629): n is a, c, t, g, unknown, or other
ccaattggggtccgggccccccctcgaggtcgacggtatcgataagcttttttttttttttttttagaacaaaaaaagacgtccgtttagaggccagccagaggcacaaccgcacaagcgttctcccgtgcattacattgcacaacacgaatgctataatactggcagtatactactgctgttgcttctacaaatactacgtcatctcgagaagtagccaagctgccacgtttcggaaaaggcttaagccgcataccatctcttttgtcctggtcggttattgtattgctaacatgcatcaccaattccagaccccttcacagcatctgcaaggtcgtgcaggcaacagtggcatcaaccaaccttttactcacttgtactcgaacgatggtatcggactgctgggcgtgtcgaagctctccaagatctccgacttgcccgcgctggatttcttctcttcatccttcctgccaatcagtcccccgaaccacccaccagcgccgctggagctcgccacttccggaggagccacgaccggctgcgcctgtggaaggccacgggaagaggtgtacgccatggcagcggtaatgttgggatcctccacgggcagctgatggttggcatagacncggttgagcataatgccggcgccctcgatgagggca

SEQ ID NO: 10236 - DNA, 1351 bp, Zea mays
  misc_feature: Ceres CLONE 994237
  misc_feature: Encodes the peptide sequence at SEQ ID NO. 10237
gtccactccacagtcacccaccgccgcctcctccagcgtccggcccgtacgccgcgcagccaacccagcgggcacgatgcaggcccacggcatcgccatccgcgcccgcgggccggtggcggcgacgcaggcccccgcgcgccgacggcaatgccgcgtgtctgcggcggcggtcggcgcgcccgccgcgcgagcccgcgtgacgcactcgatgccgccggagaaggcggaggtgttccgctcgctggagggctgggcggcgcggtcgctgctgccgctgctcaagcccgtggaggagtgctggcagccggcggacttcctcccggactcctcgtccgagatgttcgggcacgaggtccgcgagctgcgcgcccgcgccgcggggctccccgacgagtacttcgtcgtgctcgtgggcgacatggtcacggaagaggcgctgcccacgtaccagaccatgatcaacacgctcgacggcgtccgcgacgagaccggcgccagcaactgcccctgggcggtctggacgcgcgcctggaccgccgaggagaaccgccacggcgacatcctcggcaagtacatgtacctatccggccgcgtcgacatgcgcatggtcgagaagaccgtccagtacctcatcggctccggcatggatcccggaacggagaacaacccgtacctgggcttcgtgtacacgagcttccaggagcgcgcgacggccgtctcgcacggcaacaccgcgcggctcgccagggcgcacggggacgacgtcctggcgcgcgcctgcggcaccatcgccgccgacgagaagcggcacgagacggcgtacgggcgcatcgtcgagcagctgctgcagctggacccggagggcgccgtgctcgccgtcgcggacatgatgcgcaagcggatcaccatgcccgcgcacctcatgcacgacggccgcgacatggacctgttcgagcacttcgccgccgtcgcccagcgcctcggcgtgtacaccgcccgggactacgcggacatcgtcgagttccttgtcaagcggtggaagctggagacactggagagcgggctctccggcgagggccgcagggccagggacttcgtctgcgggctcgcgccgaggatgcgccgggccgcggagcgcgccgaggacagggccaagaaggacgagcccaggatggtcaagttcagctggatctttgatagggaagccgttgtttaggcacttgttgctaactgtgatatgtgctcagatcatgtcgctagctgtcagtgtctttgtcacattgtgtttatgtgtttgaaatgccgtaagagtgtttttttcctgctattatcaaaaaaaaaaaaaaaa

SEQ ID NO: 10237 - protein, 380 aa, Zea mays
  misc_feature: Ceres CLONE 994237
  misc_feature (47)..(378): Pfam Name: FA_desaturase_2 Pfam Description: Fatty acid desaturase
  misc_feature: SWISSPROT Homolog: EC 1.14.19.2 Acyl-[acyl-carrier-protein] desaturase
MQAHGIAIRARGPVAATQAPARRRQCRVSAAAVGAPAARARVTHSMPPEKAEVFRSLEGWAARSLLPLLKPVEECWQPADFLPDSSSEMFGHEVRELRARAAGLPDEYFVVLVGDMVTEEALPTYQTMINTLDGVRDETGASNCPWAVWTRAWTAEENRHGDILGKYMYLSGRVDMRMVEKTVQYLIGSGMDPGTENNPYLGFVYTSFQERATAVSHGNTARLARAHGDDVLARACGTIAADEKRHETAYGRIVEQLLQLDPEGAVLAVADMMRKRITMPAHLMHDGRDMDLFEHFAAVAQRLGVYTARDYADIVEFLVKRWKLETLESGLSGEGRRARDFVCGLAPRMRRAAERAEDRAKKDEPRMVKFSWIFDREAVV

SEQ ID NO: 10238 - DNA, 663 bp, Zea mays
  misc_feature: Ceres CLONE 994555-R
  misc_feature: Encodes the peptide sequence at SEQ ID NO. 10239
acaattgggtaccgggccccccctcgaggtcgacggtatcgataagcttttttttttttttttttagagcgtaaataacaattatattaacatattacacttcaagcagacataatgtcttaacctttattcatcaaagtacagcgaacatggacatccatccacaggaagatgaccgggggtatcactagactagcatccatggagcttagcatcatatcttcatctgcaaacttcttgcttattgaaaacttgaggttcttccagggataggaatagatcttaattcttaactactagatcaaccacttgcgacggggaagaaagcagggggcttcaggcgcggggtttcagcacggctgagaaatctgtggcgcgggagaaggtccggtgaggagatagttcattggcaagggtctccaacgacacatgacgatggtgagtagtagacatcgtgacggaggagcagaaagccgggctagtagatagtgcgaggcacgagggttgagcagcaccggtgtagtacagacgacaaagcagacggagctccggcaacggcaacaacacaacgtggtggcgcgagcacaacggtgcgcagcagcagggaggctcagtaatggagcaggggtcagcgaggcgtgaactccggcgagcacagtcgcg

SEQ ID NO: 10239 - protein, 33 aa, Zea mays
  misc_feature: Ceres CLONE 994555-R
MTGGITRLASMELSIISSSANFLLIENLRFFQG

SEQ ID NO: 10240 - DNA, 693 bp, Zea mays
  misc_feature: Ceres CLONE 994689-R
  misc_feature (532)..(532): n is a, c, t, g, unknown, or other
caattgggtaccgggccccccctcgaggtcgacggtatcgataagcttttttttttttttttttgttcaattgcaccatggtccacaaaatttccacctggatgattgaaggagttaaaagttcataataatacatcttacaaggcatatagaacgctcaacagccacaaaaaaattcactaaggaaaacgacattatcatgagaaaggccctatgtggcaagaggctcgtcggcttgtacaaagccatctttcaatcatctgcaaccctgtctgggaatcagcaaggtggagttacatgaattgccttagatatcatcaaatgcctcttcatcatcatcaccaaacatggctgccattttcatggctagctttgcagccatctccctcctttggaagtcaggcatgagtcttaagtttgatcgcatgttgccaatctccgacattattttctccaggtcatccagaccataatgctcgtcctcaaaaggatggttagcctctggaagatcactttgatgatccacagtgcntatatgttgtggttgtgtccacatgatcactattgtcggttttgttgctctgagttacagtattctcttcagcagtttctgtgggcgtgttagtcggggggagagttggatgctgaagagtcagtaccggcattcacgacttgatgtgtgtgatcctgtgc

SEQ ID NO: 10241 - DNA, 536 bp, Zea mays
  misc_feature: Ceres CLONE 996088
  misc_feature: Encodes the peptide sequence at SEQ ID NO. 10242
ctagctcatatttctgttctttcattttttcttcagccgccacaaaaaaatccggccgacagagtggccgtccgcgcgccttctttgtgccggckgctagcaatggagatgcgcactgcgcgctgcatacatgcatgctactcctttttctttgcatgcgtgctgcatgctacttttctctatctttttttttaatttctctcacgccgctgttttactctccctctgtttctgttttggccggcgacgttttttttttaatagcaacacaagaaaactaagacagcagagcagaccgcctggaaaaaaaaaggtcggtctcttgaccgtcttctacatttgaactcggatctgattattcgagcttttctgtgatgttattttagtcctgaggccctatggatgcgtctgcagtgctctgcgcacttgatccgatttctgtaaacgttttctgatcacagatttgagcccaaaaaaaacgatattgggcctttgggacagagcgtgcggttttgggattaaaaaaaaaaaaaaaa

SEQ ID NO: 10242 - protein, 70 aa, Zea mays
  misc_feature: Ceres CLONE 996088
MHATPFSLHACCMLLFSIFFFNFSHAAVLLSLCFCFGRRRFFFNSNTRKLRQQSRPPGKKKVGLLTVFYI

SEQ ID NO: 10243 - DNA, 831 bp, Zea mays
  misc_feature: Ceres CLONE 996157-R
  misc_feature (11)..(11): n is a, c, t, g, unknown, or other
  misc_feature (12)..(12): n is a, c, t, g, unknown, or other
ccaaaacccgnnacccccttccacctccccatcctcaccaaccctctgtaaacccacccattgggtaccgggccccccctcgaggccgacggtatcgataagcttggtgccctcggagacggcgtgcttggcgagctccccgggaaggacgaggcgcacggaggtctggatctcacgggaggtgatggtcggcttcttgttataacgcgcgagcttggcggcctcagcagctagcttctcgaagatatcgttaatgaaggagttcatgatggacatggccttggaggagatgccaatgtccgggtgcacctgcttcagcaccttgaagatgtagatcttgtaggtctcctcgctcttcttgcccctcttcttgcccctcttgccctcgccgccttccttggcagcggacttgcccgcggggacccgcttttccgtttttaaatttttcccggaggacacacttatcggccccccacctctttctgtgctggcttcttcagccgttgaaattcttcagggggcaaacagcgccgcgtcccccgctctcggttccatcgctcggtgtccgtcaccccgggaatgctcgtggtccggtgattgtccttcatctcacgcccctttttcttgggtccctttggccccgcctctgaccttagtcacggttttggggctcaccaccgcggcccgggtacttgttctctgggatccatgatgtcttgccggcgccaccgttgccattcctctcctggccgtagccccccctcggaacgaccccccggctggcagatcccgtttgctcctctttccgccctctcgttcttattgttcttt

SEQ ID NO: 10244 - DNA, 924 bp, Zea mays
  misc_feature: Ceres CLONE 996227
  misc_feature: Encodes the peptide sequence at SEQ ID NO. 10245
amctcctagattaataggtaatccatcaaccatattattgagaccaacaagcaacatagaaagtggaatccagtagcaacaacagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcagccctataggctccaacaagcaatcgcagcaagcaacatacctttatcacccttgttgtttcaacaatcgccagccctatctttggtgcagtcattggtacaaaccatcagggcacagcagctgcagcaactcgtgctacctgtgatcaaccaagtagctctggcaaacctttctccctactctcagcaacaacaatttcttccattcaaccaactgtytacactgaaccctgctgcttatttgcagcaacaactattaccattcagccagctagctactgcctactytcagcaacaacaacttcttccatttaaccaattggccgcactgaaccccgctgsttatttgcagcagcaaatactactaccatttagccagctagctgcagcaaaccgtgcttccttyttgacacagcaacagttgctgcctttytaccagcagtttgcggctaaccccgcaaccctyttacaactacaacaattgttgccctttgtccaacttgctttgacagaccgagcggcctcctaccaacaacacatcattggtggtgccctyttttagattgcttattagttgtaattcaataataaagttttttggatgatgtatgtggccaaccagaaataagaagttacatttccagattttaatgtgaaaaaaaaaaaaaaaa

SEQ ID NO: 10245 - protein, 240 aa, Zea mays
  misc_feature: Ceres CLONE 996227
  misc_feature (1)..(240): Pfam Name: Zein Pfam Description: Zein seed storage protein
  misc_feature (127)..(127): Xaa is any aa, unknown, or other
  misc_feature (150)..(150): Xaa is any aa, unknown, or other
  misc_feature (168)..(168): Xaa is any aa, unknown, or other
  misc_feature (189)..(189): Xaa is any aa, unknown, or other
  misc_feature (198)..(198): Xaa is any aa, unknown, or other
  misc_feature (209)..(209): Xaa is any aa, unknown, or other
  misc_feature (239)..(239): Xaa is any aa, unknown, or other
MATKIFSLLMLLALSACVANATIFPQCSQAPIASLLPPYLPSMIASVCENPALQPYRLQQAIAASNIPLSPLLFQQSPALSLVQSLVQTIRAQQLQQLVLPVINQVALANLSPYSQQQQFLPFNQLXTLNPAAYLQQQLLPFSQLATAYXQQQQLLPFNQLAALNPAXYLQQQILLPFSQLAAANRASXLTQQQLLPXYQQFAANPATXLQLQQLLPFVQLALTDRAASYQQHIIGGAXF

SEQ ID NO: 10246 - DNA, 799 bp, Zea mays
  misc_feature: Ceres CLONE 996302-R
  misc_feature (69)..(69): n is a, c, t, g, unknown, or other
  misc_feature (77)..(77): n is a, c, t, g, unknown, or other
ttcttttgttgggccggaccaaaaaaatatttggtctacacctaattagtatggagattaaaaaaaatnaatcacgngggggggcaattgggtccgggccccccctcgaggtcgacggtatcgataagcttttttttttttttttttgctggctctaatcatactctcatgtcaagctatcaacacagcctttaaagaccacaccgacacgcccaaaaatgtaaaatggaagagaataggggaggaagaagaagaagaaaacgagcaagtgtgataaaacgaaccctgctactattcacatggatcacattatcgtaattcagcgcctgactgactatacttagcaacgcaactgtgcagttagcagccaaacctccaccatggctttctcgtcgaaacgttgcactcatcaccatcatcatcaacggcggtcgatcccgccgtcactgccgagtgggccaggggctgtcagtgcagcagcctctgccgcttggctatgaaagccggcgggcagctggcggcgggcagcacggacatggccgccgccggcaccggccgcttcatgcaggcggggggaggcccaccgtggcggcgccctagcgggcagcgttcgtgtccgggggcgccgaaccctgggggcggggttgccgcccacccccggtaaacctggcccgggcggaacaaaacaaaaattccttgcagccaaggggggccccccgcccctcccaattaaagggggggggcccaaagaaaagggggggggccccctcttctacccaaaaaaaggggggcgctcccc

SEQ ID NO: 10247 - DNA, 780 bp, Zea mays
  misc_feature: Ceres CLONE 996306-R
  misc_feature: Translation starting site: 273
  misc_feature (12)..(12): n is a, c, t, g, unknown, or other
gaacacgttagncctccccctccgttacccgcagtactactattaattccccccattctacgattgggtaccgggccccccctcgaggtcgacggtatcgataagcttttttttttttttttttggcaagggcaagtggcacttccgtatgggatcccgatagcgggagaattcgcgtgaaccgaagcacctggccatatgatatgcttcaccaaacgcgaatggaaaaagtcgcaaaaggccacacagtcatacttttctttcatgctcgcatggcggggacacaagttggcggcgtaagaccaggcattgttggtgactgggtccccaaggtgatcaacaagggtctccaatggacccttaccggtgacaatggcctgaacaaagaacccaaacctatagaacatggccaatctcccgctcttgagttccttcaccttaagctcagcaaaagcctctgggacatcagcgaggcccaatgggtcaaagctgccaccagggtagaatgggacagtgacctcaccgaggggcccaccagcaatacgataacccctaacagcacccattaggataacttgggtggccccaaatggcgaagcatgcacttgggcgaggtaaaagggcttgggtttgcccaagaacgtccccgcccccccctccgctggaaaaatctcgggaaccccggacccttgaaaaccaaaccagcctttcttcccaaatctttgtaccccccgtattggcggggacaaaaataaactcctcgggtgtgaaacaaaaatg

SEQ ID NO: 10248 - DNA, 765 bp, Zea mays
  misc_feature: Ceres CLONE 996640-R
  misc_feature: Translation starting site: 245
  misc_feature: SWISSPROT Homolog: EC 2.7.11.1 Non-specific serine/threonine protein kinase
  misc_feature (13)..(13): n is a, c, t, g, unknown, or other
  misc_feature (19)..(19): n is a, c, t, g, unknown, or other
  misc_feature (20)..(20): n is a, c, t, g, unknown, or other
  misc_feature (45)..(45): n is a, c, t, g, unknown, or other
  misc_feature (424)..(424): n is a, c, t, g, unknown, or other
aagggtccttttnaaattnntcaaaacacaaatctatatatgcancacccccccccccttggcaatgtcccagcaatatatttttttgtccatgtacaccgcaaatcatgcaggtacttgctttgcttgctgttagttacatttggttctcctgacagctagaagctaaggtggcagagtgagtacagtttcagaggattgtacaggaggggcagagtctcttggagtgagatgactcactcccatggtcttccagctcctggttccttcgtttggcgagcatgaccttggtgaactcggtgtagttgatctggccatcgccgtcggcgtcggcctcgcggagcatctcggcgagctcgtcgtcggagaggcgctcgccgaggttctggaggacgtggcggagctcttcgcgcgagatgaagangttctgaccctggtcgaagacgcggaaggcctcgcgcaccctcctcctcgtcggagccgctggactcccgcatctggcgcgccatcagggtgggggaactcctggaagtcgatggctgcccgctgccgtccgcgtcctcctcgttccaacatgacctggcagctcctccctccgtccgggcgtctggccccaagagaaccgcaatcaccggtgtcccaggctctcttggggtcgaggaaccgttccccgtcccccccaatccttttgggccaaaaggaggggctctaactcgccgcttccccgggaaaacccccctcccgaaacccctgggccttcctttg

SEQ ID NO: 10249 - DNA, 795 bp, Zea mays
  misc_feature: Ceres CLONE 997067
  misc_feature: Encodes the peptide sequence at SEQ ID NO. 10250
aaaaggcgatgtgaaaatcggctctagagctgttttgagtgttgagagccggagctaaggaaaaccggctcccaacggctccgcatcgctctcgtgcgtttttgccactgacagctacatgcggatgggggctgtgcttcgtgaagatctcggcggcagcggcgggtcacatctcgacgccgacagcaacgggggcggcgtggagaagggtagcaagaagccacggacataggcagctccatcccgatggtgcacaagactggccttgtacgtgagggaggcagtaggagtgtggccattaagaagacgcgcattctagctcccgcgcgtagcsgtgctgcatgaaggtgatgttgtcgcaaaggcgctgtcaaggaacgcggaggcctgggacagggcggcggtcatggctcattgcaggcgcgtcgcgggatacgtgcataaggtgatcgtggaaatgtytaaaggggaaggagttgttttgctaaacagtttgtcctataaagaagttacttccgtaraggagccggagatggagccyttttatgaggagctggagctytgcgaaatagacccttagtttaggacmctgagtccttgttcgtttgtatcagattggagggtcgaaactatttctagccggattgtttctctaatttatataaactttgattagctggaacgattttaggtgtaatctgatgtaaacgaacaaggtytaagacaaatcagtgttggagatgcttatagcaagctacatggtgaacttatcatcgttcaaaaaaaaaaaaaaaa

SEQ ID NO: 10250 - protein, 57 aa, Zea mays
  misc_feature: Ceres CLONE 997067
  misc_feature (19)..(19): Xaa is any aa, unknown, or other
  misc_feature (39)..(39): Xaa is any aa, unknown, or other
  misc_feature (45)..(45): Xaa is any aa, unknown, or other
  misc_feature (52)..(52): Xaa is any aa, unknown, or other
MAHCRRVAGYVHKVIVEMXKGEGVVLLNSLSYKEVTSVXEPEMEXFYEELEXCEIDP

SEQ ID NO: 10251 - DNA, 1270 bp, Zea mays
  misc_feature: Ceres CLONE 997091
  misc_feature: Encodes the peptide sequence at SEQ ID NO. 10252
agattaggcgtggaattgtggcggcggcggccgtatcctcccgagctgctccctagacggcggccggtcctctacaggcggctccccagcggctacccagtcggcggtcgggactcccaagacgccgctcgtcttcctccccaggcgccaggcggccgcggctcgtgttcgtccccaggcagccacgcctcctgttcctccccaggcgtcaggcggccgtgtcctccccagccgtcggttcttgacttcatagggtatttgacactggaccaagattgtttgaggacactattaatgagatatgcaaatgttacatatctcattaatatctgcaaaaaagagatagaagatgacaataagcccatgggagttttcactaggacaggttggaaaaatttggttacaaagtatgaagaaaaaacaggcctaaagctaacaaagaaacaattgaagaataagttggacaacatgaaaaaggagtatacatggttcatggagttcaagaatgcgaccactggtcttggatggaatgaggcaaaacaaactgttgactgctccaaagattggtgggatgaacacctagcaagatgtaacaatccggataaaggtatcaaatgcaaccatgttaggttcagaaaacaaggaccaaaacatcttgatgatctacatatgttgtttgataaaatacatgttagcgggacaagtgcatcatgtcctggagatatttcatctgatgactcaagtgatgatgtgctagagatagaaagaactccagaaaatgatgaagtcaaagtggttgtttcgaaaagatccaaaccagtgaaaaggaaacgcaaggcctcatgtactgctgctgaggagaaggaagagaagagtccattctttcgactatataagaacacatgtttgaagatagaaacaacagcagagaagatatccacaagtgttgaagcatcatcaacacatccaacaagccaagtgcctagcattgcagagactatgaagatggtgaaagattgtggggttaaagagaaaatagctctaatgcacacaactacatttttgattgtgaagcctgaatttagagaggtcttctgcatgctggaaacaaatgaaggaaggtttgacttacttgagagggagcatgcaaaggaaatgatgaggcacatgtagaagattttgaattatttatttatattaatgtgttgtgagaactatttgtttgcttgctatgtaagcaccatttggaatgaaaaaaaaaaaaaaaaaa

SEQ ID NO: 10252 - protein, 292 aa, Zea mays
  misc_feature: Ceres CLONE 997091
MRYANVTYLINICKKEIEDDNKPMGVFTRTGWKNLVTKYEEKTGLKLTKKQLKNKLDNMKKEYTWFMEFKNATTGLGWNEAKQTVDCSKDWWDEHLARCNNPDKGIKCNHVRFRKQGPKHLDDLHMLFDKIHVSGTSASCPGDISSDDSSDDVLEIERTPENDEVKVVVSKRSKPVKRKRKASCTAAEEKEEKSPFFRLYKNTCLKIETTAEKISTSVEASSTHPTSQVPSIAETMKMVKDCGVKEKIALMHTTTFLIVKPEFREVFCMLETNEGRFDLLEREHAKEMMRHM

SEQ ID NO: 10253 - DNA, 1080 bp, Zea mays
  misc_feature: Ceres CLONE 997558
  misc_feature: Encodes the peptide sequence at SEQ ID NO. 10254
ctcgcccgctcgctccgcgctccctccccccctcccgcgcggatcacagacaggctcacggtcacggccggcctcccaattcgcaacctcgcctccgcctctcctcctacccctccgaaaaagcaagctccggccgggccgccaccaccaccaccgcgcgcgcgtgcacgcgctcccacacacagacagacagacagacagacagagtgagagacgcacggtggttcggggtctcccttctgccaggcgcacgaggagccatggcgcagcgcgacaagaaggaggagcccacggagctccgggcgccggagatcacgctgtgcgccaacaactgcgggttcccgggtaacccggccacgcagaacctgtgccagagctgcttctcggcgtcgaggtcgccgtcgtcccctacctcctcctcctcttccctggcgtccgcggcgtcgcagccgaggccagcagcgctcgtcgtagacgcggcagcggtggaggcgctggccgctccggcggccgcggccgtgggccaggctacggaagccgcggcgagggcgtccgcgagccggtgctccagctgccggaagcgcgtggggctgacggggttccggtgccgctgcggcgagctcttctgcggcgcgcaccggtactcggaccggcacggctgcagctacgactacaggggcgccgcccgggacgccatcgcccgggagaacccggtggtgcgcgcggccaaggtcgttaggttctgatgacgggaaggaaggaaggacacagcacaaaggctcgcagggcggagaaggggaggaggaaggcgtgcggacaaggtcttcggtgttattattattacgctgttcctttgattttaatctcctttttttttaaaaaaatatttgtcctatgggaatgggattgggagaagaggtggacgaagaatagtggagtaataataatggtggtggtgcagtggcggtggttgagggcccgaaacgatgaacagatgggttggattgggttgggtgtatgtatgtgtcacacgcaactttggacagaactattatactagtactaaaaaaaaaaaaaaaa

SEQ ID NO: 10254 - protein, 161 aa, Zea mays
  misc_feature: Ceres CLONE 997558
  misc_feature (102)..(142): Pfam Name: zf-AN1 Pfam Description: AN1-like Zinc finger
MAQRDKKEEPTELRAPEITLCANNCGFPGNPATQNLCQSCFSASRSPSSPTSSSSSLASAASQPRPAALVVDAAAVEALAAPAAAAVGQATEAAARASASRCSSCRKRVGLTGFRCRCGELFCGAHRYSDRHGCSYDYRGAARDAIARENPVVRAAKVVRF

SEQ ID NO: 10255 - DNA, 687 bp, Zea mays
  misc_feature: Ceres CLONE 997601
  misc_feature: Encodes the peptide sequence at SEQ ID NO. 10256
aggtcagggtcagcagcattctcccttccaaatgccgtcctccccgtggcctcccgctgccggagcgccgccgccgccgcagcagcgagcggcgcagggcacggtctccaccgtggcgccggagcgtcgacccgtcgagggttcccgatctgggccagcgaaggaggaggacacggctcggcttccgtctgtcgactactactcagagctaaagaccctggagcatgccgagaaaacaaaaaaatatcagggtaagcttgcagcacggttgaaggccaaatatttttccaacaagacttttgaagaaggatatgtgtttgaagaaattgttatagaatcaaagaccgtccggctaagcaggtggccgtttacaaggttgtttgcagatccagcaagattttgccgagaaaagagctctactgagaagggcatttctccacctctggctggtgttgccatgtcagatgactaagcacctcattaatatctgactcctggcatgtggcaactatccatcatgaccacccgacagataagaaccatagtttgcgtcactaacctgtatctgttatccttaaaatcagtgacctggagcttgtatattttcaacaggccaaagttaaaaccttatccagttttgaaccaaaggcaaattttcgttttgtagacaaaaaaaaaaaaaaaaaa

SEQ ID NO: 10256 - protein, 146 aa, Zea mays
  misc_feature: Ceres CLONE 997601
MPSSPWPPAAGAPPPPQQRAAQGTVSTVAPERRPVEGSRSGPAKEEDTARLPSVDYYSELKTLEHAEKTKKYQGKLAARLKAKYFSNKTFEEGYVFEEIVIESKTVRLSRWPFTRLFADPARFCREKSSTEKGISPPLAGVAMSDD

SEQ ID NO: 10257 - DNA, 1401 bp, Zea mays
  misc_feature: Ceres CLONE 997605
  misc_feature: Encodes the peptide sequence at SEQ ID NO. 10258
atttttcgccacaccgacggctcaaccactcccgcaccaccagcagcagcaccatgcgcccccgcctctcccctccatgacgaccccgctccccctcctcctcacagctcactcggccgccgcgctcctcgtcctcctcggccccaccgcccgctcgcgcaagcgcctgcgccgcgacgaggccagctccgcctcggactccgaagcgaccgaccccgaccccgaccccgaccccgaccctgacccggccccggagcaggaggcgccaccgccggcgcccttgcctctgccgcccacgagcctggacgactacccgctcgcgttccgggtctcggcgcccaccttccacttcctctcgggcctcctcgagccgctcctctcccacccctcctccctcccgtcccccgtgctcctcgcgctcgccctcgcccgcctcgcgtcgggtctgccctaccctgcgctcgcggagctcttcggcgtcccgccctccgccccccgcgccgcctcccgccgcctccgccgggtgctcctcgccaacttccgcttctggctcgccttcccctccgacccaaccggcgcctattccgccccgctcccctcctgccgcggcgcgctctgctgcgcgcgcttcgccggccctaccggcccgctcgccacccagctcgtggcgggcgcctcctcccgcgtgctctccctcaccgcgggattccgcggcgaccgcacagacctcgaggtgctcaggctgtcctcgttgtaccaggaggccgagcacggcaagttgctcgactcccagcagtacttggttggggatgggggtgggtacccgctgctgccctggctcatggtgcctttcccagggccactggtgcctggctccccggaggcggagttcaatgctgcgcacagggcaatgtgccgccccgtgcggcgtgttatccggagcttgatggggtggggagccatcgctaggctccacgaggaggaaagctctcgagcagctgtggcgtgcattgggacatgtgcgatgcttcacaatgtgctgttgtccagggaggattactctgcattggcgccggatgttgaggaggcagacagtgatttggggggactgcacagccaaagagatgacgctggtgccggagcaggactcgagatcgatggccgtgcattggcgttgcggagcgcattggcagcaacaacgagggacctgcgagcgcctgactagccatggtgattctttcacaatttctgtcattgtcgattctttttaatcatatgtagattgtatagtggtgaacattttgattcaattggattcatcacccttcagttagttgattgctcaatgaataaagtaagaaagaaattagactgtcacttgacacaaaaaaaaaaaaaaaa

SEQ ID NO: 10258 - protein, 382 aa, Zea mays
  misc_feature: Ceres CLONE 997605
MTTPLPLLLTAHSAAALLVLLGPTARSRKRLRRDEASSASDSEATDPDPDPDPDPDPAPEQEAPPPAPLPLPPTSLDDYPLAFRVSAPTFHFLSGLLEPLLSHPSSLPSPVLLALALARLASGLPYPALAELFGVPPSAPRAASRRLRRVLLANFRFWLAFPSDPTGAYSAPLPSCRGALCCARFAGPTGPLATQLVAGASSRVLSLTAGFRGDRTDLEVLRLSSLYQEAEHGKLLDSQQYLVGDGGGYPLLPWLMVPFPGPLVPGSPEAEFNAAHRAMCRPVRRVIRSLMGWGAIARLHEEESSRAAVACIGTCAMLHNVLLSREDYSALAPDVEEADSDLGGLHSQRDDAGAGAGLEIDGRALALRSALAATTRDLRAPD

SEQ ID NO: 10259 - DNA, 571 bp, Zea mays
  misc_feature: Ceres CLONE 997705-R2
agagaccttttttccttaaataacttagaataaagcctgacgggggtaacagcatccatcgatccgcagtccatgctgtttgatgcatgggtctgctgaaaccgaggatgaacaccagcacttgattaacatgggttacattcgaactggattaaagccaaagcctaccaccccctttagcatcgggattggaaaagtcccagtctgacgaaagcaccgcttacgtccctaccccccgaaacaaaaactagaaatccccggccaatgtggaaaagtgttaccacaaaatttagcgctaatttttgcccagggagccccccccccccccagggggggggggggggggggggcccgaaaaaaaaaaaagtgtggggtgggggggggccacccccccccccaaaaaaaagggggggccccttgtgaaaccccccccccggggggtttttttctcccccgggtttaataacacccttttccccccccggggggggaaaaaaatttttttttttttttttccccccccccccccccccccttgtgggggggaaaaaaaaaaaaacccccccccccc

SEQ ID NO: 10260 - DNA, 781 bp, Zea mays
  misc_feature: Ceres CLONE 997705-R3
  misc_feature (781)..(781): n is a, c, t, g, unknown, or other
ttttttccttaagattaacttagaataaagcctgacgggggtaacagcatccatcgatccgcagtccatgctgtttgatgcatgggtctgctgaaaccgaggatgaacacagcacttgattaacatggtacatcgactgattaagcaagctacacgcttagcatcggagttggaaaagttcccgagtcctgacgagaagcaacgcattacgtacgcatactcgcgagagcaagaactagagaaatcacggagcaaatggtagacatgctactactagctagcgctagcttgcacaggatgccatcacatcatgcatgcatggcggcgcgtatagaagtgttgcttggtggtgcagcatcaccccaaaagcggggggcactggaagcccgacggcgcgtgcttgccccaggtgatgacaaggttgagcgcgatggggaggtaaatgttgatgttaaccaggcccccccggatggtggtgcaaaggcaaaccgccgcgtcaaggtccgcccaccccttgcaccagtgggtcagaacttggaacctgccccccctgcccgattcccagggggaatcagccccgtcagacagtcccacgcacgcgttcagttttcagggggtacaatcggggcacccccgcccccgccggcgggggtcgggggaaacgtacggggggcaccctacgggggggaatggcccaaggtgttccggggaaaccaacggggggccactatcggcggggaattggcccgagggcgtccctgggacaccaaggggggccccn

SEQ ID NO: 10261 - DNA, 762 bp, Zea mays
  misc_feature: Ceres CLONE 997705-R
  misc_feature (720)..(720): n is a, c, t, g, unknown, or other
  misc_feature (723)..(723): n is a, c, t, g, unknown, or other
cgattgggtaccgggccccccctcgaggtcgacggtatcgataagcttttttttttttttttttgtagcaccaagaagcaccattttttccttaagattaacttaaaataaagcctgacgggggtaacagcatccatccatccgcagtccatgctgtttgatgcatgggtctgctgaaaccgaggatgaacacagcacttgattaacatggtacatcgactgattaagcaagctacacgcttagcatcggagttggaaaagttcccgagtcctgacgagaagcaacgcattacgtacgcatactcgcgagagcaagaactagagaaatcacggagcaaatggtagacatgctactactagctagcgctagcttgcacaggatgccatcacatcatgcatgcatggcggcgcgtatagaagtgttggctggtggtgcagcatcagtcgtagagcggcgggcactggaagcccgacggcgcgtgcttgccgcaggtgatgagcaggttgagcgcgatggggaggtagatgttgatgttgagcaggcgcgcgcggatggtggtgcaaaggcacagcgccgcgtccaggtcggccaccccctgcaccagcgggcagcacttggacctggcctcctgcccgatcaccaggtggatcagcccgctcagcacgtccacgcacgcgttcagcttcagcgtgtcgatcgggcacgtccgcaccgccggnggngtcggcggaacgtaacgtggcacgtatggtggtgatggc

SEQ ID NO: 10262 - DNA, 810 bp, Zea mays
  misc_feature: Ceres CLONE 997865
  misc_feature: Encodes the peptide sequence at SEQ ID NO. 10263
aaaaccaagcagcacatccaaccaagtcatccatcagctctgctcacgactcacaagcaagagctcagctcaattggagctcggtctctcgattcccaggaggaacggaaccaaattaagctccgttggttgcctgccagtagcgagtagtccggacacgggatgggcaacctcgtctcgcagtgcgtcgcgaacggtgccggcgcgcggcctctagtcgtcgagccggacggcagccggacgttggtggacaagaacaccggggtcgcagagctgatgatcgacgcgccggggcacgtggtggctcgcgccacggacgtggcgagagagcggcgggtgcgggcgatggcggccgacgagctcctgcgagctggcgtggtgtacctcctcgtgccggccggccgggccggtgcgcggctgggagaccgtgaagtcgaggccatcgcgcggttggtctgcgggaagaagaattcgaccaagagcagtcctggaggcggcaagagggtctttcccgacgtcaacggcgagggcaaccacgatcatggatttgggcccaggcaatggcaacccgccctacagactatctatgaggcctaggttttccttaagaagggaaatatagttttttttcttagagagagaataggaaccccattcattcattcatacatgcatattcttttttcttgttcttccttccggtgacgatggaagggcaagttgtgcatacaccctgtaaaggcataaccctctttggtgcagtcatttataagaaatcagaagagtaaaatgtaaaaaaaaaaaaaaaaa

SEQ ID NO: 10263 - protein, 144 aa, Zea mays
  misc_feature: Ceres CLONE 997865
MGNLVSQCVANGAGARPLVVEPDGSRTLVDKNTGVAELMIDAPGHVVARATDVARERRVRAMAADELLRAGVVYLLVPAGRAGARLGDREVEAIARLVCGKKNSTKSSPGGGKRVFPDVNGEGNHDHGFGPRQWQPALQTIYEA

SEQ ID NO: 10264 - DNA, 666 bp, Zea mays
  misc_feature: Ceres CLONE 998016-R
  misc_feature: Translation starting site: 331
  misc_feature: SWISSPROT Homolog: EC 2.4.1.207 Xyloglucan:xyloglucosyl transferase
caattgggtaccgggccccccctcgaggtcgacggtatcgataagcttttttttttttttttttgtaacgaatctcttgcaaccaaccaaatgaattaaattatactagagtatttctttcacaccagagaatcgatcgatcggtataaacaatgaattgacccgtgcgtcgtatatagtgtgcactagctgatcgacatcgcaatcgaagtgcaccgtggttcagcccagcacctctacgccatggagcactcaggcggcgcgccctgcgggaagcgcttggtgtcggcgcagtagtcgtagaccatgtagttgtcccgcgcccacttcatggcctgctgcgccgcggcgtccatctgttgcccgtaccggccgtccgccgccgtggccggcggcgcggccgtgaagttgcggtactgcgccacgaagggggcccgcgaccagtccgtcttcacgcggccgccctgcgtggcccagtcctcggcgtcccacagcgagccgtagaggcgcatccgctgcgacgacgggtacggcacgccccggtccgcgtggttcttgaactcccggatcggcgtcccgtccacagcacgaggatgtgctgctgcgtcactggatgagaaagggtgtgaagtcggcggtggggtcgaaccagagtggaactgctgc

SEQ ID NO: 10265 - DNA, 839 bp, Zea mays
  misc_feature: Ceres CLONE 998572
  misc_feature: Encodes the peptide sequence at SEQ ID NO. 10266
ttttttctgtccgcgccaccactcctcgacccccgcccaacactcccagccgtcacgccgtcgccgccgcgagtccttcattcaccatgatcatctccaagaagaaccgccgcgagatctgcaagtacatcttccatgagggggttctatatgccaagaaggactacaacctggccaagcaccccaagcttgacgtgcccaacctggaggtgattaagctcatgcagagcttcaagtccaaggagtatgtcagggagaccttctcctggcagtactactactggtacctcaccaacgatggcattgagcacctccgcagcttcctcaacctgccgtcagaggttgtgcccaacaccctcaagaagtcctccaagcccccgtcccgtccctttggctctggcccaccgggtgaccgccccaggggtccccctcgctttggggaagacagacctaggtttgtggatagggatggttacagaggaggtccacgaggtgcaatgggtgattttggtggtgagaagggtagtgctcctgcggatttccagccatcttttaggggtagcagacctggctttggccgtggtggcggcagcgcttttggtgccagtggatcttccatggagtgatctatcaacttaagcgggaaaattcaaaggataggcacatgtttgttgatctttgaacttttgaggacaatgagattttggtttaccgagctgttgccgtggcttgacatggttttgtgatcctcctttttttgttacattaaattattaaagcagcaagtcatcattcgcatcgatggtgctattgccccctgttttaaaaaaaaaaaaaaa

SEQ ID NO: 10266 - protein, 179 aa, Zea mays
  misc_feature: Ceres CLONE 998572
  misc_feature (3)..(98): Pfam Name: S10_plectin Pfam Description: Plectin/S10 domain
MIISKKNRREICKYIFHEGVLYAKKDYNLAKHPKLDVPNLEVIKLMQSFKSKEYVRETFSWQYYYWYLTNDGIEHLRSFLNLPSEVVPNTLKKSSKPPSRPFGSGPPGDRPRGPPRFGEDRPRFVDRDGYRGGPRGAMGDFGGEKGSAPADFQPSFRGSRPGFGRGGGSAFGASGSSME

SEQ ID NO: 10267 - DNA, 619 bp, Zea mays
  misc_feature: Ceres CLONE 998917-R
  misc_feature: Pfam Name: Transthyretin Pfam Description: Transthyretin precursor (formerly prealbumin)
  misc_feature (353)..(353): n is a, c, t, g, unknown, or other
cattgggacgggccccccctcgaggtcgacggtatcgataagcttttttttttttttttttatcacaagatttgacttccataatactacttgttattaaagtataaagcctgcttacatggaaccagattattatcacaacggaagtgtcaagtttacaagttgcttcgaacatcccaacagaggtaatggcacgtaagttgaaaacttagcttcccggtaagtggtgaacgagaaagggaatgcaagagaggaacatgaaatgctctgccgctgttctcctgatctcgatatgatgctgacataagggaagaccctgcaggggcatactttgcagtgttgaagcttatgcngtagaaaaccggagcaatattatcgacaatgtccatcagctgggccactggcgtccatcattgtttgtaacggataaccctaaagtttcccatccgccgaaaaacttttgtttgttaaaggatggagggaatttaaaaaatctttccaaattccccgggggaaacttcatattcccaaaggggggggatttttctggggaaatttcccaacaaaattggcttttttaaaggggggggaaaaattttggggtttgaaaacaacccct

SEQ ID NO: 10268 - DNA, 644 bp, Zea mays
  misc_feature: Ceres CLONE 998931-R
cgattgggtaccgggccccccctcgaggtcgacggtatcgataagcttttttttttttttttttgatgaaaactcaatactgactgatttccttatagacgacctcttgcacgatggtgttctaaatggcactaccaccgattacaaaaggaaggattatgccttgactacaagtaatccctagagatccatgaaagatacaaccttcaaaattgaaccataacggcttcatcttctttgtccataactattttccagcactggaacagcagggccatatattctaaaacaacggtcactaaatgagctcactagtcgagaaacaacttccttgaagaacattgatgcaacctgacgatacagtggtgattgaaacttaaaattgactaagaaatagatgtcacatgtccctggaacaggaccaggcttaaactcccaaacgtttaccaaatgatcaaaaagtccactttcagatgctgtagtctgggcttctccatctccacacgggagacataactttcaacaaggaacttgaatccaatctcgagctctgcatcaaatgagccatcttcatggcacctaataatcctggaccgctggcaccatggcacaaagtcctcgtagaggtccactgacgcgacaac

SEQ ID NO: 10269 - DNA, 962 bp, Zea mays
  misc_feature: Ceres CLONE 998931-R2
  misc_feature: Pfam Name: Polyketide_cyc Pfam Description: Polyketide cyclase / dehydrase and lipid transport
accccccccctttctacccccgtcccctgcacccactccaaccaccccccccccccccggggcctaatactggatgatttccttgtagacgacgtcttgcacgatggtgctctaaatggctctaccgccgattacgaaaggaaggattatgccttgactacaagtaatccctatatatccatgaaagatacaaccttcaaaattgaaccataacggcttcatcttctttgcccataactattttccagcactggaacagcagggccatatattctaaaacaacggtcactaaatgagctcactagtcgagaaacaacttccttgaagaacattgatgcaacctgacgatacagtggtgattgaaacttaaaattgactaagaaatatatgtcacatgtccctggaacaggaccaggcttaaactcccaaacgttcaccaaatgatcaaccagtccactttcagatgctgtatcccgccgtttctccatccccactacggggacacataattttcaacaaggaactttgaatccaaatcctcgagcttccgcatccaaacgagccatctttctgggcaacctacaaactcctggtaccgctgctaaccatggcataaaaacccctccgacaaaggttccacttgacccccaacacaccaaaacactctgttccctggttgattaccccaactcccccccccctttccttcttaaaaccttggtaaagcaactctcccctcccttaatcagttccccccacccttaaaaaaacaaattctaactcgacgtgcaccgtcatcccacccctgctcccaaatcaccccccgcacatcgccaaactgccccccccccccttctaatgcctataaacatcccccccccctactccacaaactaaaccctagcctcgcccgaacaccaccagaatactgccccacccccatcccctggacgcagcgcaca

SEQ ID NO: 10270 - DNA, 859 bp, Zea mays
  misc_feature: Ceres CLONE 999195
  misc_feature: Encodes the peptide sequence at SEQ ID NO. 10271
atccaaacgccactatccctctgccacaacgagggccgcctcgagagtcgctgaagccatggcgaccacggcgaccactgcaatcctccgcctcactccagccccttctccccgcaccgcgcgccctcctctctctgctaccttcctccagcccgcgctctccgtttccctctcccactccctccccgactgccgcaaccaccgccttgccgccgcttccaaggacactgctagcagcaaggggcaggaacaagaccaagagcccgcaccgtcggcgccacaggaaggaggaccggagaaggtaacggaggtgggggcagcatcgcccggggagaagagcccggaggcggtggcggcggagctgaaggaggtgctgagggcgcggaaggaggcggaggccgccgagggccgcggcgggtggtgggcaggcgtggcgcaggagatgaccgagatcgagtggccggcgcctgggaaggtgttgggcaccaccggcgtggtgcttggggtcatcgcgggctccactgtcgcgctgctgtccgtcaacgccctcctcgccgagctctccgacaccgtctttcgccggacgcggacttcaggacttcttctccggctgatgaagcggcgtgcttcgtgtactctgtaactattgtttttttttcttgcacttggggctagggtcatagatcaaatgttcgaggttggaattatgtccaattttcagttgccaagaaaaagatgatgagtcacttgcgaatttggtaatgttactaatatgtgagtgacattttgttggtaaatggtcactcgggaacctaacttgagttccttctgtttagtggtgaaaaaaaaaaaaaaaaaa

SEQ ID NO: 10271 - protein, 194 aa, Zea mays
  misc_feature: Ceres CLONE 999195
MATTATTAILRLTPAPSPRTARPPLSATFLQPALSVSLSHSLPDCRNHRLAAASKDTASSKGQEQDQEPAPSAPQEGGPEKVTEVGAASPGEKSPEAVAAELKEVLRARKEAEAAEGRGGWWAGVAQEMTEIEWPAPGKVLGTTGVVLGVIAGSTVALLSVNALLAELSDTVFRRTRTSGLLLRLMKRRASCTL

SEQ ID NO: 10272 - DNA, 1505 bp, Zea mays
  misc_feature: Ceres CLONE 999256
  misc_feature: Encodes the peptide sequence at SEQ ID NO. 10273
ctctttccattagccatcctagccttcgccccctcgacgagaagaaccacctcaaaaccgaacagccgcaaaagaaagctgctagctactctatacatgataactagaacaggaccgtgaagtaatatatatataatgacgaagtcaggggcgctacaacttgctcggagcaccggagggtcgcttagcaaggaccaagtcaaatccgccgttgatcagtatgtgaagtaccacgacctccacggaggcgaacaagaatcaagaaagtcaaattacgctgatttggcaaacaagtactatgatcttgtcactggcttctacgaatatggatggggcgactcattccattttgctggcggtcccatactcccatgcttgtatttcagatatccgggtgaaacttcccgtgaagccattaagcggcaccagcattttatggcactacaattggggctcaagaagggtatgaaggttctggacgtgggatgtggaattgggggacctttaatagaaattgccagattcagctcaacttcaataactggattgaccaacaatgactaccatgtctcaaggggcaaggagcacatcttttcagcaggtttgagtgagcaatgctgctccttgaagggggacttcatgaatatgccaatagctgataacacctttgatgcggcctatgcaatacaggctacatgttacgcaccagaggcacaaggtgtctatagtgaggtctaccgtgtgctgaaacctgggcagtattttgcactggatgaatggtgcctgactgaccgatttgatcccaacaacgctaagcatttgaccgccaaggctgagattgagcttggcgatggcctgcctgacatccgtaccactcgccagtgtgtccaagctatgaaagatgcaggattcgaggtcatttttgcaaaggatcttgctcaagattttccttgcccatggtaccagacgatggatcctaactacttttcatgggctaacttccaatgcacacgcccaggacggataatcacccgtgcaattgtcaatacactagagttcctccgtattgccccagcaggcagcgtgggagcctacaacgtcctaacgagtgcctctgatggccttctaaaaggtggtcgggaaggtatcttcacagcgtccttcttcgtcctgggccgcaagcctctcaaggaaagtgaaatagtgaacggcggcaacctttgagctgcaacatgagtatggggtcgtacttataagagctatgaatcatggccaacgtgttacgtgctgaagtgtgtttaccggtttgtcttatggctcttgcgcgtgtggtgggtcatgttcacgcagtagcatactagcatgtatctgcttgttgtgtgttgtactatgaactatctgaataaaaatgctgtttacgcgttgtattaatcgcaccatttcttggcaacacggctttgatcggaccaatgtattgtctggatctatcaaaaaaaaaaaaaaaa

SEQ ID NO: 10273 - protein, 362 aa, Zea mays
  misc_feature: Ceres CLONE 999256
  misc_feature (221)..(350): Pfam Name: Sterol_MT_C Pfam Description: Sterol methyltransferase C-terminal
  misc_feature (114)..(212): Pfam Name: Methyltransf_11 Pfam Description: Methyltransferase domain
  misc_feature: SWISSPROT Homolog: EC 2.1.1.41 Sterol 24-C-methyltransferase
MTKSGALQLARSTGGSLSKDQVKSAVDQYVKYHDLHGGEQESRKSNYADLANKYYDLVTGFYEYGWGDSFHFAGGPILPCLYFRYPGETSREAIKRHQHFMALQLGLKKGMKVLDVGCGIGGPLIEIARFSSTSITGLTNNDYHVSRGKEHIFSAGLSEQCCSLKGDFMNMPIADNTFDAAYAIQATCYAPEAQGVYSEVYRVLKPGQYFALDEWCLTDRFDPNNAKHLTAKAEIELGDGLPDIRTTRQCVQAMKDAGFEVIFAKDLAQDFPCPWYQTMDPNYFSWANFQCTRPGRIITRAIVNTLEFLRIAPAGSVGAYNVLTSASDGLLKGGREGIFTASFFVLGRKPLKESEIVNGGNL

SEQ ID NO: 10274 - DNA, 908 bp, Zea mays
  misc_feature: Ceres CLONE 999273
  misc_feature: Encodes the peptide sequence at SEQ ID NO. 10275
aaaacgcgagatcccgcgcttgcacgcgggcgcgcccgctctccgatccgacggccctcgcctcttccacgtcagcgatccgcgccccgcccgctccgccagtcttccccgcggcctctacatataaccccgcctcgccgcctctcctcatcccacttccgcccaaatccaccaccgccataccagcgtgtccgcgattccgtcgagtagactgggcgagagagtagtctcggacgagaagaggcgaatatgagttccggcggcggcaggggcaagcccaaggggtccaaggctgtgtcgcggtcgaccaaggccgggctgcagttccccgtcggccgcatcgcgcgctacctcaaggccggcaagtacgccgagcgcgtcggcggtggtgcgcccgtctacctctccgccgtcctcgagtatctcgcggcagaggtgttggaactggcgggcaacgcggcgcgcgacaacaagaagaaccgcatcgtgccgcgtcacatccagctcgccgtgcgcaacgacgaggaactcagcaagctgctcggagctgtcaccatcgccgccggaggtgtgttgcccaacattcatcagacgctgctgcccaagaaggccggtgggaagggcaaggccgacatcggttccgcatcccaggagttctaagcggccgcggcggcggttgcaggtttctctgacttgttcgaactggagctccaacatgcatgaagtccccccgtcgctcaagtttcgtcgattagtagtgttagggtgttttctatctttggttaggtttaggttgtctgatggatggtttatcagacgaaagtttggtgatcgagggcttcctgtatgtatcaatcaatcttgctggaatggaacaaatcgttggttgcaaaaaaaaaaaaaaaaaa

SEQ ID NO: 10275 - protein, 136 aa, Zea mays
  misc_feature: Ceres CLONE 999273
  misc_feature (18)..(91): Pfam Name: Histone Pfam Description: Core histone H2A/H2B/H3/H4
MSSGGGRGKPKGSKAVSRSTKAGLQFPVGRIARYLKAGKYAERVGGGAPVYLSAVLEYLAAEVLELAGNAARDNKKNRIVPRHIQLAVRNDEELSKLLGAVTIAAGGVLPNIHQTLLPKKAGGKGKADIGSASQEF

SEQ ID NO: 10276 - DNA, 958 bp, Zea mays
  misc_feature: Ceres CLONE 999512-R
  misc_feature: Translation starting site: 183
  misc_feature (958)..(958): n is a, c, t, g, unknown, or other
tggtgacgggggaggagcggagagaaaccgggataatggaaaaaaccccaccccacacacacccacggcggggagacggagggggggggccaattgggtacggggccccccctcgaggtcgaccgtatcgataagcttttttttttttttttttaaggaatgacacacagcagcatcttaacatggtttgctcagttctaacaagtctcaactgttggaacatagataaatataagctgggactacgagcaccaacatgccccctgacagaacacaaacttagcgcttaggactgcctgttcttcttcttgacaccggacttggcaacctggaggctgcggtacaccgagcttagcctagcaagagctggcttggtcagatcaggcctgtagtagttgtcactaacctggtttttcacagccttggccatcttggcggaactccttgcgcatcacagactttgtggctgaacttcccaggtgcctttctgcttccttggcccccgcgtagtagaagaaggaccacaaacccgagtccgttttgcagcctggccggggattcccccaaaagtcgttcttggaattccccaaaaaccccgagttgtttctgaaaaggagatgagaataggttggtaacacaggatccgctttcagagaggacggggatcgggataaaaaatagccaaactaggcaagaaaggggaatcatgggaggctcgaaaaggtgatcactacgcaccaggggagtaaacgtaaggggaagtttattgctagcctaacacctatggcgtggtaggccattcagctcatataatgcgccttccacgccggagatgagaaaaccgtaggaaacggagacaaaggatgatgtacttggcgatcgcggggtcaagctacttacggggccgcacaaggaagcaggaagtgaaatggatgcgcttccgcgcttgagctagaan

SEQ ID NO: 10277 - DNA, 857 bp, Zea mays
  misc_feature: Ceres CLONE 999517-R
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaattgggtacgggccccccctcaaggtcgacggtatcgataagcttttttttttttttttttacaatatttaaatccatagtctcatcaattacatcacaaaagtctcatcaattacatcacaaaagtctcatccatagtcataataagacacatctcatcatccagtactaataagagacaatatctcatacatagtcataataaaagtctcaagtatcagaaaacgcatacatggaagctcacggtcgccgatcaccatcggggtacagtggtgagtgatgggcgataccttcaggccgggcgaaaacagctcggaaataggctgctgcccccattcttagaatcgaaaacacatgggggaacaaaccccaaatatgggggttttctgggcccggggggttttattttttttttttgaaaaaagtaagccccccccggccccgggggcccccttaaaaaaaccccccaaattggggggggggcccccttttttttcttaaaaaaacccccaaaaattttttttccttgagaggaaaaaaaaaaaaatttcctgcgaaaccaattaaatttcaaattttgaattggggaaaatgaacccctttttttttgggccccccgggggaaaaaaaaaccccaccccccctggaaaaatttttccccgaaaaaaaaaagggggggggtggcaaaaaaaaaattccctcccctcttttataaaacccccccccagggggggggggttgggtgtctttttttc

SEQ ID NO: 10278 - DNA, 981 bp, Zea mays
  misc_feature: Ceres CLONE 999778-R
  misc_feature (13)..(13): n is a, c, t, g, unknown, or other
  misc_feature (19)..(19): n is a, c, t, g, unknown, or other
  misc_feature (47)..(47): n is a, c, t, g, unknown, or other
  misc_feature (48)..(48): n is a, c, t, g, unknown, or other
  misc_feature (52)..(52): n is a, c, t, g, unknown, or other
  misc_feature (53)..(53): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (981)..(981): n is a, c, t, g, unknown, or other
tctcttactcccnccgccnccggctcatgtagtgattataaattacnncttnnaataatttnnnnnnnnnccgttnnnnnnaacaaatgagtacgggccccccctcgaggtcgacggtatcgataagcttttttttttttttttttggtccaacccagatgcatggattttactgctacgcgaaacgcatcgcacacttcttcttttttttttttacacaggaacacagacccatcaacgtcaacacaaagatacacactagaagtactagcaaaaaacaaacagcagagcacatcaacctcgtacatctaagctagatagctacaggctcggacatctacgccgacggggtcggatcatacaaaacgtggcgccagtgggcccatggactcatgctgctctcgtcaaggacaaggagtcacgggcactttggtcttttcccccccccaaggggggggggggggggggggcttttccccaatttttttcttcctccccgggcaggtagcccgcgcgggcacacccagcggggcagaacggcccgcagacccttttaaagggcaaacccccgggggggccaaatatatttcttgggcccacgaaatggggccgccccctcaaccgctaccctactgtactacggtcatcttaccccgcccaataactccttggtcggcggaaaaggagttcaaaccatactgtcggggggagcagctcgcggaaagaaaatcgcgacgtgtcgaaggggatgttaatcccaccccccgtgagagacgtggtcgggccgccccggaatagcacctacatcatgctgcctaccaatgttggctgtatccctctaacactctcgtgcatgagcgaccagagatgtgaccccccatccactttcctgcgatagatgagggacccaaaatatacgcccgcccgtcccggccgccggttgggtgcggcaccccccacgcccgactcgcacccccgtcn

SEQ ID NO: 10279 - DNA, 1853 bp, Zea mays
  misc_feature: Ceres CLONE 1000070
  misc_feature: Encodes the peptide sequence at SEQ ID NO. 10280
gagcggtggccggcagccggcacgcatggcggcagaggaagcaggcggcgatggacgggcggaaggacggggtggcgcgggaggtcatccggatggaacgggaggccgtcatccccatcctcaagcccaagctcgtcatgcgcctcgcgtatctcatagagcatgaagctgatcggaacgagttcctgaagctgtgcaagaaggtggagtacaccatccgggcctggtacctcctccagttcgaagacctcatgcaactgtactcactgtttgatcctgtttctggtaaggagaggttacagcaacagaacctgacgccggaggaaatcgagaccctcgagttcaatttcatgacatatcttttccaggtgatggaaaagagcaacttcaagttgctatcagatgaagagtttgatattgcgcaatctggaaaatatttgttgaatcttccgatcaaagttgatgaatctaagctagacaagaagttgttgacaaaatattttaaagagcacccacatgacaatctaccagagttttcaaacaagtatatcatctttcgtcggggcattggaattgatcgaacaactgactactttttcattgagaaagtagatgtaatgatatcccgagcttggaggtcattgctcagggttaccaggattgaccggttattttctaagaaacaacatttgaagccaaagaatggtacgaagaagactgatgaaattaatgaagatgaagaagatccagaattgtttgttgagagaattcgattagaaaaaattgaactaagtttgaaaaatctcatgagtaagatgacaattcaagaacctacattcgataggatgattgtggtgtacaggagggctggtacaaagactgagcctgatcggggaatatttgtaaagcacttcaagaatatcccaatggctgacatggaaattgttcttccagagaagaaaaatccatcactaacaccaatggattgggtcaagtttctcatttctgctgttatcggtttggtcactctagttggctctcttgaaatgccaaaggctgatgtatgggttgtaatagcaatcttgtctggtgtgattggatactgtgctaagatatacttcacatttcaacaaaatatgacaatgtatcagaatttgattacaaaatcaatgtatgacaaacagcttgatagtgggaaaggaactcttcttcacttatgtgatgacgtgatacagcaagaagttaaagaggtcataatttgttactacattttaatggagcagggaaaagccactatacaagatcttgatttacggtgtgaagagctaatcaaagaagagtttggcgcagagtgcaattttgatgttcatgatgctataaagaagttagagaagcttagcattgttcatcgggactcgattggaaggatcttgtgcgttccgttgaagcgtgcgaatgagatcattggtacgacgaccgaagaactggtgatgcgagcacaacagaaccttgcttcctgattccatttccagtcacgatggattgctgtaccttccctctcatctccctgcaaagcgcgcaccagaggggaagcttctgatcatcccggaagtctattcctagtctcatctccctgcaaagcgcgcaccagtaataaggaggaagctcctggtcatcctggaagtctattcacctgtacatgtgtgtatctttgcattgcagtgccttccctctcgtttggtttagcacggagtgtatatgtcaaacctggctgttacacagttgtacataacaattatatgtatttttttaatatataacagtacaaattcgttaaaaaaaaaaaaaaaaaa

SEQ ID NO: 10280 - protein, 489 aa, Zea mays
  misc_feature: Ceres CLONE 1000070
MDGRKDGVAREVIRMEREAVIPILKPKLVMRLAYLIEHEADRNEFLKLCKKVEYTIRAWYLLQFEDLMQLYSLFDPVSGKERLQQQNLTPEEIETLEFNFMTYLFQVMEKSNFKLLSDEEFDIAQSGKYLLNLPIKVDESKLDKKLLTKYFKEHPHDNLPEFSNKYIIFRRGIGIDRTTDYFFIEKVDVMISRAWRSLLRVTRIDRLFSKKQHLKPKNGTKKTDEINEDEEDPELFVERIRLEKIELSLKNLMSKMTIQEPTFDRMIVVYRRAGTKTEPDRGIFVKHFKNIPMADMEIVLPEKKNPSLTPMDWVKFLISAVIGLVTLVGSLEMPKADVWVVIAILSGVIGYCAKIYFTFQQNMTMYQNLITKSMYDKQLDSGKGTLLHLCDDVIQQEVKEVIICYYILMEQGKATIQDLDLRCEELIKEEFGAECNFDVHDAIKKLEKLSIVHRDSIGRILCVPLKRANEIIGTTTEELVMRAQQNLAS

SEQ ID NO: 10281 - DNA, 940 bp, Zea mays
  misc_feature: Ceres CLONE 1000091-R
  misc_feature (364)..(364): n is a, c, t, g, unknown, or other
  misc_feature (366)..(366): n is a, c, t, g, unknown, or other
tgtccgggccccccctcgaggtcgacggtatcgataagcttttttttttttttttttggagaacgagcattatccaagagttgccagcaagctggggagcaaacgtagtagtacgtaacatctactggcatcggagtaacaaacagcatggaacagggtagcagacaagctatacatgcacaacagtagcatccaaaattacacgacacaaccccctccccccttcccccggttcaccgtcacttcccaaccaacagcaatcaacaccgacatcagggataactccctctgacgatcaccaagaataatcagcgcaggactcaacaacaagacgaccaaaagagcaagaaaggtcaccgtttcncngacttggggtttttgtgaaaacaatacatttcccccaaccccccggggtgggcggcttcccgggggtatgaaaaatcaggccttaaaccgcagtggggcctgattactccccaccacagataaaaagaacccttggggggtggggcgaaggggaattgttgaaggggaatgcctttttcatttataaaaaacaccttgcggttgttttcaaaaccaaacgatgattatacctgaggaaaaaaaagaattcgttgttgggggcagggaggtagagagaaccccccggagagggacccccctcagggttgtgtgtgaatttgagacgagtgattctcacatggctgacacgagaaattttttgtgtggtaaaggggtggagaacctcaagatagaggatgtgtgaatcacccccacctctaaaaaaataatatttaggtctgcgaaaggggagagagagcgagaagagaattaaataagtgagtgtgtcaatccattaaaaagtgtggcttttgttaaaatagcacagcgggggtggagagcgtgtgtaatataagaacagcgactggtggtgtaa

SEQ ID NO: 10282 - DNA, 2301 bp, Zea mays
  misc_feature: Ceres CLONE 1000504
  misc_feature: Encodes the peptide sequence at SEQ ID NO. 10283
actcgaggtgtactccagtcctacatcgaaatggtgtgctggttgctgaatgcaggcaggcaggcacggcatcggcatcactggaaattgaagcccaagaggggggaggtaggtggccattcaactccaaccctctaccggccgggctggcctccgatttgtttttcccagcctctgatgcgaattaggagcgcagcactggtctcattactcgccacaatgaccttcctttaagcatagattatatccgaacagttgttgctgccaagcctttactttaaccatcggcaagagtaagatccctgtgcgcacgcatacgcatgtccaggcccagcggcgcctgctataaaaatctccacgtccaccgcccggctccgtgtccctccctcgtcacatctgccgtccgtcaccatggggtgttcgtgtcctccgctcgccgacgccgcgtgcctggccctgcttcttctggccttgtcgttggcgtgtcgccaccaccacgggtgcgcggcggccacgctgtcgacggcgtcgcggtgggtgctggacgagagcgggagccgggtgaagctggcgtgcgtgaactggccgtcgcacctggagccggtgctggcggaggggctgggcaagcggcccgtcggcgccatcgccgcggacgtggccgccatggggttcaactgcgtcaggttcacgtggcccacgttcctggtcaccgacgcctcctactccgacctcaccgtcgcgcagtccttccagcggctcaacctcaccgagtcgctcgccggcatcagggtcaacaaccccggggtcgtcgacctcaagctcatcgacgccttcaaggccgtggtgagcagcctgggcgagcacaacctgatggtcatcctggacaaccacctgagcaagcccgggtggtgctgcagcaacaccgacggcagcggcttcttcggcgacacctacttcgacccggacgtctgggtcgacggcctcaccaagatggccaccatgttcgccggcgtccccaatgtcgtcggcatgagccttcggaacgagctcaggggccccaggcagaacgtgaacgactggtacaagtacatgcagcgcggcgcggaggcggtgcacgcggcgaacccgcgcgtgctggtcatcctctcgggcctcagcttcgacaacgacctggccttcctcaactcgcggccggtgaacctcagcttcaccgggaaggtggcgttcgaggtgcactggtacagcttctccaacggtcccgagtggagctcgggcaacgccaaccaggcgtgcgcgcgcatcacggccggcatcacccgccgcgcgttctacctgctcgacaggggctggcccgtcatcctcagcgagttcggggtcgacaaccgcggcgtcaacaccaacgacaaccgctactacggctgcgccgccgccgccgcggccgacctggacctggactgggcgctctgggcgctgcaggggagctactacctccgcgagggcgtcctggggctcgacgaagtctacggcgtcctcgactgggcctggtgcaggccgcgcaacgacaccgcgctgcgcagggtccaggccctccagcgcccgctcagggggcccggcctcgcggaggcggcgccgtacaccgtgctgttccacccggtgtccgggatgtgcgtggtgcgccggtcgccgacgccgtcgctgacgcagccctttcagctgagcctgggcccctgcaacgagacggaggcgtgggagtacagcgcgcagcagcagcgactggcgctgcgggacgctgcgctgctgtgcctccgcgccgagggcgccggcaggcccgcgagcctcgccgtgagctgcggcgacgccatggcaaggtggggcttcgtgtctgactccaagctgcacgtcgccgtcaacgccacgtcgtcggccgggagcgtcggcgacggcttgctctgcctggacgtgggcgcggacggccggagcgtcgtgaccaacccgtgccgctgcctgagcgcggacaacagctgcgacccgcagggacagtggttcaagctcgtgagcagcacgaggagcgtggtcaccaagcagaccatgctcgcgcagctgccgctcaagctcaaagactggaagatcaggtcgttttgagcgtttccccggtagaatatagtgcgtcagctaggctcaacacgtacgtaagctgtagcacgtgacgtcgtgtggaacggcgggaatagaggagcactgacctagaacttgaacaatgttctcgaggagactgatcagcattcaaaaaaaaaaaaaaaa

SEQ ID NO: 10283 - protein, 576 aa, Zea mays
  misc_feature: Ceres CLONE 1000504
  misc_feature (56)..(359): Pfam Name: Cellulase Pfam Description: Cellulase (glycosyl hydrolase family 5)
  misc_feature: SWISSPROT Homolog: EC 3.2.1.4 Cellulase
MGCSCPPLADAACLALLLLALSLACRHHHGCAAATLSTASRWVLDESGSRVKLACVNWPSHLEPVLAEGLGKRPVGAIAADVAAMGFNCVRFTWPTFLVTDASYSDLTVAQSFQRLNLTESLAGIRVNNPGVVDLKLIDAFKAVVSSLGEHNLMVILDNHLSKPGWCCSNTDGSGFFGDTYFDPDVWVDGLTKMATMFAGVPNVVGMSLRNELRGPRQNVNDWYKYMQRGAEAVHAANPRVLVILSGLSFDNDLAFLNSRPVNLSFTGKVAFEVHWYSFSNGPEWSSGNANQACARITAGITRRAFYLLDRGWPVILSEFGVDNRGVNTNDNRYYGCAAAAAADLDLDWALWALQGSYYLREGVLGLDEVYGVLDWAWCRPRNDTALRRVQALQRPLRGPGLAEAAPYTVLFHPVSGMCVVRRSPTPSLTQPFQLSLGPCNETEAWEYSAQQQRLALRDAALLCLRAEGAGRPASLAVSCGDAMARWGFVSDSKLHVAVNATSSAGSVGDGLLCLDVGADGRSVVTNPCRCLSADNSCDPQGQWFKLVSSTRSVVTKQTMLAQLPLKLKDWKIRSF

SEQ ID NO: 10284 - DNA, 643 bp, Zea mays
  misc_feature: Ceres CLONE 1000621-R
  misc_feature (633)..(633): n is a, c, t, g, unknown, or other
cgattgggaccgggccccccctcgaggtcgacggtatcgataagcttttttttttttttttttgtaatacctacagttccgtaatactgagacctattgaaacctcttttatcctacggcatcgaccaatttaccaaagcgactcagacaatctaataaatattttacctagtcaaaccatccatcaatccgctaatacgaataacaaatttgcttaccctgactaattcatcgcgatagttgcaagcacggctacggttccagttgacgtcatccagggctcttctttcttcggtaatcaattgctgaagatcttttccttaattgaataattttgacgaattgaacttgagtcgcgcaggatgtccgagctttttgtcgcgcacttggtgaacaccacgcttgctagcttccgtcttcacctgattcttgggatttgttgctgacgcgcgaaacgacgacgactttcagctgaagtcgagaacgagctggtgaggtggggtttgagcagaggatgacgtatttgatgactcgacagcaaaggacacgacgacgagctgatcaaactaaaactccacgacgtcgaccggcacacgggttaaagaacggtggccggcaaaatccaagctggcnaacgcacggc

SEQ ID NO: 10285 - DNA, 668 bp, Zea mays
  misc_feature: Ceres CLONE 1004062-R
accgggccccccctcgaagtcgacggtatcgataagcttttttttttttttttttaaaacttgaaggacagggagacactatttattctgtgcccaattttgcttctgtacatgttcaggagttctttttttcttgccacaatctcaaccacaggccagctttacactcaagacgtgtggcagcatgaaagatttgcacggtcataagttcacaacttcggagacgagcgcatcggcagtcattaggctctgccttgcctgaatgtgcagtttcagtttcagcagctgagagaaagagaaggatatggtgagagggcatctcaaggaacatgcattaaactgcccccatttacttgctgacaggccacagactgctagttcacaagtcagtaaacacatagttacatagtactagtaccacatggagacgcagttcagggccgcttccatctgtgtggatcagctagcaagcagatcacacatatacggcgccgacaggtcactggtataatacaaggcggctgatacggacacgcttgcttaatgcttagcttcttgttaggagatcgaattgggtcaggcgcttggaaactgtactacacgcgcaccatgcagacacagcagtagtacttgcgcggtttcctccgggcagaccaccaccaggcaca

SEQ ID NO: 10286 - DNA, 716 bp, Zea mays
  misc_feature: Ceres CLONE 1004466-R
  misc_feature (165)..(165): n is a, c, t, g, unknown, or other
accgggccccccctcgaggtcgacggtatcgataagcttttttttttttttttttggctgcaacaaacaaatcataatctcttgcgcaggcggttacgcccggagaggaacaacagggctggagatctagcttgagagaagaggaggaagagggtaaaagggganggggggcgatgctacaacaggctacaaccagctcgaactaggaagcgcggcgtgcggcatcgtcgtcgcgccggccgaggaggagcgcggcgaagctggcggcagcgcagagcgcggcgacggcgttgccctcgcggaggaggacgcggagcgcgaggcccgcgatgtccctgtgttggcgcgtcggccctcggcgacgagcgacctgggccggcgccccgccaaggcgaggaccccaccgacggtggtccaggtgaccagcattgccggggggcggcaaccgccaacccggcggccattggagaataagcccaacacggcccccgttacctgacggaaggcgtataaacgccccggggcccggcggggccccttcccaaggccgcccccccaggccgaaagcccgaaagaaacccggcctaaatacccaggcccccgaaccgagggcccccccgggcgacctccccaggaaggaaaagcccgcccccggccgtaacaccgcgccaaggaaaaaaccccccccccccatgggcccccccaccccgggccct

SEQ ID NO: 10287 - DNA, 912 bp, Zea mays
  misc_feature: Ceres CLONE 1060797-R
  misc_feature (12)..(12): n is a, c, t, g, unknown, or other
  misc_feature (13)..(13): n is a, c, t, g, unknown, or other
  misc_feature (22)..(22): n is a, c, t, g, unknown, or other
  misc_feature (29)..(29): n is a, c, t, g, unknown, or other
  misc_feature (30)..(30): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (461)..(461): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
ggtggttggggnntctaccctncccccannaaaannnnnnnnnnnnggaaacnnnnggggcgaagtggggacggggccccccctcgaggtcgacggtatcgataagcttttttttttttttttttcaatacaaacttggaaataaattttattatttcggtccatgttcgtcgcattaaccgaaaggaaccattgagaaaaggaaaaacgtgaattaaaaagcgggggggggggagatcgggaacaaggactcccaaggatggttcaaatcttcaatcttctggatgtaggatttgaggccggaacatcacagggcccgggatggccaggaggtattctttttggcgccggggagggacacagtttgtgcgggtttctttttttaaagccgggaaaagagcggtcgggggcaaattttttttttccccccccccggggggggggagaagggggggggtatntttctttttctnnnntttctctcccccccccgggggataaaaaaaaaaaaaaagaattatcaacgtaggtgcgtgcggcggggcttggcgtggtagtggcgaggcgcgggcgcgccatgcggcacggtacatcgggcgaggcgacgggtagcagtgccgcgtatataagtaacgaggaggaggaaagctgaggccatgtcaatgttcgccggaggaggagtagagagagatggcgggcgaccagtgcggcggggtggtgcgatcgggatgggggttggcgggagcggtgctgggacggaggtgcgaaaggagagggtgcgaccggattagcgggagtgggcagggttagtcagtgagggacggtgaacgcgcaagtgattctcgagcgaggcatcggaatggtgtggatgctgtgtacctcatagtgtgttggagcgggccgttaaggttg

SEQ ID NO: 10288 - DNA, 640 bp, Zea mays
  misc_feature: Ceres CLONE 1060964-R
  misc_feature: Pfam Name: GCV_H Pfam Description: Glycine cleavage H-protein
  misc_feature (86)..(86): n is a, c, t, g, unknown, or other
  misc_feature (135)..(135): n is a, c, t, g, unknown, or other
  misc_feature (519)..(519): n is a, c, t, g, unknown, or other
  misc_feature (640)..(640): n is a, c, t, g, unknown, or other
ggttcctcaaaccgcgtgagattacatttttaagccgtgaagacgagacgtgacgaaccatgacagatacatcttcctgttgggancatcttccgctcgcagaattggtggtttccttttgaaccatcaaggttnccaattctgcagggttgcttgggttcacctttatcagccaaccatcttcattagggcttgagttgatcaaaccaggtgaatcggttagctttgtgtaacctcaatgacttcaccagagattggagatagaatctcacttgttgccttcacactctccacaggctcaaagttcttttctttgctcactgagcttttctcttctggcagctccaacaacacaacttctcctagatggtcctgggcatggtcagtgatgccaatggtagccaccgagccatcagggttcacccactcgtgtgaaagtgcatacttgagtccttcccacactgaggagaagcatctgaagatggacaacccaggaggaaatgagatttggaggtaaanaaaaaagctaagaagcggtgctgaaaaggagccaacatcccagggcattttgcctgttttcccaagaaaggggaaaaaatttccgataggtagttctaggaatggctcccgcaattccgan

SEQ ID NO: 10289 - DNA, 940 bp, Zea mays
  misc_feature: Ceres CLONE 1060979
  misc_feature: Encodes the peptide sequence at SEQ ID NO. 10290
aattcccttccttcgcctggccgcgaccagtaccacccaccgctcgctctcgctcccaggcctcctgccgcccggcccgcgccgcgccatggaagagccgccgccggggagcagcaaggccgccgcggcgcgcgcgccccgggtggtgggcgtgctggcggggctgctggagcgcgcggcggagcgcggcgacacggcgacgccgacgctggcggactcggcgttccggggccgcgcgctgccggggatccccgtgcggcggtacgcggagcggatataccggtacgccgggtgcagcccggcctgctacgtcgtcgcctacgtctacctcgaccgcctcgcgcggggccaatgcgactccggcgccggcgaggacgaggacgaggacgaggcggcggttgtcggcatcgactcgtacaccgtccaccgcctcctcatcacctccgtcttggtcgccgccaagttcatggacgacaggcaccacaacaacgcctacttcgcgcgggtgggcggcgtggaggtggcggagatgaacgcgctggagctgcgcctcctcttcgccctgcgcttccgcctcaacgtcgcccccgacaccttcgcgcggtactgcgccgcgctcgagtgccacgtcgacacgcccgacgccggcggccccgtgccgcagatgccgccctcctcccacgtcgacggcgaggaggcagtgaccagcagcaagggcaaggttgccgccgccggtcggttccgtcgtcgtccagcgtagtcaccgtcagcggacagccgtggtacagatcatgacgacggcccaatgacgacgacggacggcctaggtcgacgtacgggagattgtttcatttgttcttttttaatatacgctccataagcttttgtacgcacctgctttatacactccataagcttttgtacaaaaaaaaaaaaaaaa

SEQ ID NO: 10290 - protein, 223 aa, Zea mays
  misc_feature: Ceres CLONE 1060979
  misc_feature (17)..(163): Pfam Name: Cyclin Pfam Description: Cyclin
MEEPPPGSSKAAAARAPRVVGVLAGLLERAAERGDTATPTLADSAFRGRALPGIPVRRYAERIYRYAGCSPACYVVAYVYLDRLARGQCDSGAGEDEDEDEAAVVGIDSYTVHRLLITSVLVAAKFMDDRHHNNAYFARVGGVEVAEMNALELRLLFALRFRLNVAPDTFARYCAALECHVDTPDAGGPVPQMPPSSHVDGEEAVTSSKGKVAAAGRFRRRPA

SEQ ID NO: 10291 - DNA, 701 bp, Zea mays
  misc_feature: Ceres CLONE 1061232-R
  misc_feature: Pfam Name: eRF1_3 Pfam Description: eRF1 domain 3
caaattgggtaccgggccccccctcgaggtcgacggtatcgataagcttttttttttttttttttaaatttttattatttttttttttttttaaaaaaaatggagagggcccttattattaagtcaagaataaccaatagatgtgggatagctaaccatttacaacaaggatatattaaaatgtcatcaaaatttctttctgttgctacctaaatagaaccaactgttatattattattacacttgatcagctataggttaacaggttggtacaaaaatgttaggcaactccggaggtctggactaatcacatctcgatgtcctccaaatctggcagggggaaacaaaatattactgctattcctgacaactgagccaattggtcgccggagacatgcatcaaagaaaataagtgcactgtaccaccatatttcttgactgacccaaccaagttcacatactttctcctgctagcgatgtccgtgttccgaaacaaagcatctgtcatcagaagaatttgtattggaagacgttcatgtgcgacctcaacggtgcttaggtccataacacggctcgggctgagtcattagtaaacatagcgaagaattccttcaaagattgcacctcctagtgccgctttttgatcttttatcagtcacatcacacctgggggggcccaaaactttccttccaactatggt

SEQ ID NO: 10292 - DNA, 593 bp, Zea mays
  misc_feature: Ceres CLONE 1061355-R
  misc_feature (593)..(593): n is a, c, t, g, unknown, or other
cgattgggtaccgggccccccctcgaggtcgattcctaagccgcgctttttttttttttttttttaccagcattggtgattgctgcatcatttcttcacagcatgggcatgtgcttatacaaatggtggttgtcacttgtcagtaaattactacacgaacagagggcagaaactttcagacttaggaagtcactgattcaaaaatcgcttctataatcccgcaatgggccaaacagtcaaatcttcgctcccattattgcatctgtaagtttacagctgactatttctcaatcagactcggtacacttgctgcacaggaaaagtgaggtgccatgtacgctgaggatagaatcaactgccgggcatgccacatcacccggaaccattctcgcctttcttggtaagggtgtccacttcagctgttactgacgaactgacaccattctttccactgctctgtttcaatttctttgcaaaaagcctagcgatctgaaggtgcgttttcgccatgatctcagttctcttgagctccatctcccccttcttaatctcagcttcaaccctcatcctttctgtctccctgtacatctccn

SEQ ID NO: 10293 - DNA, 1722 bp, Zea mays
  misc_feature: Ceres CLONE 1061417
  misc_feature: Encodes the peptide sequence at SEQ ID NO. 10294
gtccccagcccgcgcactgcccccggtctctctctctcaacacaccgataagcccagtccaccggatctcccgtagtccagagactgagttgaaggaaggaagccatgatgatgatgggcgaaggcgtgagcatgccgccgtggtcccaccacgtccctgtgagcggcgtcgacgaaggcgacgagatgacgccgtacctgctcgcggcgctgcgccagtacctgccgtgcaacgacgccggcgccgaggccgaggaggatgaggcggcggcggcggccgccgccatggcggcgggcgtggacggctacggctgcgacgagttccgcatgtacgagttcaaggtccggcggtgcgcgcgcgcgcgcagccacgactggaccgagtgccccttcgcgcacccgggggagaaggcgcggcgccgcgacccgcgcaagtaccactactccggcgccgcctgcccggacttccgcaagggcgggtgcaagcgcggcgacggctgcgacatggcgcacggcgtcttcgagtgctggctccacccggcgcgctaccgcacccagccctgcaaggacggcacggcctgccgccgccgggtctgcttcttcgcgcacaccgcggaccagctgcgcgtgctcccgcccacgcctcagcagcagtccagccccaggggcgccgcctgctcttccccgctcgccgagtcctacgacggctccccgctccggcgccaggcgttcgagagctacctcaccaagagcatcatgtgctcgtcgccgaccagcaccctcctgtcgccgcccaagtcgcccccgtcggagtccccgccattgtcgcccgacttccgccgtgggtgctggccgggcgccgggtcccccgtcaacgacgtgctcgcctcgctccgccagctccgcctcagcagggccaactcgtccccgtcgggcggctggtgcggctaccctgcatccgcggtcgcgtacggatcgcctacggggggcgcgctctacggcctgtcctccaccccgagggccaccgccgcatcctgctacatggccaacctggaccctctcgacgtcagcttcggcggcgacgacgagcccgtggagagggtggagtccggccgcgccctccgcgcgaaggtgttcgagcggcttagcagggagggcgctgtttccggcgacgccggtggccccgacgtcggttgggtctccgacctcatcaactgagcgcggcggcggcagtggcaataacaatgggcacggagaaaggtgatggtgagccgtaacggagaaggatggtacggagtatccaaaaaaaaaatatttccctatatttaatttcgttcctcagttaattccgataatccccgtgtacatatctatcaccctgtgaatattctcagttggtaagagggaggatgctaggtggtggaagtggaaggaggggtggatttgttttggggttcttgagggtagtagaaaatatccaagaaaaatagaaaaaaaaagtgtacagcagatgcagtagcgcggtggcggtggttgtgtccctcttctgtgcatagggttagggtgttggtggcgaagcatggcgggggctgatgtgacgacgaaggcgggccggatttccaccacggcttggtatttctgtgattccggaacatggtagtttgatgttgttttttttaagttagtggactagttggcgattgcaaaaaaaaaaaaaaaaaa

SEQ ID NO: 10294 - protein, 370 aa, Zea mays
  misc_feature: Ceres CLONE 1061417
MMMMGEGVSMPPWSHHVPVSGVDEGDEMTPYLLAALRQYLPCNDAGAEAEEDEAAAAAAAMAAGVDGYGCDEFRMYEFKVRRCARARSHDWTECPFAHPGEKARRRDPRKYHYSGAACPDFRKGGCKRGDGCDMAHGVFECWLHPARYRTQPCKDGTACRRRVCFFAHTADQLRVLPPTPQQQSSPRGAACSSPLAESYDGSPLRRQAFESYLTKSIMCSSPTSTLLSPPKSPPSESPPLSPDFRRGCWPGAGSPVNDVLASLRQLRLSRANSSPSGGWCGYPASAVAYGSPTGGALYGLSSTPRATAASCYMANLDPLDVSFGGDDEPVERVESGRALRAKVFERLSREGAVSGDAGGPDVGWVSDLIN

SEQ ID NO: 10295 - DNA, 576 bp, Zea mays
  misc_feature: Ceres CLONE 1061492-R
tcgaggtcgacggtatcgataagcttttttttttttttttttgctggtaataacatggaaagttctgtatgcatcaaacaagataagctactggcatacataatgcaggcacagaggcactagtacagcttgttccacgtctattttaccctgatctacgaatccttcttcgtttcaccctgctgctgctgctgcttcgactgcgtgcgtgcaccgccgtcatcctcatggtcgttgccgagatagtatctcctgagtgccctgggcaggtagaagggcagcaggaaggcaaagaggttgagccccccaaagccaggttggcggccgcgagccgcctgccggccaccacccgccgcgccggcacgggcgggccgcgcccgaagtcttcccgctcctgcagctcctggcgcagccacttcggaggccgcgaaaatcctgcgggccctggaccttcccgggtacggcagcccctgacaggcaacccataaaggtgcccggtacacggcccccgaaaagcccctccggtgaaacaccccccgccggccacgaagaaacccctcgccgccctccccgccc

SEQ ID NO: 10296 - DNA, 862 bp, Zea mays
  misc_feature: Ceres CLONE 1061521
  misc_feature: Encodes the peptide sequence at SEQ ID NO. 10297
ctttttttcttgttgtcttgctctactccccagtccccagaccccagtcccccactcggacctgggcatcgcaccgaggacgacctcacgctggggcgggccttggtatattccttctcctccctgctcggtttagcacgcccgcttccagcacgcatcctcccctcctcccgtctcaagggatagcagggtgcagcggctcgatgctggaggaagcggacgggttcgccatggggtccgagggatcctcgggtccagttgtcgttcccagaaactttaggctgctagaagaactagaacgtggtgagaagggcattggtgatggaactgtgagctatgggatggacgatgctgatgacatatttatgcggtcctggacaggaactatcattggtcctcccaacactgttcacgagggacgaatctatcagttaaagctgttttgtgatacagattatccagataaaccaccgactgtccgattccagactcggatcaatatgacatgtgtgaaccaagaaactggattggttgaaccaagtctatttcctatgcttggaaagtgggaaagggaacatacgatggaggacattctgaccagcttaaaaagggagatgtcaactccacagaatcgcaggctgtaccaacctcatgaaggcaatgaagaccaaagagtagagcagaaaggggtgtctcttagatgtgtcatcatgtaatctatgtgcgttgcaatgtacagcattatcgaattgagcagcgagatgccgaggtgagagaccctctcaggaaatcatgtagttcgccttaatggtgccaccatcgcaataaaagcgtcgatgattgttaaaaaaaaaaaaaaaaa

SEQ ID NO: 10297 - protein, 170 aa, Zea mays
  misc_feature: Ceres CLONE 1061521
  misc_feature (26)..(168): Pfam Name: UQ_con Pfam Description: Ubiquitin-conjugating enzyme
  misc_feature: SWISSPROT Homolog: EC 6.3.2.19 Ubiquitin--protein ligase
MLEEADGFAMGSEGSSGPVVVPRNFRLLEELERGEKGIGDGTVSYGMDDADDIFMRSWTGTIIGPPNTVHEGRIYQLKLFCDTDYPDKPPTVRFQTRINMTCVNQETGLVEPSLFPMLGKWEREHTMEDILTSLKREMSTPQNRRLYQPHEGNEDQRVEQKGVSLRCVIM

SEQ ID NO: 10298 - DNA, 1068 bp, Zea mays
  misc_feature: Ceres CLONE 1061688-R
  misc_feature (669)..(669): n is a, c, t, g, unknown, or other
  misc_feature (690)..(690): n is a, c, t, g, unknown, or other
  misc_feature (692)..(692): n is a, c, t, g, unknown, or other
  misc_feature (693)..(693): n is a, c, t, g, unknown, or other
gtacgggccccccctcgaggtcgacggtatcgataagcttttttttttttttttttcttttttgcaacgcaaggaaaagggtctgaatttgcaaggcaagtactccgatgctctgacaagcacaaattgaaaagtaaacagatgtttatacaaacaaaagatgacaaaaagcatgctttaggttctcttctgttcttcagaagaaatataaccacgatgccctacacaatagtgttgttttaattattgcgacagacaaaatagcctcgagagtacagccagcacacataggtagatttagcaacaggcatcgccatcagggtaaaggttccaaccgaccgcaaaccttaagatcttgagcctcaggggttgaggtccttgacgatgaagttctggcggctgatggggttcatgatgaccggcggcccagcgacccggggccaggcctggaacctctgctccgtcgccttcaaccactccttgtcggacacagtccctgggatggtgccaccgaagatcttcttctgagaaacgatgtagtcacaggcatacgagatgacacaggagccgacgaggccggcgacgatgtacttgccagccattggagctttggatcccttttgccgggggcggcggattcgttgctgctccgaggtcgagtccctgctngtcttggttggtggagagacnannaggggaaaaagattctgggatttttcgatttagaatgtctaggtaaaggtctcggggcgaatcctgcagcccggggggatcactagtttctgaagggccgccacccgggggggaactcccgcttttgtcccttttagtaaggggtaaattggccccctgggggaaaccggggcaaagcggtttcccggggggaaaatggtttcccgttcacatttccccaaaaattaggagccgaaaaataaaagggtaaaccccggggggcctaaaagaggggggacccccccctttttggggtggggcaacagggcccttttatagggggaaaaaactgttggcgccccctttttataaaaaggcacccaccgggggggagaa

SEQ ID NO: 10299 - DNA, 1009 bp, Zea mays
  misc_feature: Ceres CLONE 1061750
  misc_feature: Encodes the peptide sequence at SEQ ID NO. 10300
acccccagccggcgtcaccctcatgagccagccgccagccccaggcttctagcctctgtccaagccggcagcccgccacccgcgaggccgcgaccggcgaccgcccgcccctgacgtggtgactgcgtcctcctccgctctccgtgcgccaccctgaagcggtgaggcgaggacctccaggcaccgccctccctggttcggcggctccctcgaggccttcctccccaccggttcagcagctcccgatccgcacggccaaaggccgattcgcgctcctccagccttcctccgcgtccaacagcaagggttgctacagataccgaaaaaggggggataaggattccaaaacactcggaggaaacatgtatatggggccatgtccaatcaagaaatacgaacaaacgtggcatcacaaagaaattttctctagtaagcaatgaaaaacttcaacccaagaatggcgatgtcttggacaagagggttaaagcatggtgttgttccgaggcatgccgctcaattggtagagagcagaagccttgcaattgcaagcaaggcgaagaagggtggaaaggctgatgctggcaaaactcctgctctcagccaagagctcaagagtacaacagtgttcggggcaaacatcttcaaggagggttctgatccgaaaatccaaccagactctgagtatcctgactggctgtggcacttgctcgacaagcgtcctgtactaagtgagctgcggaggaaagatcccaagacactctcttatgaagacctgaagcgttttgtcaagttggacaaccgatccaggatcaagataaggaatgacctcaatgctaagaactgacctggagtcttggacgaaacaggacctgctctactgttctttttattattaatataatactagacgacatgaataatttttctggagtttttggcaaaacatagcgacttgggatgttaaaatgttaagatgtgcttggtttgttactcaaaaaaaaaaaaaaaa

SEQ ID NO: 10300 - protein, 135 aa, Zea mays
  misc_feature: Ceres CLONE 1061750
  misc_feature (29)..(134): Pfam Name: Ribosomal_L37 Pfam Description: Mitochondrial ribosomal protein L37
MKNFNPRMAMSWTRGLKHGVVPRHAAQLVESRSLAIASKAKKGGKADAGKTPALSQELKSTTVFGANIFKEGSDPKIQPDSEYPDWLWHLLDKRPVLSELRRKDPKTLSYEDLKRFVKLDNRSRIKIRNDLNAKN

SEQ ID NO: 10301 - DNA, 1111 bp, Zea mays
  misc_feature: Ceres CLONE 1061835
  misc_feature: Encodes the peptide sequence at SEQ ID NO. 10302
ttacctggaacagagacaggcaggcagcaggccttcatcgcagagaggacagcagcacctgagattgacggcggggcagcgcgcgggcccttcccttcggagcactcagcgtgagagatggggaggcagccgtgctgcgacaaggttggcgtgaagaagggcccgtggacggcggaggaggaccagaagctcgtcggcttcctcctcacccacggtcactgctgctggcgcgtcgtccccaagctcgcagggttgctgaggtgcgggaagagctgcaggctgcggtggaccaactacctgaggccggacctcaagaggggcctgctctccgacgacgaggagaggctcgtcatcgacctgcacgcgcagctcgggaacaggtggtccaagatcgcggcgcagctaccgggcaggacggacaacgagatcaagaaccactggaacacacacatccgcaagaagctcgtccggatggggatcgaccccgtcacccacctgccgttgcaggaaccgccggctcctgctcctgctcccgccgagcagcaggagcagagccacaggcagcaagaagaactgcaactgcaagagctgcagaacggccgcgagcttatcatgcaggagggcgcgggggaagacgatatcacgccgatgatccagccgcacgagatcatgccgacggcggcagcggcaagcaactgcggctctgtttcctctgcccacgccggctccgcgtccgtggtctcgccgtcctgctcctcctcggcggtgtccggcgtggagtggccggagcccatgtacctgctcggcatggatggcatcatggacgccgactggggcagcctcttccccgacactggcgctggcggcggcggcggcggcttcgacttgggcgtcgatccgttcgaccagtacccgggcggtggcttcgaccaagaagacgaccacagaatatgacatcggcctagcaatgcacatagattcgccgcttctccttccatctcgctcagcacatcagcgccgtagcctccatgttttcttaatagctctccagggtccagtgctgataaacaagaactgacaaattcgggtgcggaaaaaaaaaaaaaaaaaa

SEQ ID NO: 10302 - protein, 278 aa, Zea mays
  misc_feature: Ceres CLONE 1061835
  misc_feature (67)..(112): Pfam Name: Myb_DNA-binding Pfam Description: Myb-like DNA-binding domain
  misc_feature (14)..(61): Pfam Name: Myb_DNA-binding Pfam Description: Myb-like DNA-binding domain
  misc_feature: The sequence is a functional homolog of SEQ ID NO 2 in the 10/225,068 US patent application
  misc_feature: The sequence is a functional homolog of SEQ ID NO 22 in the 10/225,068 US patent application
  misc_feature: The sequence is a functional homolog of SEQ ID NO 230 in the 10/225,066 US patent application
  misc_feature: The sequence is a functional homolog of SEQ ID NO 258 in the 10/374,780 US patent application
  misc_feature: The sequence is a functional homolog of SEQ ID NO 442 in the 11/435,388 US patent application
  misc_feature: The sequence is a functional homolog of SEQ ID NO 842 in the 10/412,699 US patent application
  misc_feature: The sequence is a functional homolog of SEQ ID NO 98 in the 11/375,241 US patent application
  misc_feature: The sequence is a functional homolog of SEQ ID NO 1564 in the 10/374,780 US patent application
MGRQPCCDKVGVKKGPWTAEEDQKLVGFLLTHGHCCWRVVPKLAGLLRCGKSCRLRWTNYLRPDLKRGLLSDDEERLVIDLHAQLGNRWSKIAAQLPGRTDNEIKNHWNTHIRKKLVRMGIDPVTHLPLQEPPAPAPAPAEQQEQSHRQQEELQLQELQNGRELIMQEGAGEDDITPMIQPHEIMPTAAAASNCGSVSSAHAGSASVVSPSCSSSAVSGVEWPEPMYLLGMDGIMDADWGSLFPDTGAGGGGGGFDLGVDPFDQYPGGGFDQEDDHRI

SEQ ID NO: 10303 - DNA, 1004 bp, Zea mays
  misc_feature: Ceres CLONE 1061902
  misc_feature: Encodes the peptide sequence at SEQ ID NO. 10304
aagcttgctccacgctccatcactctcctcactagtcacaagtacacccactggccagtggctacacgagctgagctatctccgctagcagctcgctcacaagtcacacccacgcccagagtgttctagctacaccctagctccggtcttcttctttttcttttttgaaaggcgccaccttggcgcggccttcctcctagatcgagtccaggcgcgcggtgcgagagggttccagcacccgcaggctgcttcccacaaccccattccacccttggaggtggccactgggccggccggccgcacctaactctggtcttgatctcatagcttgataagtaacaacgacgggcgtaagagctcagagaggtgggagctagggagaggaacaaaagaaaccagcgcgcttgtgcgtcgtgtggcgatgcatggcatgtgttgacatgtacaacccagagcaccatcatcagcaccagccagcgccgccgtccttcatggcgccgcggatgtccttctccagcgacttcgcggtggagccgccgcccccggccgcggcgcgcgggggcggggacgccgacttcgaattctccgtcggcagccacccgatgatggccgccgaccagctcttctccaagggccgcctcctgccgctccgggaggcgccgcagcaggccgccggcgggaggcccgtgacgctgcgcgacgagctgcgcgccgacgagcgccacggccgcgccccccgcgcgaccaacatccggtggaaggagctgctcgggctcaagaaggcgcccaagaagcagcaggccgccgccgccgccgccgacgctgccgccggcgcgtccaccgacgcccatatggtaggtcactaacgctagctagaagctcgggtgtatatacatcttcgtgttcacttatttcctcgcatcactcagtccatccaagtgcccatctgggtatataactatatatatagtgcattgttccgcacttcaaaaaaaaaaaaaaaa

SEQ ID NO: 10304 - protein, 146 aa, Zea mays
  misc_feature: Ceres CLONE 1061902
MACVDMYNPEHHHQHQPAPPSFMAPRMSFSSDFAVEPPPPAAARGGGDADFEFSVGSHPMMAADQLFSKGRLLPLREAPQQAAGGRPVTLRDELRADERHGRAPRATNIRWKELLGLKKAPKKQQAAAAAADAAAGASTDAHMVGH

SEQ ID NO: 10305 - DNA, 1245 bp, Zea mays
  misc_feature: Ceres CLONE 1061915
  misc_feature: Encodes the peptide sequence at SEQ ID NO. 10306
gcaccaggcaacccaccagcaggccgcagttcacgcttggctgacgaccgacccccattcgttctagccctccctccgacactccgatccattactcgctatggacgcggcgggcggcgaccagctaagcctggccgcggtgcgcgacgcgctggtgcggctggaggactccgtggtgttcgcgctcatcgagcgcgcccggcatccgcggaacgcgccagcctacgcgcccgccgccaccgctggagaacattcgctcgtggagttcttcgtccgggaagcagaggccctcaacgcaaaggctggacattatcaaaagccagaagatgttccattcttccctcaagatctaccctcacctctctttcctacaaagccttccccaaaggtcttgcacccttttgcttcattggtcaccgtgaatgatgcaatatggaaaatgtattttgatgaattgctcccgttattcactgttgatggtgatgatggcagctatgcacaaacagttgcactggatttagcgtgtctgcaggttctatcacaaagaattcatattggtaaatatgttgctgaggtgaagttcaaagacgctcctcaagaatatagtcgactaataaaagaaaaggacagcaattctctgatggatatgctgacattcaaggctgtggaagagaaggtcaagaagagagtagagaagaaggctaggacgttcgggcagaacgtcaccttggatgacaatgccactgctggtgacagcgagtgcaaggtcgatcccaaagtgctctccaagctgtatgatcagtgggtgatgccactgaccaaggatgtcgaagtcgagtatctcctgcgccgcctcgactgatcagtgatcacccgattagctgtagctgcgaactttatgtacgcgtgggtttcagtttgctttgcacatgccctttatggctttatcgttcaaactcaactacgagagaacgttaccaggatctggccttcgtctttgtcagcctgcttgcccgtcatctgcatgagtagtccaactgtaagtgacgcttggtatggaatgtaagaaaagtaatacaactggttacatgttatctttaatctcctgttgttcgtctgtaagtgactggcaacacagtagggtaccaattctctggttcagaaacgtattatgtttcttgcttacgtgacaaataccaaacaaaatagttacaaaaaaaaaaaaaaacaaaaaaaaaaaaaaaa

SEQ ID NO: 10306 - protein, 253 aa, Zea mays
  misc_feature: Ceres CLONE 1061915
  misc_feature: SWISSPROT Homolog: EC 5.4.99.5 Chorismate mutase
MDAAGGDQLSLAAVRDALVRLEDSVVFALIERARHPRNAPAYAPAATAGEHSLVEFFVREAEALNAKAGHYQKPEDVPFFPQDLPSPLFPTKPSPKVLHPFASLVTVNDAIWKMYFDELLPLFTVDGDDGSYAQTVALDLACLQVLSQRIHIGKYVAEVKFKDAPQEYSRLIKEKDSNSLMDMLTFKAVEEKVKKRVEKKARTFGQNVTLDDNATAGDSECKVDPKVLSKLYDQWVMPLTKDVEVEYLLRRLD

SEQ ID NO: 10307 - DNA, 790 bp, Zea mays
  misc_feature: Ceres CLONE 1061949-R
  misc_feature: Translation starting site: 235
  misc_feature (29)..(29): n is a, c, t, g, unknown, or other
  misc_feature (37)..(37): n is a, c, t, g, unknown, or other
  misc_feature (38)..(38): n is a, c, t, g, unknown, or other
  misc_feature (40)..(40): n is a, c, t, g, unknown, or other
ttataggtcaaaaagaggagccccaccanccttcttnncnaaaatccttaatttcaaatgggtaccgggccccccctcgaggtcgacggtatcgataagcttttttttttttttttttattcgaagccttatgatttcttcatttacagaagcaaagcttgagatctacaactaatccaaagaaagaacaaatggaacaagcggaccactagcactgatcgactaccgctgctaatgagtgtggggggaaaaggatgttcacggcgcgtggccgccggcggcgtcgtggcggtggtcgccctcgtaggtgacgacgagcgtggccgggtcgtcggcggcgcgctccacgtgcttgcgcgcggggcagcccttggcgctgctgcagcggtagtagccgcgcgggtagggggaccccttgatgggcttctgcccgtacttgcgccacgagtagtcgtcggcgggggatgtccgaccacccgggcacgtgggggtggggcggctgcaaccccgccggcggacccgggcacgcccaccgtgggccttgacaacatcccctggccgggcgccaattctttctttgaaagaaccaatgggccccccctcgaccgggatggggggttggtgccccccggtaggctggggaggaacagaaagaggggctcttcaggagggccagtcttttgaatctttatcggaaaggggaaagtctcttgtcccccaaaataaaacaccgcgctctaactaaatatcaataacagttcttactatggtagcaatgtacacggatcaa

SEQ ID NO: 10308 - DNA, 646 bp, Zea mays
  misc_feature: Ceres CLONE 1061964-R
  misc_feature: Pfam Name: PPR Pfam Description: PPR repeat
  misc_feature (46)..(46): n is a, c, t, g, unknown, or other
  misc_feature (84)..(84): n is a, c, t, g, unknown, or other
  misc_feature (98)..(98): n is a, c, t, g, unknown, or other
  misc_feature (446)..(446): n is a, c, t, g, unknown, or other
  misc_feature (447)..(447): n is a, c, t, g, unknown, or other
  misc_feature (454)..(454): n is a, c, t, g, unknown, or other
  misc_feature (457)..(457): n is a, c, t, g, unknown, or other
  misc_feature (465)..(465): n is a, c, t, g, unknown, or other
  misc_feature (497)..(497): n is a, c, t, g, unknown, or other
  misc_feature (502)..(502): n is a, c, t, g, unknown, or other
  misc_feature (506)..(506): n is a, c, t, g, unknown, or other
  misc_feature (513)..(513): n is a, c, t, g, unknown, or other
  misc_feature (514)..(514): n is a, c, t, g, unknown, or other
  misc_feature (518)..(518): n is a, c, t, g, unknown, or other
  misc_feature (528)..(528): n is a, c, t, g, unknown, or other
  misc_feature (536)..(536): n is a, c, t, g, unknown, or other
  misc_feature (545)..(545): n is a, c, t, g, unknown, or other
  misc_feature (546)..(546): n is a, c, t, g, unknown, or other
  misc_feature (552)..(552): n is a, c, t, g, unknown, or other
  misc_feature (556)..(556): n is a, c, t, g, unknown, or other
  misc_feature (560)..(560): n is a, c, t, g, unknown, or other
  misc_feature (562)..(562): n is a, c, t, g, unknown, or other
  misc_feature (563)..(563): n is a, c, t, g, unknown, or other
  misc_feature (573)..(573): n is a, c, t, g, unknown, or other
cttccataatccgcgcccacccccggaatacacaccctttttggtncttttttcaaatggggtaccgggccccccctcgagggngaatacctcacggngctttttttttttttttttcgcacacaaaaagcatttctgacacaaacatccacattaaaacctgatttaactgctaagcagtgtacttgcaacccttgaaagtaccccttaacctcagcacaagcactgaaaacacctgataagctaattacatcaaacccaacaccagacctgctcatgaaccgaaacagttgcatggcctcagctcctagccctgtgcgcacaagcccaaccatcatggcattgcatgtctcctccttatggtgaggcaaaccaatgaatgcccttcttgcatcaaccaagttaccagccttcgcatacccgcccacgattgctgtcccaacaanncggtcanaantaaaaacnttcttgatggcatgcgcttgccactgcctagnggtgntccnacatggnnttgntgcacaggancggaaggnaccggcatnnaccggntggntgantnnaagccccacnctctgcatctgcccgaacaacgaccaacaccccgtgccgactgccccctcccgaccccacccatcctatcgcc

SEQ ID NO: 10309 - DNA, 1128 bp, Zea mays
  misc_feature: Ceres CLONE 1062248
  misc_feature: Encodes the peptide sequence at SEQ ID NO. 10310
attgatccctgaaacccatccacaattggtagctcgttgatccaaatccaagacctcacgtcaacgcactgtctcgcctgttaattagtcgtcgacgtcgtcgtctatgtccaggctgatggctgccatgctgctcggaggcgcgcgcgtcgccggcgccgcaaagctcaccggtaacggcaacgctgctggcatgcaggctcttcccatgccggcgtgcttccttccgccgcgcccgcaggcagcgacctggacccgcctctgcttgcaggctgcgccaagatcgtcccaggcatacgacaacgcgccggaagaccggagagaaataggggacaagtacaaggacgcggcggaggaggcgaaggacgccaccggggacgccaaggagcacgccaagaggatggccggggagacgaagagcagggcgcaggacaaggccggccgcgtggcggaccaggcgtcgggcatggccgagcgggccaaggaccaggcgaagggcgtggcggaggacgccgcggacacggcgtcccgggcgacggagcgagcgaagaacgagacgcgtgacgcggcgcgggaggccgcggacagggcggggcacgtgaaggagcgggccaaggaggcgggacacgaggccgcggaccgggcgcagggggcggcgaaggcggccaaggaccggaccggggaggcggcggggcgcgccatggacagggccggggaggccaaggaccgggccgtggaggggaccgcgtcgtacggggagaaggtggtggagatgaccaaggagggcgcggggaaggtggccgagacggcgcaggccatcggggacatggcgaagcaggcggcgcggagcacctgggacgcggccaaggacaccgcgcacggcgtcaaggagcgcgtggtccccgacgcggaggacgtggacgccgccgtgaaggagcgggaccggatcgcgcgggatgtggacagggtagagcgggagcggaacatgagggaggccagggagaagggctcgggcttgccgtaggcccagctccaattttccctctccagaagacgaattttactcaactagctagctgaataaatgtttggcgatacatcgtgcgcgcgccaaaaaaaaaaaaaaaa

SEQ ID NO: 10310 - protein, 305 aa, Zea mays
  misc_feature: Ceres CLONE 1062248
MSRLMAAMLLGGARVAGAAKLTGNGNAAGMQALPMPACFLPPRPQAATWTRLCLQAAPRSSQAYDNAPEDRREIGDKYKDAAEEAKDATGDAKEHAKRMAGETKSRAQDKAGRVADQASGMAERAKDQAKGVAEDAADTASRATERAKNETRDAAREAADRAGHVKERAKEAGHEAADRAQGAAKAAKDRTGEAAGRAMDRAGEAKDRAVEGTASYGEKVVEMTKEGAGKVAETAQAIGDMAKQAARSTWDAAKDTAHGVKERVVPDAEDVDAAVKERDRIARDVDRVERERNMREAREKGSGLP

SEQ ID NO: 10311 - DNA, 816 bp, Zea mays
  misc_feature: Ceres CLONE 1062289
  misc_feature: Encodes the peptide sequence at SEQ ID NO. 10312
atttctttactcaacattttcactgctcagcgaagcgacacagccgccgccgtttcctcgtctcccatcttcatcttcctcgcagcgccgggactccatcttccgctycctctcttactcgtgctcggcacgcaggcgacgggagcggcgctcaggctcgggctctcagcggcgacttcagcggcttcccctccsgcctcgcgccctcgcctccggtcctccgcacatcggccggtgatcctgctttaagatgtcagaagcactcgagaaagataaggaaattgatgaagaggaagaggagtatgtattgctagagttggacaattgtctttattcagacatgtcgccaggtgctccgttcgtactctctggtttggatacattgacgcctaccttgatagtaggtgacagtcttaagatgatcggagaatatgaagaaactattggcacctgctatctattctctgaaactgaagctgaaccgaaacctacaagtaatgagatggcaccttctgaagaaaacacagacaaacaagctagcagcagtaaggaagcgccgtcgaaggaggtgaaccatctcgccagcgttcaaaagatcctcaaatttcggccaatcaatgcggagcattcgcagcatcgagcatatcagcacaaggacaaggaattctagaaaaaaattgtagctggctatctgccgttatcttcttcattggccatccaaacgaggtggtttgtacactttgctttgttctatacataatctgatctattgtatcgatctgtcggtaattgtttctcaaaaaaaaaaaaaaaaaa

SEQ ID NO: 10312 - protein, 139 aa, Zea mays
  misc_feature: Ceres CLONE 1062289
MSEALEKDKEIDEEEEEYVLLELDNCLYSDMSPGAPFVLSGLDTLTPTLIVGDSLKMIGEYEETIGTCYLFSETEAEPKPTSNEMAPSEENTDKQASSSKEAPSKEVNHLASVQKILKFRPINAEHSQHRAYQHKDKEF

SEQ ID NO: 10313 - DNA, 1923 bp, Zea mays
  misc_feature: Ceres CLONE 1062383
  misc_feature: Encodes the peptide sequence at SEQ ID NO. 10314
aatcgccagcgagagccatgccgcctcctcccctgccctcgccgagcctgaccgactgaccccacctcgccactgttctttccctgccacctgggccccacagcgcccctttaccgtcaccaccaaatccccaaatcccggaggcacgaggagggaattcgtcgcctgaccgatcggccgatccactgccgtcggcaccccaatccgccgctgccgccatgttcaacaagatcatcaagaggggaaaccgcaagggcgcgcgcggggacaacgcggaggccgccgcgcgccccgcagcgccctcgtcgtcctccgggagcggcggcggcggcgcgggggcagccgcgcccgtcaccgtcaaccacgcctcccgggccacagcgccttcgccgtcctcgcccacttcgccgcacgtggcgccgtctgcgcttgcgaccaacccggcgggggcggcgtccccgccactcctcgagccgctcccgcttctccgcgacgtcgccgccgcggatcgcccgggcctcttcctccgcaagctccgcatcgtcgccgcgctctttgacctttcggactcgctcaagcacccacgggagaaggaggccaaacgccaggctctcctcgagctcgtcgattacgtgcaggctccagctcaggcagcgggcgccaacgcacccacgcgcctcccggaccacgtccaggaggcgctcgtcgccgccatctctgccaacatcttccgcccgctaccacccgcgctgcacgaatccgccgccgcgatcgaccccggcgccgcgcccgacgaggaggaggagccatacctcgacccctcctggccacacctccagctcgtctatgagctccttctccgatacgttgtttcgcccgacaccgacaccaaggtcgccaagcggtatgtggaccacgccttcgtcctccgtctcctcgacctctttgactccgaggatccgcgtgagcgcgagtacctcaagaccgtgctccaccgcatctatggcaagttcatggtacaccgaccattcattcgcaaggccatcaacaatgtgttctaccggttcatctttgaaacgcagcgccacaatggcataggggagctccttgagatccttggaagcatcattaatggctttgccttgccaatgaaggaggagcacaaactattccttgcccgtgctctcatccccctgcataagcccaaatctgttgcgatctaccatcagcagctgtcctattgtattgttcagttcgttgagaaggactacaaattagcagatactgtgattaggggtctgctcaaatactggccagtcacaaactgccagaaagaggtgttgtttctgggggagcttgaagaagtgctcgaggcaacacagcctgcagagttccagcggtgcatggtgccactgttcaagcagattggacgatgccttaacagttctcacttccaggttgctgaacgtgctttgttcttgtggaacaatgatcatattgtaagcttgatagcacaaaatcgtgttgttatatttccaattatatttgaagctcttgagaggaatatacagagccactggaatcaagcagttcatggtctcactgcaaatgtgcgcaagatgtttttggacatggacagtgaactatttgaagagtgccagcagcagtacatggagaaacaagcgaaagccaaagagatacaggaacaacgagaatcagcatggagacaattggaagctgttgttgctgccaaggctgctggagatgacatggttttggtcaactaggtaatataacctttcgcttcatttatttgttagtgcttgtgttcgtaagtttttctagtcttgtaacctaaaaccgtactactctgtttatgtcctcttgttcttgctttgttttagcaaaaaaaaaaaaaaaaaa

SEQ ID NO: 10314 - protein, 522 aa, Zea mays
  misc_feature: Ceres CLONE 1062383
  misc_feature (86)..(510): Pfam Name: B56 Pfam Description: Protein phosphatase 2A regulatory B subunit (B56 family)
MFNKIIKRGNRKGARGDNAEAAARPAAPSSSSGSGGGGAGAAAPVTVNHASRATAPSPSSPTSPHVAPSALATNPAGAASPPLLEPLPLLRDVAAADRPGLFLRKLRIVAALFDLSDSLKHPREKEAKRQALLELVDYVQAPAQAAGANAPTRLPDHVQEALVAAISANIFRPLPPALHESAAAIDPGAAPDEEEEPYLDPSWPHLQLVYELLLRYVVSPDTDTKVAKRYVDHAFVLRLLDLFDSEDPREREYLKTVLHRIYGKFMVHRPFIRKAINNVFYRFIFETQRHNGIGELLEILGSIINGFALPMKEEHKLFLARALIPLHKPKSVAIYHQQLSYCIVQFVEKDYKLADTVIRGLLKYWPVTNCQKEVLFLGELEEVLEATQPAEFQRCMVPLFKQIGRCLNSSHFQVAERALFLWNNDHIVSLIAQNRVVIFPIIFEALERNIQSHWNQAVHGLTANVRKMFLDMDSELFEECQQQYMEKQAKAKEIQEQRESAWRQLEAVVAAKAAGDDMVLVN

SEQ ID NO: 10315 - DNA, 1293 bp, Zea mays
  misc_feature: Ceres CLONE 1062556-R
  misc_feature (402)..(402): n is a, c, t, g, unknown, or other
  misc_feature (1029)..(1029): n is a, c, t, g, unknown, or other
  misc_feature (1147)..(1147): n is a, c, t, g, unknown, or other
  misc_feature (1262)..(1262): n is a, c, t, g, unknown, or other
cgattgggtaccgggccccccctcgaggtcgacggtatcgataagcttttttttttttttttttcttttttggcacaatggaaaagggtctgaatcccgccggccaggactccgatgctctgacaagcacaaattgaaaagtaaacagatgtttatacaaacaaaagatgacaaaaagcatgctttaggttctcttctgttcttcagaagaaatataaccacgatgccctacacaatagtgttgttttaattattgcgacagacaaaatagcctcgagagtacagccagcacacataggtagatttagcaacaggcatcgccatcagggtaaaggttccaaccgaccgcaaaccttaagatcttgagcctcaagggttgaggtccttgacgatgaagttctngcggttgatggggttcatgatgaccggggggccagcgacccgggggcaggcctggaacctctgctccgtcgtctgtaaccactccttgtcggaacacgtccctgggatggtgccacccgaagatctgcttctgagaaacgaagttgtcgcaggggtacggagatgaaccatgaagccgaggaggccgggaaacaatgtatttgacagcgagacggaaacgggggagatcgtttcggcggggggtgggggaattcttcgccgagtgcgaaaggtagaggttcgtgctgttccctgggatcgagaggcgagagagcgcggaagggtggaaaaaaagagtgtaaggggatctttcttcgatttggaggggggttcatggggtatataggggggcttgggggggagattaagaggggtctaggctctgggggggggatagcgcctaatggagctggaatgcgaggtgagggtgcgtcgacttgatgaggaggaggcaaatgcgcgtcgtggggtatacgcgctccgatcattgtgaaagatagtgtcgtaagaagggcggagtgaacatcggttaggatagaaggagagagcgaagaggagatgtgtacatagtggagtcagaaaaggganggtaggaaaggggacgaaagagagctgtaaattcaagaaacgaggagagagcggggaatgtctgggggtgtgggctcagagagcgtcgggggtgggcgtgaggatacatgtaagagancctggggcaggagtagacgacggagactgtaagtcgatagtaaaccgcacagagatatgaacaggaatcgagaatacactggcgtggatgtaatctacactttcacaggtaggantgtggacgttctcaggttgaggagatgggga

SEQ ID NO: 10316 - DNA, 882 bp, Zea mays
  misc_feature: Ceres CLONE 1062663-R
ttgggtaccgggccccccctcgaggtcgacggtatcgataagcttttttttttttttttttctttttttttttttttttttttttttttttttttttttttttttagcaagctttcatacactggaacccgcaatacattacatcccattatattttacattacattccgaaaaaccaaaaagatatcgatcgaccttgtcccacgggacacttaattcttggcgcgggcccccgcaaaaccatttaattcaatcttaacttatttcccccttaatttaactaggaacgatagtagtagtagcaataattccgccgcatcactgggactccctggctcccaaggggcgcctgggggtcggcgtgggcttgggcttgctgtcggtcttgacgggggaggaaccctccatggggatgccgcaaaacccgcccgcggaccccggaatccttctcccccctggaggaggcccgggttcccccaagaagggcccccaaaagttttttcaccgtccaataaccccttggcgggctttgggcaagccggtaacccgaaaaaccgggaaggccggggggcccactctctgggccccaaaattggcgggggaaaaaacccccccgggaaagaaaaaaaaggaaaaaccctttccccgggggggcttcaaagggggacacgggaaacgggggggggggtttccccccaccccccggggggaaaaccccccccccctccggttgttgggcgcgggacactccctggggggggccccccctaaaaggggccccccccccccgggggggggattttttgggggccgccctttttccccaacaattttcaggggtggcctcgggggggggggccccggaaaaagggggagtgggac

SEQ ID NO: 10317 - DNA, 821 bp, Zea mays
  misc_feature: Ceres CLONE 1063733-R
ccaaaccgccacctttccctttttattcccccgcctaccccttaaaaaatataaacaaaagcgttacgggccccccctcgaggtcgacggtatcgataagcttttttttttttttttttgaaatgaatatactaattttgaatttcactgctatcacgttatttacagttcacacatagagacacgaatttgtttttccactagtgttgcccgaagagactttagcaacattatcaatgattagaactccgagcaaagcatagaacctatgtagagttaggtggccgagggtccctgaacacccaggaagaaccaccagatgcggcccgggaaggtgatgtggctacatagttacttcctggtccaccatgctgaataaagaccaagaggatgacctgggtgtaaattatgtaggcaaagcgacgcggacttgcccgtaaagaacgggtgcctggactcctttggaagctgtggcccctgataaagaactctaacggtggacctcccccaataaagtatggtttatgaaagagcacaataatcctggctgaaaattgcatctaaagggcgcggtacaaaaaaacgcccctctgggcttttgacaaccacaacatatggaaacctccccagcaaccaccccccccataattttccgcatccatccacgccttatgctacggggtgctaaaacctacaaaatcagagaactcgccaaaacagagtcgagaagcatatcgcgtaaggcgcctcgggggtaatatgtatagtatgtatgttcatgtctaaaacacctatcaccccattatacacaaccatctcca

SEQ ID NO: 10318 - DNA, 471 bp, Zea mays
  misc_feature: Ceres CLONE 1063849-R
  misc_feature (143)..(143): n is a, c, t, g, unknown, or other
  misc_feature (191)..(191): n is a, c, t, g, unknown, or other
  misc_feature (255)..(255): n is a, c, t, g, unknown, or other
caaaattgggtaccgggccccccctcgaggtcgacggtatcgataagcttttttttttttttttttgctcaacatccaatccaattgtgatttttctttttcttccacaggaaaataaaagagtcaaagttcctacagcaatncaattatcgtcatgcttgctttcttctaacaaaaactcccccaaagcntaaatggtttcacccaccccatcaaattactttcatcaccacgactagttttgcagctactccntccttcaaggaaggcctgcgatttcccgaatggaaagattccgtgtgaaagaaaacccaaatggcccggccccgcaaaaagaacaaacccttggggttaaccaaaaattaaggggttcccccaaaaattgaaaaaaccgggggcttaaaaaacctccccaaaaaaaaaacccccgggaaaagggaaaaaattgggggcccccccccccaacacaca

SEQ ID NO: 10319 - DNA, 662 bp, Zea mays
  misc_feature: Ceres CLONE 1063862-R
caattgggaccgggcccccctcgaggtcgacggtatcgataagcttttttttttttttttttgggtaacaagtacatggttgataagattccatgttcacacgaaactgcatgaattaccgaagctcacgcaaatttgttcattcagcaacaaactcctgaccataagggacccatgttcacgcaaaacagcatcaattacaactcgacaacgctgatagtagcagctagattcatatcatccaaccaagtgcgagaaattcttccgcgagtatagcttaaaaccaaggaggggcaccttctttattataaggggcatggactcttggtgggacccgacaggtttcaccccctcctgggccgggttctccgtttcggggggcttaacgggttccttaaccctgtggcacagggggcccccccgggaggcggaaacccccgggaagcggttctgggggacccctcttttttgggggacgcaacatttgggggggcttcccctctgggggggtcccagggggggcccccacacaccccgggattttggggaacttggggccccctcccctctgcccctttggtttacaaagaaaagacccctccgcccccctgtttggagaaatatctaggggggacaataatctatgttgcggggcgcggggg

SEQ ID NO: 10320 - DNA, 630 bp, Zea mays
  misc_feature: Ceres CLONE 1063955-R
  misc_feature: Pfam Name: TLD Pfam Description: TLD
  misc_feature (324)..(324): n is a, c, t, g, unknown, or other
cattgggaccgggcccccctcgaggtcgacggtatcgataagcttttttttttttttttttggatataaataaggttattatttcccataaaaagagtgctgtacacaacctccaaatatctgctattgtgattttttttcagtgctcagtcactcgcactcgccataccaatcagcttcagcatgttccgatcctccttgaatctctcaaggaccgtcccctttacaagctccggcttctcgtcattcgatcccttcacttgtatcccccaacattcaataacttctggtctgaacctgctcgtgtttgaaaggggaagattngtgaatgtggctgaggtaaatgagtgcctttgatcgaagcccgcacagaggaaaagggcaaagtgattgggcttccttccaaagccgataccattttggaatgtctctgagggtaaaggtcccagcccaccattggaaaccttttgttgcgtcccgaaggggcaaaaattggaacctttcggggataaaacttgaaaaggaaaaggcttccctggcccctaaaaaaaacgggggcccttccccaagggggggagaacaaatcccccccaaaaaggggaaccttttttggtctttttaaaacccaaa

SEQ ID NO: 10321 - DNA, 788 bp, Zea mays
  misc_feature: Ceres CLONE 1064046-R
tgttttcttcgggcttccttttcatccattctctcccacatcatcccccctcccccccacccccaattgggtaccgggccccccctcgaggtcgacggtatcgataagcttttttttttttttttttggtatcaaaatcagacagcataacttgacttgcataacttagtccattcaatccaatacataaagatataaggtctgtccccatcagacgacacaagataacttcaaacgaacaacacgccaccaacaatacttctggaaccaagctcgcatcgtcgattcttcttcctacgagaagcacggggaacactacggcgacatatactaatactgataggtataggtatgacttgctgcagagtcaggcggtaggaaaaggagctaaggggaacggggcactcagatctgacgggcaaagccgtcttagttggtcttggtggggcactcgcgcgagaagtgccccgactctcctcaggagaagcagctgccaccgccaccaccaccgacactgccggcaccacctcccgtagccactgccaccgccgccgcctccccgggggcaactccctaggagatttcgatcactcctcgcccgccacttgaaataactaaacggacctcacgacgcccgcctatccgaagaaagaagcccccctgtcctgcccgtcatcgtcctttttattccgcctcatctgggcttcaccaccaatttggccgggcccgaacgggcgtggccctccaagcgcctattctcgatcccatatccctcattgatagagcta

SEQ ID NO: 10322 - DNA, 672 bp, Zea mays
  misc_feature: Ceres CLONE 1064076-R
ccgggccccccctcgaggtcgacggtatcgataagcttttttttttttttttttccttttttttttttttttttttttttttttttttttttttttttttttttcagggaggaagcaggtttatttcttcgtattacaccagtatccattgaggctaacttgttggataggccccccccacaaacttcaaaaggtaagttcacataacatatttatttacatcttttcaggcggccggtttaaagtcctggaatttcttaaagttctcccaggccttctcccacacttgggcctcaaaaagctttttggcgcccccctcaatgacctcaatggtgaaggaatgcataaacccggtcaccacctgctgcctcaccttcacaagcctctcgaactccaccacaccgttggccttggtgttgtgatcagcaacagcaaaactggcaagcacgatggatgcaaggtctttctcccacccccccggcgagtcctggaatccccccaatatcactcgcgaggggggacagccccccgccctggacaagcgctagacatcgcccccgagcctctggagggtgggctgacactacataggagtgtccaaccgaggcccgctcttgaaattctgatagagaacaaatttgttcatggggacgagattatttttctaaaagg

SEQ ID NO: 10323 - DNA, 1360 bp, Zea mays
  misc_feature: Ceres CLONE 1064081
  misc_feature: Encodes the peptide sequence at SEQ ID NO. 10324
acacaaccaccgcgctcccaacggctcaccgtcaccggccgggaggcgatcccatgggagagacgacctaacttttctcggattctagctcgggtctgcactctgcacgctgctgctgctggtttcttgagaggcgagaccctgaagggatggcactggaggccgtggtgctttcccagcaaggcagtcgctttgggtgtggtgccatggcagcaggagggccttggagtggcctgttttttagtggaatggagggcgtggtcgagatcggtagtggcgctggcggcggccgggacgtggccgggtgctcgccgccacagctcctgcaggagccggctgcccgcgcgctgcctgtggcgtcgtccgtggggagcgcgagtggcggcgccggtcaggatgccccggcggcacttgctgtgaccgcgacagcggcggccggaaccggaagaaggaagcggcgaaggatgaggccactgaagaacgaggaggaagtggagagccagcgcatggtccacattgccgtggagcgcaaccggcgcaagcagatgaacgagtacctcgccgcgctccgctccctcatgccgcccgcctacacgcaacggggcgatcaggcgtccatcgtcggcggcgcgatcaacttcgtcaaggagctggagcagctgctccagtcgctggaggcgcagcagaggcgttcctcccggcggcagggccccgcgtgcgccgtcgatccggacgacgcagggccgttcgcggacttcttcaccttcccgcagtactcaatgtgcgctgccgcggcggccccatcagagaaccccggcgccgacgccgacgccgagcaggaggcgtccgggtcgaagccgtcgggcgtggccgacgtggaggcgaccatggtggagagccacgccaacctgcgggtgctgtcccggcgccggccgaggcagctgctgcggctggtgctggggctccagggctaccgcctcaccgtgctccacctcaacatgagcagcgccggccacatggtgctctactcgttcagcctcaaggtggaggatgattgcccgctcacctcagtggatgagattgcaggtgcggctcatcagatcgtcgagaagatcaacgaagaacaaggcggcggcagcttagagtagtgctttcttgcggtgcatgttatcttttttctttagctcctgtagcaagtgaagtggttttctcccttccctgtgtctgtgtgcaagcgaataatgtactgatcagcttagccggtctctgaaacagtagtatgcatcagaacctatctttgttcatagataatgtccatggccaagcatgcatgcaaggtctccgaaaaaaaaaaaaaaaa

SEQ ID NO: 10324 - protein, 332 aa, Zea mays
  misc_feature: Ceres CLONE 1064081
  misc_feature (118)..(169): Pfam Name: HLH Pfam Description: Helix-loop-helix DNA-binding domain
MALEAVVLSQQGSRFGCGAMAAGGPWSGLFFSGMEGVVEIGSGAGGGRDVAGCSPPQLLQEPAARALPVASSVGSASGGAGQDAPAALAVTATAAAGTGRRKRRRMRPLKNEEEVESQRMVHIAVERNRRKQMNEYLAALRSLMPPAYTQRGDQASIVGGAINFVKELEQLLQSLEAQQRRSSRRQGPACAVDPDDAGPFADFFTFPQYSMCAAAAAPSENPGADADAEQEASGSKPSGVADVEATMVESHANLRVLSRRRPRQLLRLVLGLQGYRLTVLHLNMSSAGHMVLYSFSLKVEDDCPLTSVDEIAGAAHQIVEKINEEQGGGSLE

SEQ ID NO: 10325 - DNA, 877 bp, Zea mays
  misc_feature: Ceres CLONE 1064085-R
tttttatcttctccaccaccccccccacccccctctttaaatagcaacaacgaattgagtaccgggccccccctcgaggtcgacggcatcgataagcttttttttttttttttttgtaattgacaagtggctccagcctacatgctccgcttgtcagtctcattgtattgaaatcatttacctttattgaatatatacttacaaacaacacatacaagtacaaaattgtggtaaaaagggaataccttggaaaacccatttattttcattggctattgcctacaaataacacgcagcgtacaccattagataccttaacagtttaattaccaaggacttcaccagcactactctgatgatttggggaaaccacaaagcttttcctccatgacacgctgcgcttcagcgacctagcctcttgacaacttcccttggtgggaccatcctcccgcgattaacccaaccactctggtccagcatacatgggccaatgctaatcaatatcgccctgttggttgtccccttaaggaaccagcacccaggaaaacccggcccatatatccccttggcggcacacccattgggattggatagaaaatggaccctattaaatagggctcgaatttttcccctcctgggctttccacggaaccccggaaaaaaatccctctccacctctcaacaataaaaaaaggcgggtctttacaggaaacaccgttggggggtagcaacccagagactctctttagcaacgcccccgaacaaaacagcttggtaaaatccccgtggcaaacttacatccccaaaaataaacttttttttctctaatcaaccgcgggattgggcgcccaaaattttttcccccccgtggggccac

SEQ ID NO: 10326 - DNA, 913 bp, Zea mays
  misc_feature: Ceres CLONE 1064130
  misc_feature: Encodes the peptide sequence at SEQ ID NO. 10327
atagataatcttatataaaaataggtttatatatcctggtgctcttgccatggctggtgcatcgctcctctccccatcctgcacgctcctccgcctgattcccagcgcgtcgcacttcaagagattcgatcgggttcgccggttcgcgcccgccgccatggcgacttcctcaggaccaaaggaggcgccagcgaataaccctgggctccagaccgaggtcgaccccgccaccaaaggctacttcttgcaacaaacgatgttacgtgtgaaggacccaaaagtgagccttgacttctactcacgtgtgatgggcatgtcgttgctgaaaaggttggattttgaagagatgaaattcagtttgtattttctaggttacgaggatgtgaccttagcccctgatgatcatatcaagcggactgaatggacttttaggcaaaaagctactcttgagctcacccacaactggggcacggaaaatgaccctgaattcaaaggttaccataatgggaactcagaccctcgtggttttggtcatataggagtaactgtggatgatgtccacaaggcatgtgaacgctttgaacgtcttggggttgagtttgtgaagaaacctgatgatggaaaaatcaaaggcatcgctttcatcaaagatcctgatggttactggatcgaaatatttgaccagacgattgggacggtaacttcttcagcatcatgatgaacagtagtggttccttatatggtgcgcaagatcatacaactctggcataagagcttttcatatgtgtgtctggggtctggactcggattaagggctggaatctgtttacttctagcatcttcttgctttaataatatgcgaactatgttgaggaatgaaataaaataagttcgggcaaaaaaaaaaaaaaaa

SEQ ID NO: 10327 - protein, 222 aa, Zea mays
  misc_feature: Ceres CLONE 1064130
  misc_feature (65)..(209): Pfam Name: Glyoxalase Pfam Description: Glyoxalase/Bleomycin resistance protein/Dioxygenase superfamily
  misc_feature: SWISSPROT Homolog: EC 4.4.1.5 Lactoylglutathione lyase
MAGASLLSPSCTLLRLIPSASHFKRFDRVRRFAPAAMATSSGPKEAPANNPGLQTEVDPATKGYFLQQTMLRVKDPKVSLDFYSRVMGMSLLKRLDFEEMKFSLYFLGYEDVTLAPDDHIKRTEWTFRQKATLELTHNWGTENDPEFKGYHNGNSDPRGFGHIGVTVDDVHKACERFERLGVEFVKKPDDGKIKGIAFIKDPDGYWIEIFDQTIGTVTSSAS

SEQ ID NO: 10328 - DNA, 1096 bp, Zea mays
  misc_feature: Ceres CLONE 1064517
  misc_feature: Encodes the peptide sequence at SEQ ID NO. 10329
aaaaaaaccaaacacccgtagcctccgccgagagtcgcagccgccgacacccagtcgcccaccgacccgaccccaaccttggagctgctgtgccccggcggtccgtctctggccagagctccgccaccgcccgccgatcagagctccgcctccgagacgacgcgcctccccccagtggctcaggccgcctgcccgcctggcaggacgccgcgccgagctctttcccggcagctgctcgcccgcgccgatcttttcttcggcaaccgcgcgcccgcgtcgagctcctccccgtccccggcagccgcgcgccagcgccgagctcctccccgcggatccgcctctgctcagtctgagctccggccagccgcgagctccgtcgaggcgtcgacgccgaggcccagctccgcccgtgagtgcctgtgccggattcagcaaacagaaatttgctctgctggttagatagatggaggtgccaatgaacaccacgcaatctggtcctcacttccctgtgcagcatcggtccctctcgttagacatcaagggaaataaaacagatattgttatcaataaatacgaagatacctttctggtgattgtgacccaaatcggctgcatgggaaccatactagctgccaagaaagatgaaagtgttttctccgacccaacctacaacgtgtctgttctttttgggaagagagatgagccactcctactagcttgcgcacgtcaacttattgagcacataagtggcagtggctcagcccggtcattggtgatttctctgggtctgaaagatcattctcagggaacgctgaaggatattactgtagctgtgatcgagaatcgcctttggtgatgattgaatagctgagctgggcatgggaacgctgaaagatactgtttagcattgcgcaataggagccatcgtttacaccatgcactaaattctggtacttttgtagttagaccttctatctactgggattaacaaaaggtgggtttaagctgctgtcaaaattggagtgtcaactttaacgctaaacaaaaggcaatgtacactggtaaagcacttctgagttgaaaaaaaaaaaaaaaa

SEQ ID NO: 10329 - protein, 130 aa, Zea mays
  misc_feature: Ceres CLONE 1064517
MEVPMNTTQSGPHFPVQHRSLSLDIKGNKTDIVINKYEDTFLVIVTQIGCMGTILAAKKDESVFSDPTYNVSVLFGKRDEPLLLACARQLIEHISGSGSARSLVISLGLKDHSQGTLKDITVAVIENRLW

SEQ ID NO: 10330 - DNA, 546 bp, Zea mays
  misc_feature: Ceres CLONE 1064524-R
  misc_feature (159)..(159): n is a, c, t, g, unknown, or other
  misc_feature (249)..(249): n is a, c, t, g, unknown, or other
  misc_feature (250)..(250): n is a, c, t, g, unknown, or other
  misc_feature (499)..(499): n is a, c, t, g, unknown, or other
caaattgggtaccgggccccccctcgaggtcgacggtatcgataagcttttttttttttttttttagagcaataatatcaaagctgcatcgaccaaataacatttcatgaatgaatacaacacgcagtgttccaattgctatttttgaaatttgagtantgtaactatctatatgggcatggtaggctcatcctctttcttcaaatcaaacatttggtcatttctttgacctggtattgccaaaaaaannaaaattcccccccatatttgcagctgggcccaagcctccaacttttaaaccttgacccaccggctgtaaaaacccaagcttccttggggtttatttcaaaaacaggtgtcccccgccccctttaatggcccaaaaggggaacccttttccaaaaccccctctgggggcccccccaaaaaaaatttttgcttttttttttaaaaaaaaaaagggggccccccccttctgtgtttaaaaaaaaaaaaaaantttttctcccccccccccaaaaaaaaattttttttcccccccccccc

SEQ ID NO: 10331 - DNA, 631 bp, Zea mays
  misc_feature: Ceres CLONE 1064551-R
ccaattgggtaccgggccccccctcgaggtcgacggtatcgataagcttttttttttttttttttagctcagagacgatatacaatacttgcagcattaaccaacgtacatgacatttcagactcaagaatacgcagatgaaatctacatatgcacaagcgctagggcatttgggactgcttttctctctaagtcgccaaaaaaagaaaattccgcgaaggtaaaaacatgatttaccactatacactcttgtataaggctggcgaaaagaatgagttgccatggtacccgtcactactcgataacaacgtccctcgccaccatgtccctgttcacaataagcttcccatcttcatccctggtgaaaagcttgtcaaccagctcatcccaactggtccttcctgcagatttcggttctgatgaagtcgtctcgctgtgagtgtcagaggatggcgcagggcaagcgccctcatggggttcctcttcagagatgtctatcgcgtgagggacatccaagggtttcgctctatggagcgcattcttgtgttcttccttggaactttgcaatctcctcatctttttgttcacaaggaagaggttgttgccttctcaattttccttcataagctcc

SEQ ID NO: 10332 - DNA, 587 bp, Zea mays
  misc_feature: Ceres CLONE 1064601-R
  misc_feature (18)..(18): n is a, c, t, g, unknown, or other
  misc_feature (19)..(19): n is a, c, t, g, unknown, or other
  misc_feature (24)..(24): n is a, c, t, g, unknown, or other
  misc_feature (529)..(529): n is a, c, t, g, unknown, or other
ccgattgggtaccgggcnnccccntcgagtcgacggtatcgataagcttttttttttttttttttggtgcggatggcgggaaaagagagggtaaagctggcgcaaagcaagcagaggagaaccagccttgcatttgcgaatcgataatacatgggattaatattaaacaaggggaaaaaaacaatggttacactgggaataaaatgcgaaaaagggaaggtcggagggccagctgcagtgccgagagcccgtgggtgggtccgccaaggagcccactttgtcagctccgagtgtcatgtcatggtttcgccgttagtgtcacggcggccgttgccttcacgttcacgagcggatcacggcttcgacacggacgcggcgtccttgggatgctgctgctgctgctgcgagtgcgatccctcgccatcagtcccacccccggcgccgttgggcgccatggccgactgcgccgtgagcacggacatgctgggtgaggccggcacggcgtcggctccggctccggggccgccgntcatggcgtggggcggcaaccgcatatcgtccatgtggcgcgcggcgtcgacccataa

SEQ ID NO: 10333 - DNA, 591 bp, Zea mays
  misc_feature: Ceres CLONE 1064627-R
ccgattgggtaccgggccccccctcgaggtcgacgttctcgataagcttttttttttttttttttgatcccaaagttcttttatatatatgcacaagggtgaccgggtctgtacaggtagagactaagtttacagttgctgcacaacgcgtgcagaaaattagagagacatatacatcttggaaccaattttgttaatgctggacatctagaataagtcccactgccaatagatcttatcgacaatacctccaccgctccgcaccgcgacatggagggtctctgatgctggaggaacgccccacagcaatggtactgcaacagacatggttagcttctcctggaggccgttactgcttgccttctctgcagtgacaacatttgttgctgctatgttaaatagtgctccaaggcaaagactttgatttggatccatgtaagagctctcctgaaaccggcgcaacttttgtccactcttcagtttccgttgcctcttctcagaagcagaaactcgacgaggaaccaaggaacccccaatctggatcagcccatcagaagtgaatagcgtgactctgtcttcaggcacccattg

SEQ ID NO: 10334 - DNA, 788 bp, Zea mays
  misc_feature: Ceres CLONE 1064681-R
  misc_feature: Encodes the peptide sequence at SEQ ID NO. 10335
  misc_feature (35)..(35): n is a, c, t, g, unknown, or other
  misc_feature (49)..(49): n is a, c, t, g, unknown, or other
  misc_feature (51)..(51): n is a, c, t, g, unknown, or other
gaaggcacacctcccgtcctactaacaatacaccnccttggccccagcnanaccaactaatggataccgggcctcctctcgaggtcgacggtatcgataagcttttttttttttttttttacgattgcaaaattagcttgtttaataaatagcatgagagtcactggtagcaaggtacgataataacacccggatgatgattaacatactcctgcagacactcagcatatgaggataacgcacggacacgatacaactccaacttacataagagtagctgggtgttgcacagacacaggctacttgcaaaattattaatacttcttgtcgtcactgttggcagctacgatggtgctggtggccacttcaaggaacatgccggtgatcaggagatcgctgtttccaagaacatgcctactgcttgtacacttactactgctacttcttcccggtccctgattgacacacggcctgtcccttgtttggccaccatgaacaggtggtgggcccatgacccaggaaaaatgcctaagactcccacgaacggccggttgaatcaccgaaaccagctgggacacctgaatgtccacgccaagtaccccctccgtatagtccgtacttccaaaaaatcatctccaacgatgatacctttcccccttttcccgctgaaataaaagggatttcttctaaactcctcaatgtcaaaaaacttattcctccccttttgcacgaacatcgttgggtgaaaaacacctcacgactagttttccggaaaactcccgtgcatg

SEQ ID NO: 10335 - protein, 30 aa, Zea mays
  misc_feature: Ceres CLONE 1064681-R
MDTGPPLEVDGIDKLFFFFFYDCKISLFNK

SEQ ID NO: 10336 - DNA, 591 bp, Zea mays
  misc_feature: Ceres CLONE 1064785-R
  misc_feature (216)..(216): n is a, c, t, g, unknown, or other
  misc_feature (220)..(220): n is a, c, t, g, unknown, or other
  misc_feature (221)..(221): n is a, c, t, g, unknown, or other
  misc_feature (256)..(256): n is a, c, t, g, unknown, or other
  misc_feature (268)..(268): n is a, c, t, g, unknown, or other
  misc_feature (291)..(291): n is a, c, t, g, unknown, or other
  misc_feature (344)..(344): n is a, c, t, g, unknown, or other
  misc_feature (345)..(345): n is a, c, t, g, unknown, or other
  misc_feature (370)..(370): n is a, c, t, g, unknown, or other
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (374)..(374): n is a, c, t, g, unknown, or other
  misc_feature (375)..(375): n is a, c, t, g, unknown, or other
  misc_feature (376)..(376): n is a, c, t, g, unknown, or other
  misc_feature (377)..(377): n is a, c, t, g, unknown, or other
  misc_feature (378)..(378): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (432)..(432): n is a, c, t, g, unknown, or other
  misc_feature (433)..(433): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (447)..(447): n is a, c, t, g, unknown, or other
  misc_feature (448)..(448): n is a, c, t, g, unknown, or other
  misc_feature (450)..(450): n is a, c, t, g, unknown, or other
  misc_feature (452)..(452): n is a, c, t, g, unknown, or other
  misc_feature (453)..(453): n is a, c, t, g, unknown, or other
  misc_feature (458)..(458): n is a, c, t, g, unknown, or other
  misc_feature (467)..(467): n is a, c, t, g, unknown, or other
  misc_feature (470)..(470): n is a, c, t, g, unknown, or other
  misc_feature (506)..(506): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (554)..(554): n is a, c, t, g, unknown, or other
  misc_feature (569)..(569): n is a, c, t, g, unknown, or other
ccgattggataccgggccccccctcgaggtcgacggtatcgataagcttttttttttttttttttgaaacttcaattcctcatacactccagcgagcaaacaaacaacatatcgatggtgacaatgacattgtttaacggcacagtgctaaccgttacacagctatgtaattattatgagcctctgagttccatgatcagatagaggtgcaggttngccnntttttcccgcccggctcatttgcgcagcaagtctnctcagtttatcnggtggctgacctcagttcggcangcgatgccaacttcattggccgagtgccctgcatctgctaccaccttgaaatnntctgctttcaggggcccaaaaaaannnnnnnnnnnnnnnnnnnnnnnnnnnnnnnnnnnnnnnnnnnnnnnnnnnnnnnnnnnnnannannnnnnnnnnnannanannaaaanaaaaaaaanaanaaaaaaaaaaaaaaaaaaaaaaaaaaaaaaaaaaanaannnaaaaaaaaaaaaaaaaaaaaaaaaaaaaaaaaannnnaaaaanaaaaaaaaaaaaaanaaaaaaaaaaaaaaaaaaaaaa

SEQ ID NO: 10337 - DNA, 590 bp, Zea mays
  misc_feature: Ceres CLONE 1064953-R
  misc_feature (590)..(590): n is a, c, t, g, unknown, or other
ggtatcgataagcttttttttttttttttttggttttcaagatcgtatgttaatttgtttcaacaaccagatttacctttctgcccactcctatgcatggagtgttctgtaccatgatgatccgttcgaccgtctggttgcctccgtgagaataccatgtgcgcgcacgcgcctcaacggggcaccatggccggtaccatgcgcccgccgggacgaacccacactggctgcgcctggttagcgcccgcactgccagagccgctggactgtgcgttcgcccgctcagggggccgcgcatttgtgcccccatggcccagcagccggacctgtccccgaacctttgtagttataaaccgccccccacgggtggctgtttactacaccgctcggccatacccccctgacgcgccctgccttgaacccccctcctcttagattcccccttcccccccaaacgggcgccaccccctggccccctcctgaccccccacgcatcccccccctcttctctcccccccttccctcttacacccccacatgaacccccgtaacgcggattatcccccccaataccatatgcccccccgtan

SEQ ID NO: 10338 - DNA, 811 bp, Zea mays
  misc_feature: Ceres CLONE 1065083
  misc_feature: Encodes the peptide sequence at SEQ ID NO. 10339
acctcatctctcattcttcaattcgtcacttagcttcactcggttctgcttgtacatctatatatcgttagtttggtatgtactaacggctcgatcacaaggcaaagaaaagaggcaacgacgatggctgctgcggcggcgatgatggtctccggaggacgggcggcgctggcggtggcgggcgtgctctgcgcggtggcggccatggcggcggcgcagcaggcgtcgaacgtgcgggcgacgtaccacctgtacaacccggcgcagaacgggtgggacctgaaccgcgtgagcgcgtactgcgccacgtgggacgccgacaagccgctgtcgtggcggcagaagcacggctggacggccttctgcgggcccgccgggcagaagggccaggccgcctgcggcaagtgcataagggtgaagaaccgtgcgacgggcgcgtccatcgtggcgaggatcgtggaccagtgcagcaacggcggcctggacctggactacgagacggtgttcaagaagatcgacaccaacggccagggctaccagatgggccacctcaacgtcgactaccagttcgtcgcctgctgagcaggagagctcagtcagatccttcctgtgtatgtatgcatccatgcatgcaggcaggcagatgcagagaccgacgtcgttgtaaaacgcgtggccttacttgagatgaataaaacgcaacatgtagcgtcttgcaactgtcgcaagcacagctactactgctactgattaaataaacaggactgcaataatagtaacaaactatttaggccccaaaaaaaaaaaaaaa

SEQ ID NO: 10339 - protein, 152 aa, Zea mays
  misc_feature: Ceres CLONE 1065083
  misc_feature (33)..(152): Pfam Name: Barwin Pfam Description: Barwin family
MAAAAAMMVSGGRAALAVAGVLCAVAAMAAAQQASNVRATYHLYNPAQNGWDLNRVSAYCATWDADKPLSWRQKHGWTAFCGPAGQKGQAACGKCIRVKNRATGASIVARIVDQCSNGGLDLDYETVFKKIDTNGQGYQMGHLNVDYQFVAC

SEQ ID NO: 10340 - DNA, 713 bp, Zea mays
  misc_feature: Ceres CLONE 1065893
  misc_feature: Encodes the peptide sequence at SEQ ID NO. 10341
attcatcaagccggccctagaatggttaaaccctagtagagagaaaggaagagaagggggcggagaagcacgtacgtcgtacatcgcccaccgccctttgcctcgcctcgcctcgcctcgcctgcatatctaacagccggagccggagccggagccggagccgacgccggcgccgacaatcgttccaactgatatggctacgacgccaccaggattcacgggcaacctgaaggtgagttattgaaagatccccatccgccaacgcacggttcaggccacactttgccagttccggcgcactgctaggacggcatcgacacatcaacaccacccatggctaccgttcctatccccaagcgtcgtcgcaggtccctgcccaggcgcgttgcgtctccatcccagggcttccgccactcgagaaactctttgctactgcgcccccatccgctcccttcaatcgggggcatgaatcatttgccgccgagctgtgctgatccgggggcccgacgtctgtggcactcagtcctcctatttgcgcttagtagtaggttcagttctctgcagacaatagctgaaacactactgtacatggatcttgggttaatttgactgcgaatgttatgattttattcggcatcagttgattggattgattgtagcttgaacctttgatcctgattatccaccattttatcccaaaaaaaaaaaaaaaa

SEQ ID NO: 10341 - protein, 91 aa, Zea mays
  misc_feature: Ceres CLONE 1065893
MATVPIPKRRRRSLPRRVASPSQGFRHSRNSLLLRPHPLPSIGGMNHLPPSCADPGARRLWHSVLLFALSSRFSSLQTIAETLLYMDLGLI

SEQ ID NO: 10342 - DNA, 857 bp, Zea mays
  misc_feature: Ceres CLONE 1065917
  misc_feature: Encodes the peptide sequence at SEQ ID NO. 10343
actactacagttcttaactcctacctaggagaagagaacatctcgttctagatccactcagctttttataagaactttttgttcattggagcctgtgctgcttgtggaggtacagtgctgatggcgtccaactacgtcgacaccggggcggaggagggcaggttccacggccacggccaccaccaccaccacagcacgacgccgaccagcgcggcggcgtcgcccaagacgctgcggaggagctcgtcgtccgcccacagccacggccacgcgcccaagtgcgtgtgcgcgccggccacgcacgcaggctccttcaagtgccgcctccaccgcagcagctcccacggccacggccacggccacggcagcaacccggcgtcccctccctccccggccaccttcgccgccgcgccgccgccggccgcggccgcgtcctcctcccgcaccgtcgcggcgcagtgacggcgccccaagaaacgccgacccagcagcagtgaagagaggagaagagaagagagaaacggcaaaaggggaaaaaaaaggaaaacacactctctgttattatgcgacacgagaaagggagcttatttgttcctcccttcatcttcacgtacgccaacggcagaatttcccaatttctttcacttcctcctcgccctcgtctttacccttttttcagtttttggctgggatccatcgattctcgctggaatggccttccctccttcggtcagaagaaaccctccctggttgtacgtactgtactaggcaatgcgcatcctgctcgcctcctccgctgaaatggaaagcgtatgtgtgatggtgacatgaagttcactaaaaaaaaaaaaaaaaaa

SEQ ID NO: 10343 - protein, 113 aa, Zea mays
  misc_feature: Ceres CLONE 1065917
MASNYVDTGAEEGRFHGHGHHHHHSTTPTSAAASPKTLRRSSSSAHSHGHAPKCVCAPATHAGSFKCRLHRSSSHGHGHGHGSNPASPPSPATFAAAPPPAAAASSSRTVAAQ

SEQ ID NO: 10344 - DNA, 838 bp, Zea mays
  misc_feature: Ceres CLONE 1145708-R
  misc_feature (838)..(838): n is a, c, t, g, unknown, or other
agactcgcatatatatattcagaagcttcagagttaaattggttaaacccaaagagaatattatacaaaaaaatttggaatatataatacaagaagctgaaccttattagcaaagcatattttgcccggtaacaaaaagaaaacagatcttcccatctatggtatatttgtggcctcagcttttttcagcttctgagcttgcttctataataattgacctgttaaaatccattcaaaatcaacataaacacattaattcgaccgaacaaccaaacaggcctaatgggtttcgtattcctaatttcatcccttctgccaagcttcatcggtgttttgcttgctgtatcaaatttttttgtcacagattgtattgcttcagctcaatagtgatcaataacattcataaccatggagtactgaaacgaactatatcgcacaagttggataagctctgattgtgcctagtatctactaagtgtgcttgagcagttcactgtccagtgaccaggaaatgaagctgaagaccatagccattttgtaccaacgatttatacagagcagcccacattaacacatcgtataaatatttcactgtccactgaccaggaaaagaaagttgaagacgaaagccatttcatactgacaaagtatacctagcaggcgaccttcaaacatcttacaaaaactcctcatgtaggaacccaaatattcacaagaataccgacccaggcttttataagaaaaaaaaaaatcaaactccaacccaaaatggaaagtcaggccacactttcttggggaggtcaagaaaaaataaggcccaacccaaaggggcacatan

SEQ ID NO: 10345 - DNA, 859 bp, Zea mays
  misc_feature: Ceres CLONE 1146113-R
  misc_feature (28)..(28): n is a, c, t, g, unknown, or other
caattgggtaccgggccccccctcgagnttttttttttttttttttctttttttttttttttttttttttttttttttaacgcgcgcaatatgccagttatgattttatattttaggcctccgccattgttcggggggggggttactggttaccctattttactgagactcaagatatccctgaaaagaaaggactcctctggatttaaataactggaatcggcatgccaaaatcttcatccctgacgagacagccacacaaaaactgtacttgtttgtcaggggtaatatactggtccatcaggggagaggttgggttttccctctgcgtgcgccctgatggtcgagctgtctaattgcttgggcagggaaaaatgcgccatctacttgtttgggcaatccgatgcacggggaccggattctccgcagttgaaaaagcgccactgaagcttctgctgctctctctaccgcccaaggatgatgaccggacaccgaaggatggtgatggggagccacggctcccgtaggatgatgatcggccaccaaaggatgaggaggaacggtttgattttctcccaccgcctgaccagtcatcatctgaccaactatcgttgtcagacctcaagctcctgtcaccacgccggtatcggtcctcactgtcgatgtccaaaccaccccggcctcttgaagcgcctcacccctgagacgcctgttcctgaaaactcgggtcgtttgaaaagcgaccatatgttatcgtagcaggactatcttcttgcaacgcaggaagtttcaaatttggattaatgggtttcccgggggaactccatagccagcaggccctttgaatttcctcaggaaa

SEQ ID NO: 10346 - DNA, 698 bp, Zea mays
  misc_feature: Ceres CLONE 1146238-R
  misc_feature: Pfam Name: Ribosomal_S21e Pfam Description: Ribosomal protein S21e
gcgaaccccgcacgctgcgccgaaccggcacccatggggggaggggggttttgtataggagatactagatcttcagatttattttacagctgaaatcacaacattgcatatagtgacatgaattcaaaacatagctaaggcagtgtccaattcttggtaaactagatgtaaaatctactgcttgatatcagccttcttcttctgccacagcctgtccaaggagctgtctgcgtcgccctgagcacggacaaacccagagagagcaaacgttgtgaagtgaccatcatacaggccattcgcatccaagtggccaatgttgatctggacataggcatggaccttggcagtgatgatcctgtttgtggccgagcacttcctggggacatagaggtccacagtcttaccctcctcgttctgcatggtgacaggtggcggaactaccacaagatcatcttgcaagaaaccgaccacgctggaagcggagtcccgcatcagaagacggcccgggagtcggaaccgcggcgagggggaaagagacacgacaaacgaagcaccagtttccctcagcagagcgcagacaccggagggagatgcgcactacacactcacacgcggccagaccacccaacacggatgatcccccagccccggcgcgtccccgctgtatcaggacgcacgacgacataccagacgtcccc

SEQ ID NO: 10347 - DNA, 826 bp, Zea mays
  misc_feature: Ceres CLONE 1146707-R
  misc_feature: Pfam Name: DUF1034 Pfam Description: Domain of Unknown Function (DUF1034)
  misc_feature (643)..(643): n is a, c, t, g, unknown, or other
tcagtttttttttcctcttttttcttttttttttttttttttttcccctcccccaccattctggttgcacaaggatttcccattctggatatctggaagtatcccccctttaccgctactggctaatcactcagctacttacatcaacatgtttcaaaatgtacacccctcaaccaacaaaaaatttctctagtcaaagggaagctccacctccatggagtcaagtcatcactgcatacgctggatcagtcaggccttggtttgcatttgcattgcatccactgcatcagctccgctcatcagtcatcaggaactgtatacaaccttggagatcaccgaaaatggcattatccccccccggcctttgttaccctggaacccaacgttcccgaagctcccagcgcagctgtttatggcgccgttcacaacaaaggtcacgagctgcttctgtccccttggaatgaaaaattgcgtcggaaccacggaaactgcacttccattacccccactgtaattgaaagagtagttctcgtccccccccaccttgatcaccgttctcgttatgcctcttgtttgggtaaccccggatatgccgcccgacgctaggttaaaatccgtccccgccccgcccaacaccccgcantttatcccccgcaataattcaacaagcgggttcccccccacatccccgcagcaaaagcgtccccccccccacaccctcataaaaaattacccccccccccaaaagagcacctcccctccaccgccgacccacgccagaaaatatcccccaccacccccccctaagccacccccaccccccccg

SEQ ID NO: 10348 - DNA, 852 bp, Zea mays
  misc_feature: Ceres CLONE 1147159-R
  misc_feature (23)..(23): n is a, c, t, g, unknown, or other
  misc_feature (730)..(730): n is a, c, t, g, unknown, or other
  misc_feature (797)..(797): n is a, c, t, g, unknown, or other
  misc_feature (827)..(827): n is a, c, t, g, unknown, or other
ggggaccgggccccccctcgagnttttttttttttttttttttttttttttttttttttttttttccataacaatcccacttttcttatttataaatcggggcattttggggaaaattcttcaattacaaaaggctttttcataaaacgggaaaggcaacaaggacttcgggattctcttgaacaatcgatcttcacaccgaagcttaaaaacgccctaacagaagtatgttacaaaacaggttttttcgggcacaagtatttgaaaatacaaggaacaaatcggcgacggtatacagggagggaaaccagcagtataaacccgcaaagaaggggagacgaaaaaaaaatacaaatttatacttgcgcgaaaaatccacacggcccaaatcgacctcactgcgctttcatggctctctctttgcatagctggggccactcctgaagcacggcagcctgaaaagcgcggggctcaccctcctccgcggggagcttgaaaagcgtcaagggccccttggggtttccaaacccatcaagtccctcgctcggctttcgcccctcttccccctcttgatcggcctttgcggggggaacctttggcctggctgccttgagcaggccaatcctctccagggagatcttcagttgctcggaagccacactcttcacctcatcctcaggcatgaattccacagcgccgtcggtgatatcatccagccagccctgaaggncggatttgatctctctcgtgaggaattcatcggatgcgcgaatgacaaattggcagatcattgtggnggctctcatcacccaaatcaacattccggntgacttcacttgccccaaatatcat

SEQ ID NO: 10349 - DNA, 765 bp, Zea mays
  misc_feature: Ceres CLONE 1154155-R
cgattgggtaccgggccccccctcgagtttttttttttttttttttctttttttttttttttttttttgtttaatttaatcccttttaattgtttttttatttttttggttgtcaaggattttcccatttttggatatttggtattattttctttttacagaaaccggcccaccacacagggtatttacatcaacgtgggtcaaaagggaccccccccaaccaaaaaaaaatttctctattcaaagggaaggtccgcctccatgcagtcaagtcatcactgcatacgctggaaaaggcaggccctggattgaaaaaaaattgcatccactggaacagctccccctcctcaggcatcaggaactgtatacaaccttggagaacaccgagaatgggattatcgcccggggggctttggtaccctggaacccaacgttcccgaagctcgaaggggaactgcttatggaggcgctcaaaaaaaggttaccagccgggtctgttcgtttggaaagaaaaaatgcgtccgcaccacggaaactggagtttcattagggggactgaaaaaaaaagaaaaactctcgtcatccgccacgttgaaaaaaaatctcggtatggcccctgaaatgggtgacaccgctatggcgattgaaggaaagaatatatctgctcccgccacggcggaagccacccacctgttgacagtgttatttttcacgaccgggctatacccatttatggcggcaaaaaaagacaacaccacctcaaag

SEQ ID NO: 10350 - DNA, 406 bp, Zea mays
  misc_feature: Ceres CLONE 1154174-R
tcgaggtgctgcatggtgatcgcaagcctccgagtgtatttcttccatagctcctgtccttcggcgacggatatgcatatttggagaatgcctgaggggctgcggtggtagagctccttttcatcacccagtaagacgaacgacttggcgcgccatgccagtcgccgagcttcggccttgtcgaggggtagctctcctcggaggagatattctaggtacggggcctgccagttcgggttaggcgtgaccccatttcgctctccctcgacacgcagggcctcaccctcggcggccgaggatacctcgggctgggccaaggcctcctcgggctcgggcgtgtcgttgaccttgacagagggttgatgtatgtctctagagaagacgtccggaggaactgttgtccgcc

SEQ ID NO: 10351 - DNA, 862 bp, Zea mays
  misc_feature: Ceres CLONE 1154236-R
  misc_feature (7)..(7): n is a, c, t, g, unknown, or other
  misc_feature (8)..(8): n is a, c, t, g, unknown, or other
  misc_feature (84)..(84): n is a, c, t, g, unknown, or other
  misc_feature (664)..(664): n is a, c, t, g, unknown, or other
  misc_feature (769)..(769): n is a, c, t, g, unknown, or other
atctatnnttttttttgttttttgccaccccccccccccacccatataaatgaagcaacaacccgcaaagtaactactttttanccgaaatggggacggggccccccctcgaggtcgacggtatcgataattttttttttttttttgtacgaatatactccattaatctttcacttttacacacaatcacccaatatgtaaactagacacccccgaccaaacaaataacaaaaagtaagaggagttgttgaatcacccccaaacaaatcaagaaaaaagaaaccgagatgaattgctacaaagatacaaattcaataaaggcttagaaacatccacacgttggcctttggtactacaccagtggatcgaaacttaacaacccatttcaccccgctttggagaaacgcttctccctttcttaagcttccccccatatgatccacatccccctctggctaacttgaggcatcgccaccctacctatgaaacgtccaattttccgccaacggaaattggggcttgtttcccctcctcccactatcttccttcgaatctttccctaagctgggagggtatgaaaaaaccggcctctccctggctcatgtggccccccggcctggtgtaaccccaaagggaccgcaagcttcttgcccccgggccgctnagagcctttccgaattaggcaacaataaactctccgcacggcctctttatgagaaagggacggaaaaaccctttcacaggtttcgcctccccctgggcgcacgtngaccccgccatcttcgtacctcggcccaccaaccgcaacctcccgaccgatttctcctcaagacagataaagagcctcctatacattggaaca

SEQ ID NO: 10352 - DNA, 892 bp, Zea mays
  misc_feature: Ceres CLONE 1154246-R
ttttatttttttttttctttattgcaacacccacaccgcacaaataataagatagaggccacaggaaattcccattaagttaatcgatatggtaccgggccccccctcgaggtcgacggtatcgataagcttttttttttttttttttaatgtctggaaaaattcaataagaaaatcaccataaaacataatagctcagctctatcccgaaacttaacctaccatcctcaacagcagcagcttaccttccagtgaatgcctcctttccaaagaacaaaaaaaccaccaagccatcaacacctggcacctacctcttcctttagcacacaaagtccagggaaaggaaattttatcgtcaaacaaaacctccccactatggcctacaccaaaaagtctacgaagccaaaaaccacaagttcttcaaagaaacccggctccccaacctattttaaagggaccacctttccccgttcccgcacattaaccctcccctcccaacaccaaaaaacacaaacccacccccttaaaaaatagaccttttccccagctcttgtaactccccccactaggacctgaaacgttagaacgcctaccacggctcatagaaccacatcctgtatatggacccaccgcataaatcaaatgaaaatccaataagacacccggattcacccgaaccacccagcaaccatattctaccacctaaaggaaagtgtcataatgtataataagaacccgcagcgagcacaattgtccaccccaccccctgggcgaaactcaccatgactaccaaaaacgacggcgcgcgaaccacccccgcggtgccccacccacaccaatttgggcccgcccctaaccaggaacgacaacacatcaccccaacacacaccaa

SEQ ID NO: 10353 - DNA, 1024 bp, Zea mays
  misc_feature: Ceres CLONE 1154790-R
  misc_feature (691)..(691): n is a, c, t, g, unknown, or other
gggtaccgggccccccctcgagttttttttttttttttttttgagaaacataatcgtaaagttattacatcccacatagtttaggttcttactctcacaactgccagcaacaaaagactagatcaaacgtcacgaacttctctcccttttagcaacaagaaccaagaagaagaagaagccaccataatgaccatgttcaccagaaggactcatcttcatcatcggagatttcttcctcatcatcggagatatcttcggcgaaaggaacaccatatgtctgctgaacccactgatcccgagtggctggcataggcggcggaggattgtatggtggagcaagacgcagagtacacgaccgagctaacagctaatgttgtccgactctaagagaaggttcataagagtgtgattagaaaggggcaaagactcctaaggaggatgagggaacacagaacataaacttttgagaacggattacgcatagattccattttaaaccctcttgaagaaggcggatgtgacgacattgtgggggtgtggcatgcaccgaaagagagaggttatatggagggagcatatggcggggtgtagagtccagatcacgactatctgtgaatgtgaagagaatgtagacacggattaggggatacctgccttcaggtgtgtgggcggcggcgtggggtggtagcgngcggggtgcagacggagtattattgaacggggtggtgcgtagagggtgagagcgactagtttcactttctttcgcgcgacgtctcattatgcaaggtggcacgatcaacgtacggcatgtaggtttggggttgggcgcgtgggtgtgatgacgtacgcgatgcttctggacaacgatgtcgcgaattttaattgttcagttatatggccggaggggataatcgaagccgatggcgtgatacgccggaatattgcaggttgagtcgcgcacgattatttaggagggtggcagcgggagttggacactggagagtgagtccaagctcccacgcgg

SEQ ID NO: 10354 - DNA, 1801 bp, Zea mays
  misc_feature: Ceres CLONE 1155585
  misc_feature: Encodes the peptide sequence at SEQ ID NO. 10355
attccactagaacactaccaccacctccacctcgtcgtctcccaccaccgccgcgcgcgagccctagcccgatctagccggcggcaggcactagatcccgccgcttgcggcatcccgggacgcgcctcgccgaattcgccgctccccgcactgcaacacgcccggaccactgttactgcatgccatgtagtattttattattggtggaggttgtcaccacaagacatatgttgtgatttctcgatggcgaggagatgaaacaggtgtgggggcggagcagcaaggacatgacaaccatgccccctccgcgccaccgtggcgctgctaagaagcccatgtggatcatagtgctattgtcgttgatttgtgttgcccttatgggggcctatgtctacccaccacggcactactctgcatgctacttctttgcttcgagtgtctgtaccccgttcaaggattggctacctgctgttgttcgggagcgaactgatgaagagatagtgtcatccgtggttattaggaatctcctttcgatgcctatggctgtgtcgaagaacccaaagattgcctttatgttcttgacaccaggttcattgccttttgagaagttgtgggaggaatttttacagggtcatgatggtcgatattccatctatatccatgcatctcgtgaaatacctgtacattctagctccctctttgttggacgtgaaattcgcagtgaaaaggtagtatgggggaggatttcgatggttgatgcagagaagaggctgttagcaaatgcattggaagatgtcgataatcaattttttgtcttgctttctgacagctgtgttccagtacatacatttgattacatatataattatctgatgggaacaaatgtcagcttcattgattgcttcctggatcctggcccacatggaactggaaggtattccatggaaatgcttcctgaaatagaacagagggacttcaggaagggtgcccagtggtttgctataacacgaaggcatgctttattgattctggctgacaacctttactacaataagttcaagctgtactgcaagccagcagaggaacgcaactgtattgctgatgagcattatttgccaaccttcttcaatatggtcgatcctggtggaatagctaactggtcagtgactcatgttgattggtccgagggaaaatggcatccaaggtcatatagagctgcagatgttacctatgaactcttaaagaacataacgtctgtcaatgagaatttccgcattacaagtgatgataagaaagttgtgacacggatcccatgtatgtggaatggaacaaaaaggccatgctacctttttgctagaaagttctacccagaatctctgaacaacttgctgaagctattttccagttacacatcggcttgattcgacatttttttgttcatttggcctaggagattcccctagttttttttctgcttcatgtaaattgtgaaattgatacttagaggcttaacacagagttacgggtacagggccagtgatgtaattctgtgagtcccttggtagggctgaggtgctgtttgtttagtattgacctgccctccctgtcgttcttggtgccgtctgttaggttcctagcgcccattccctgagtaacagggtttttgtcagttattactgattaattytttgtagacatgaagagattwsgaaatcagtttcccttcmtwgttttaaaaaaaaaaaaaaaaaaaaaaaaaaaaaaaaaaaaaaaaaaaaaaaaaaaaaaaaaaaaaaaaaaa

SEQ ID NO: 10355 - protein, 388 aa, Zea mays
  misc_feature: Ceres CLONE 1155585
  misc_feature (74)..(379): Pfam Name: DUF266 Pfam Description: Arabidopsis protein of unknown function, DUF266
MKQVWGRSSKDMTTMPPPRHRGAAKKPMWIIVLLSLICVALMGAYVYPPRHYSACYFFASSVCTPFKDWLPAVVRERTDEEIVSSVVIRNLLSMPMAVSKNPKIAFMFLTPGSLPFEKLWEEFLQGHDGRYSIYIHASREIPVHSSSLFVGREIRSEKVVWGRISMVDAEKRLLANALEDVDNQFFVLLSDSCVPVHTFDYIYNYLMGTNVSFIDCFLDPGPHGTGRYSMEMLPEIEQRDFRKGAQWFAITRRHALLILADNLYYNKFKLYCKPAEERNCIADEHYLPTFFNMVDPGGIANWSVTHVDWSEGKWHPRSYRAADVTYELLKNITSVNENFRITSDDKKVVTRIPCMWNGTKRPCYLFARKFYPESLNNLLKLFSSYTSA

SEQ ID NO: 10356 - DNA, 912 bp, Zea mays
  misc_feature: Ceres CLONE 1155604-R
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (13)..(13): n is a, c, t, g, unknown, or other
  misc_feature (14)..(14): n is a, c, t, g, unknown, or other
  misc_feature (17)..(17): n is a, c, t, g, unknown, or other
  misc_feature (18)..(18): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
ttttgnnnngtgnngcnnaaatataatataataagaaattaactatttgttgtggttagggttgttgatgttaataannnttttgtattttgttttttgcaattgggtaccgggccccccctcaagttagccccgcgcgtgacccaacagtgccaattaaggacagcgatcacgggtcagtcagccgcggggataggcacgatagttgctatggccaaaagtgggctggcagtaattgcagcggcagacgagcagaagcagcggtcaaatcgcctgcaggactcgcgtcccctcctgaagcggcaagagagccctctcccacggcgtaaagacgacgcacccgtgctccattcctcaaatgactcgcgcatgcacaacggccgccccgcgaatcgcccgtcccgtcgcattaactccctggcagggcaagcgacacctctggcaggcgaggcgggcgacttttcacctccggccatgacaaccagcgtcaaaaaaaggtgcgccctcattattgtaaaattcatatccatcttcctccttccctctctttgcctacacgggaactgggggaaagggggaataaaatttcgggaaaagggaaccctttcccttcgggccgataagggaatgccggggacccccccgaaagcccccttcccttaacctgaaatccagggggggttttacgaaaaagggcctaagccccccacttcaaataaggggatttttcacaaacaatccccgcacccccctaagtaagaccaacttacggggggcctaaccgcctgctccaccttttttacctcggaaattcaagaaaagaggtttacaaataagaggacataaagacccccccccttccatgaaaatagggagagtttaccagaaccaaggcccgcgacgccgctcgag

SEQ ID NO: 10357 - DNA, 767 bp, Zea mays
  misc_feature: Ceres CLONE 1155680-R
  misc_feature (20)..(20): n is a, c, t, g, unknown, or other
  misc_feature (21)..(21): n is a, c, t, g, unknown, or other
  misc_feature (50)..(50): n is a, c, t, g, unknown, or other
  misc_feature (62)..(62): n is a, c, t, g, unknown, or other
attatatttgaagaaagggnnacaaacaaccctaaaacaacacacccccnggccctcccccnaaaaaagtacgcattgtatccggaacgagcgatactaactttacaagcaaccggcgtgtgtccatgctgccgtcgggtctggttcaaccaaccgtcccatcacccacccacgtaatctaacgcaacgaccaccgtacggagactcgaccacacatggcctagagtcctcctgcttgttttgttgctgatcctaaactaaaaagctacttctgcaggggcaacgccccagttcaacaggcatcgcctgagcagcgcaacagctgccaccaaaaccaccagtgggggccaaaccaaaactgagtgcgacaaaccaaaagcacatcagatccccgcagcaacgacggctcagctggtgagcgacgacagcatgccgccgccactcttggacggtaccatcacctcccaggccggacctttcagcggcacaagaggggggacgtgcggttagcgtccccaggggggcgggcccaagaaggacgcttccggtccatcagccctcctggaggggcctccgtcgcctgattgtcagacctggaaggatcactggccctccctcggaaccggctccaaccctttggaaaaagccgccgaggggaacatcaacctttattctaaaaagcacaactcggggtcaaacatacgtggtcgtgggaacccaaaaatggggccctttataagccaaaacaaaaccaagagggggtgcag

SEQ ID NO: 10358 - DNA, 846 bp, Zea mays
  misc_feature: Ceres CLONE 1155953-R
  misc_feature: Encodes the peptide sequence at SEQ ID NO. 10359
  misc_feature (326)..(326): n is a, c, t, g, unknown, or other
  misc_feature (846)..(846): n is a, c, t, g, unknown, or other
ttgggtaccgggccccccctcgagtctaaggcaagttatgcccttgatcactcttctttacctaataatgttcttcttaatcactatgacatgctcaggttaatttgatgggacctaataggtttccctagatttgtttatcccacatcttgtttaccactggacttttgggtagttttgctattgctctacctggttttagaattaatattatattatgatcatgttccagttatgctgttgttttaattattgttcatgacaaggtcattgtgttaattggaacatggagcttaacttgagatatatgtgctaagacaagggtnggaatgggacgccctgtggctgactaattagaaaaagctagttagaaggactaccctttacccaaaaagggggcaaggggctagtaagaaggaagctgccgaatttagggggaggtttcttcgggggtcgaatccatgcttgcgaatgggcttttttcgggaaggaaggggatttccctaaatttggccccttttctaaaaaaaaccggtaaccggggttttcccctggaaagcttaggtgggaaacttttttgtaaaaagggacctccgttagtgggcttacccctggtccttttgcccttttttctcgggaaaaaagggtggttttggggggggttcctctaaaacaaacctccccattaaacacaaccctgggggggaaaaacactaaacctcttatggggggggtgtaaaagaggggcgcgccacaacacctcttttttggttagagaaagggtgtaaaaaacacacgggcggtgataatatattctcaacgcccctggcgggtaattttattacn

SEQ ID NO: 10359 - protein, 35 aa, Zea mays
  misc_feature: Ceres CLONE 1155953-R
LGTGPPLESKASYALDHSSLPNNVLLNHYDMLRLI

SEQ ID NO: 10360 - DNA, 649 bp, Zea mays
  misc_feature: Ceres CLONE 1156229-R
  misc_feature: Pfam Name: PB1 Pfam Description: PB1 domain
  misc_feature (618)..(618): n is a, c, t, g, unknown, or other
tgttaaaaccttcatggcatcgtttcgtttcaaccgtgcgaagagtatgacactttattcctttcctacactcgccatttgtacattccatacgacgacatggcgtgaacatggacaaggaacctctatggcgacaacaggatactgggcctactacaacaggctacgggcggtaacctaggcttctgttctgttacgagctatgcgcttccacctgcaagcagctgctgctgctgcccgagctgcccacgtggcaggagaggtcgcgcacctgcagcttcatgttacgcgagctgatcgagtccaggacgtccatgcactcctggaggtcggcgtcgttcgccaggatcacccactcgtcctcatcgtccttgtatttgagctggaatgctccagccgtcagcttgaacctctttgctatctcttccagcaagtggtaccagccccttgctggcacaaacttgaaccggacggtgtcaccattggtaggtagctttcacagtcagtgcagggctgcttcggtctttgagggcacggcctgggttccccttgaaagtaggctcgcttgaggcgctaccgcttcgagaatcggtcatgccaaagggggaaagggagggnccgctcctttggggcctgcccaccgaccaaa

SEQ ID NO: 10361 - DNA, 1872 bp, Zea mays
  misc_feature: Ceres CLONE 1156319
  misc_feature: Encodes the peptide sequence at SEQ ID NO. 10362
tgctgccccgcgccgaagcaggtgtggcggcgctgcgagcctgcaaccatctccgcagactccgctgcgactcatctgggctacgacccacgtcaaggctgctagttgcgttcgttggagttgcggcttccgcgaatcccccaatccatcccagtcatggcgttctggggggtggaagtgaagcccgggaagccctacacccacatccatcacgctgaccatggccgcctccgcatttgccaggctacactgggcaactgtgatgctgctgcaaggacggtgctgcaatgcaatgttggcaacaagattcccatcaaactttgtagtctaaatccgaaattggccgagacatgccatctagaggttgagtttgaggaggttgatgatgttatcttctcagtaattggtcatagttcgatacatctctctggatactatgtctgtgcaagcaacaggtctaatgtgggggatgatgaatcagaatcttatggggaagatattgggcactccagcaccgatgaggagcatgataccagtgaggacagctatgaatctgacttcattgatgatcgtgaagttccattatctgagaagtatgggtctggttctatagatgacagtgatgatgagtgcacccaacgatgccacagacaaaaagctgaaaaaacgactcaaaatgctgaaagacggcggcgcttgaagaagcaccaagtaggtagcactgattacgatgatgatgatactccagtcatgaaacatgttgcgaagcgctgtgctcctaaaatatctgatagtggtgatgatgacactcctgtcacaaaacctgttgtcaaacgtagagcttcaatatttgatagtgacagtgatgaagatgataatgtacctatttctcttgcattgggtaagaaaggcaatgctaaggttgctgaggaaactgaacatcaaaatggacaggcaaatggcatcaccaaaaaaaggattattgatgtcaagaaaagaaaacagtcttccatcagcgaggatcctgcatcgtcaatggatatgacagatgctaatgcaccatctgtttcaaaacaagttgatgaaataaaaaagaaatcaaagaaaaagatgagaaatcaatcaggggaaaataatgagaagcagtccaatataagaacattggatgacgggttggtggttgaatatttgtcaatgggaaacaatgatgcaaaagtggcttctgatggctgcaaggtctatatcaaatatgttggcatgttgaaggatgggaaaattgttgagtctaatgttagtgaaaagccttacaagttcaagcttggtgctggaaaagttatccgtggatgggatgttggtattcatggtatgcgtgttggcgagaaaagaaagcttacagttccaccttcaatgctctctggcggtaaatcagtgggagaagtacccgaaaattcttcagtcatatatgaaatcgagttagtgaaagtgaaataaagaaaaaatatgtcaggcttttgcatgtgccctatctcagcagctgcaacagttgcaggaattttgttgatatacagatgactcatgctcatgttttgcttccttctggaagaatttatatgtgccactcgtgccacaccataggacatcgagcagtgaactgcagcgggtgctttatccatgcatgccttgagtggatacttggttttgcactatctggctacattactttgtaaactgcatacgatggttgaagcactattgtggtctggtgatttgccatatgtttgtgactacttcgcggttcactgcttggaatcatgtttgttttcccaaaaaaaaaaaaaaaaaaaaaaaaaaaaaaaaaaaaaaaaaaaaaaa

SEQ ID NO: 10362 - protein, 444 aa, Zea mays
  misc_feature: Ceres CLONE 1156319
  misc_feature (350)..(441): Pfam Name: FKBP_C Pfam Description: FKBP-type peptidyl-prolyl cis-trans isomerase
  misc_feature: SWISSPROT Homolog: EC 5.2.1.8 Peptidylprolyl isomerase
MAFWGVEVKPGKPYTHIHHADHGRLRICQATLGNCDAAARTVLQCNVGNKIPIKLCSLNPKLAETCHLEVEFEEVDDVIFSVIGHSSIHLSGYYVCASNRSNVGDDESESYGEDIGHSSTDEEHDTSEDSYESDFIDDREVPLSEKYGSGSIDDSDDECTQRCHRQKAEKTTQNAERRRRLKKHQVGSTDYDDDDTPVMKHVAKRCAPKISDSGDDDTPVTKPVVKRRASIFDSDSDEDDNVPISLALGKKGNAKVAEETEHQNGQANGITKKRIIDVKKRKQSSISEDPASSMDMTDANAPSVSKQVDEIKKKSKKKMRNQSGENNEKQSNIRTLDDGLVVEYLSMGNNDAKVASDGCKVYIKYVGMLKDGKIVESNVSEKPYKFKLGAGKVIRGWDVGIHGMRVGEKRKLTVPPSMLSGGKSVGEVPENSSVIYEIELVKVK

SEQ ID NO: 10363 - DNA, 842 bp, Zea mays
  misc_feature: Ceres CLONE 1156532-R2
  misc_feature: Pfam Name: Alpha_adaptin_C Pfam Description: Alpha adaptin AP2, C-terminal domain
  misc_feature (806)..(806): n is a, c, t, g, unknown, or other
ccgattgggtaccgggccccccctcgagtttttttttttttttttttgggaaaacctagcaccttatattaacacacaaaaactaccgattgtccaccaccatacatggggcgatacaggttatacaaatgggccaaaaggggatgatgataataatgagaaacaacaagttacgcttacacaatacggcaactgctacatggagagggagggggccttgaaaccgcacaaaaagaatctaagctctttctcggtttagaatcctcatggagactacactccgccagctctttcttggttcttccacgtgtacgtcttggcagcaagatgcttgtggagatgttagatcctcgtattaaataacagggtcattgtatgtggcaggtgctgtagtaggcaactgtggctggactgctgcgcgaggtggagcgacctgagtccttgggatatcaaccagatgttccttgatgaactctttcaactcgaatgtcaaatattggtcgcccgaggcaactgttagccgcagttgggtcctgtcttgtggatctgtttcaactcgtatcagacaaagcatggcacgtgttgcttcagaaaagaatgtcgtgcatgcaaccagattgttcgggttgttatcaagtccaggagcgaccgccaagtgaaggctcatgaaaagattagccatctcagaaagaggcatgggtttcacacctttaaccacttcttgaaccttcagcgaatgaacagtaagcgctttccactgggagaaaaattcttcaggggtaagaagtatagtctgcaaaaatttnattcatacacagggagtcgaagtttggcatccacca

SEQ ID NO: 10364 - DNA, 1001 bp, Zea mays
  misc_feature: Ceres CLONE 1156532-R
  misc_feature (46)..(46): n is a, c, t, g, unknown, or other
  misc_feature (48)..(48): n is a, c, t, g, unknown, or other
atattttaatatatttatacagaagaccccccccacactcaaaccntntttgaactagcacctttattacacacaaaaactaccgtattgtccaccaccatacatggggcgatacaggttatacaaatgggccaaaaggggatgatgataataatgagaaacaacaagttacgcttacacaatacggcaactgctacatggagagggagggggccttgaaaccgcacaaaaagaatctaagctctttctcggtttagaatcctcatggagactacactccgccagctctttcttggttcttccacgtgtacgtcttggcagcaagatgcttgtggagatgttagatcctcgtattaaataacagggccattgtatgtggcaggtgctgtactaggcaactgtggctggactgctgcgcgaggcggagcgacctgagctccttggcatatcaaccagatgttccttgatgaactctttcaactcgaatgtcaaatattggtcgcccgaggcaactgtttagccgcagttgggtcctgtccttgtggatctgtttcaactcgtatcacacaaaccatggcacgtgttgcttcataaaagaatgtcgtgcatgcaaccagattgttcgggttgttatcaagccccgtatcgaccgccaagtgaaggcccatgaaaagattacccctctcataaagtggcatgggtttcacaacctttaaccactttcttgaaacctccggcgaatgaaacagtaaatccctcttcattgtgaaaaatatatcttccgcctttacgacctacagcctgtcaaaaatctattctataccaccgcgttatcccatattttggctttcaccactggtaattccccatatgccttatcaaaaattctagaactcctctacatcttcttacttgtaaaggggcatttctacaccctcatagggaaatctttgcatcttccgctctcttggtgggcaatatatattccgctaatcgagacg

SEQ ID NO: 10365 - DNA, 934 bp, Zea mays
  misc_feature: Ceres CLONE 1156623-R
ctgtcatcctgcgggggaggtctaatctcacatacagagtcatcatactcttgccacactgacaagatcaccaaaattaaaatccgcaacaaatccaaaaccactcctcatttcatctgaaacatgttctccacaccacatggatctactatgaaagcaaataaaactaatgtttctgcatcactctgcttatgaaattgcctaatccaacaaccaaaaaaggatgtctgcctcaataaattatgcgggcgaacacaggagtatataccgtcaacaactgatctccccttcctccttgtctacatccatcataggtgatacgctgtccaccatctcatgatctgtctcttctttcttcatgtcaatgactgtgtttgttgatccgctgacctccatttcatgtcctgccactccctgtacgtcattctttgagccaatgacagtcactcttgatgcactggcctgcatttcatgacctaatgcctcctgtaaaacgttccagatgtcaacatccatcgatgctgacactctgacccccatttgctgatctacctcatccctcgaaaccttcctacatgaacagcccgagcctctccaatgaactccctaaacccggtcgaaagtcctcccacctgataaaatgcacaattacttttgccaaaagagcttcgcctgacatgccatgctgaaattccccccctcctttacgaagtacctgccagccatatcaaaagcctttgttctcatgagtaagggcatgcttgctgcccccctttcccggtttcccttacaccccatttcgtcctcaaactttcgtcgtgcagctccccaaccattccttcccacgggccttcatacctcgtttacctgggctgcgagccctttttccgccctctccttttccattgtcaattcccaggttttataattctac

SEQ ID NO: 10366 - DNA, 844 bp, Zea mays
  misc_feature: Ceres CLONE 1156678-R
  misc_feature: Encodes the peptide sequence at SEQ ID NO. 10367
  misc_feature (810)..(810): n is a, c, t, g, unknown, or other
tcgagttttttttttttttttttttctttttttttttttttttttttttttttttttttttaaagcaggccacattctcgtatttttcttcaacttattcatgtacaaaaggcaggccagccatgggggcacctcctcggtttgaaaactgaaacaatctgctgaacaaaaggacgcgagaggcaaggctaaagcatctatttcgattgttgggccttggaaggaaaagccatggcgcgcaggctcttgccgacctcggggaagctcggcctctctgacggttcggttgaccagcaccgctccatcagggacctccactggggatcacaggactcgggcaccggaggtcgcagcgtgttattcacgattccacctataatggccccatagggcagctcggcgtaaggctcttcacctgtaagtagctcccacatcacaatgccaaacgagaagacgtcaaccttttccgagacaaggttgctgctgccattcaacaactcaggggccatccaaggaagtgttcctcttactccgccaaagattagtggctggcatttgacctttgataatcccaaatcaccaaccttgcatataggccgttgaggatcccttaggttgacaagcagattgtcactcttcaagtcaaaatgcactatattcttcccatggagatattccattccaaatgcaacatccattgcaattaggagacgcctacgccgatcaaagatcttttcaggtctttgaaatgcttgccggagtgagccatttaccatgtattctgttaccggtggcacagatccaccaggnccatcatacgctcttgctcaaaagccttcccaga

SEQ ID NO: 10367 - protein, 49 aa, Zea mays
  misc_feature: Ceres CLONE 1156678-R
EFFFFFFFFFFFFFFFFFFLKQATFSYFSSTYSCTKGRPAMGAPPRFEN

SEQ ID NO: 10368 - DNA, 660 bp, Zea mays
  misc_feature: Ceres CLONE 1156724-R
cgattgggtaccgggccccccctcgagtttttttttttttttttttctatgctactctctctagtcagtaaaatatgggagatggtcgccagtcagtgacacaaacaaacagccagcagcaccaaaactaggcaatttcagctgttgccctgtatgtacacatcagaacaccaaacaagcacgaccttcacagtgatatgttatgttacctagcaattagctgagctgagctaccaaaagtcaaaaagaagctgctccctcactgaccagctaagctacctaacaattaattaactctgaacacctgcagcttctcctcgcttaagcaaccaaggtacccacctggtcctccagattcagcagcgtaccttaaatcaaggatgggctcccggtgggtgcagaggtcagcatgcatcccaaacgaaggcagttgccaggtccggaccccacgcagcgactcgtctccgtaggagaacaggtgcttctgctggtggcctccgtatccgtaaggtatgatggccgattttgacatgcgcagctcgctcacgttggcatagcaagtcgtggcttcagcgaagcaggtgttacccgtcctcctcctgataagggtgtgctgccctggtttcccctgcccagaccgtgtaggcgtttgtgatagat

SEQ ID NO: 10369 - DNA, 870 bp, Zea mays
  misc_feature: Ceres CLONE 1157007-R
  misc_feature: Pfam Name: DNA_methylase Pfam Description: C-5 cytosine-specific DNA methylase
  misc_feature (28)..(28): n is a, c, t, g, unknown, or other
  misc_feature (870)..(870): n is a, c, t, g, unknown, or other
cgattgggtaccgggccccccctcgagntttttttttttttttttctttttttttttttttttttttttttttttttttttttttttaaaggacaagtcaattgcttgcaataatcaagccccaagacttgaaaagtttacttggagcatcctacatttacggatcagatgattctatatcctcctacgggttagttttatgaagacgggcgatcttcattaaagatggactcttcaactgagtccaactgcagtccttacccttttgacaacacggttatactcataaaaggggttcgaatccatgcccattgtcgtatttactgtagaaccacctttgcaagaagtataattcccaccgataatcagatcaaaaccaccaaactctttcaccaagtcttcaatcacatgggttttgagcttccaaattcctgcaggttgccttagtactccagtttgttcagttttcaaccaccaccttcttaaaatttttctattcacctcaaattcctcaacagatatcacacttttcaaagggatgcctagacgatgaagggttacttctgcacctccaatgccactgtaaagggataacactcttattccatcttgatacttacctttcaggactgataaaaagatatgacaatgtatccagctgggatgcatatttcatggcagaaagtcgatcaggttggtttaattcaaaaaaattttgtgtggttatagggataacctattatctttttccacttgacgaggctccaaggggcctaacctgtcccgaccgacccaaatagggtttgaacacctgcactggggaaaaacccgcatttggtcttgcttggggaacacccctccttctggacn

SEQ ID NO: 10370 - DNA, 855 bp, Zea mays
  misc_feature: Ceres CLONE 1157048-R
  misc_feature: Encodes the peptide sequence at SEQ ID NO. 10371
  misc_feature (294)..(294): n is a, c, t, g, unknown, or other
gggcgctccgctataattcaccggactgtccggtgtgccagcggagcaacggctacttcgcgcgcaacggtcgactgcaacgcattaaatgcaacgtctgcgcgcgcagaggttagagcacgcgcgggaggcgcaccggacagcctagaggccccataagtcagaactccaacggtcgaaccccaacggtctgctgatgtggctggcgcaccagacagtgtccggtggcgcaccagactgtccggtgcgccatgcgacagcacacttccaacggccatcttttggtggttgacncactcctcaccccctactcaccttctccccttccttctcccccctctctcgcggaacccccactctcccccccctcccaaaaccctactcccttccttatcaccctccatccgccccacagctcctttcccctcctcccccccccacacattatctcccccttctcctctctcccttcccccctctacctccccctacacctcacccccctccccttccgttcacctccacccccccaccaccccccctcttttcttaccccataaccctacacctacatccctccccccgattactcttctctctcaccccccatccctctcacactaccctcccacgcacatctcccaaatctttctcatagcactcaacccccacatatcactccgccccacttcttctatcctcgcgcacatttaacaccttctcatctcgacgttaatacgctccatccgctgattatagcggacagatacccaagaaccgtccctaccctctatactctccactaatctgatccagaatatttatagtatcgtctcacacttccctgtacctcac

SEQ ID NO: 10371 - protein, 37 aa, Zea mays
  misc_feature: Ceres CLONE 1157048-R
ALRYNSPDCPVCQRSNGYFARNGRLQRIKCNVCARRG

SEQ ID NO: 10372 - DNA, 1072 bp, Zea mays
  misc_feature: Ceres CLONE 1157060-R
tcccatcacccacttctatactcaatacttcaccagtagaaccctcccctccctctccattggggtacgggccccccctcgagtttttttttttttttttttgaatcaaaacaggtcttcttttatgaggctatggttaccattttccataggcttgggggctaaaacataagacggcggaatccaccctcgatatacaacttcatttttctataaggtaatgggggtatacgaaccctatatatccttcacatgaaaagcattgactaactgccccatatgctactctatgcaaaaggtacatggacatcacgaaaagactggttttgcaccgaggctgccatcgtattgtgataatcagtatgttgaatgcattcccacctttccccttgctgtgagaagatcgtatccatggccgagaaatatgggcaagatcttcatggtgctcctcgaacgtttttgattttcctgcgcatctaccgaatcgttaccgcctgagcagattattgctaaccgacaagtctgaagcttatccttgcatactttgctacagaatgccacctagaagcattccttcgcggcactatgccttcacccggagggttggaattttattcaaaaacttcggtacttgaacaccgtaatttttggtctcggttagagcatcacaaatattaccgaaatctaagccgaatgtgtccaaataggggggcataaggaaatctctcgcacgagaaggataccgcatttcaaaccctctttggactaccaacaatgggtgcgtccccattaatccttcgttccaccaccagggaaccatatttctttccttcttccacgtcatcttgacaagctatcgcccattttattctccgcccgaggccattctagtaatattaagggtcttctgcatgtattaaccatggcattccccatttggatcctatttctttgaaaacattgtactctgccaatcgggaaggctgaacgtgggtttggattgtatctactctcaattctgtatatcaaatctccttccaaagaatgtgggtataactaccccgcatagaga

SEQ ID NO: 10373 - DNA, 725 bp, Zea mays
  misc_feature: Ceres CLONE 1157098-R
  misc_feature (18)..(18): n is a, c, t, g, unknown, or other
  misc_feature (19)..(19): n is a, c, t, g, unknown, or other
  misc_feature (30)..(30): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (446)..(446): n is a, c, t, g, unknown, or other
  misc_feature (529)..(529): n is a, c, t, g, unknown, or other
aaattaaagttaaataannaaaaaccatcnaacaaccacaacccnnnccnnnnnnaaacgattgggtacgggccccccctcgaggaaccctgcgcatggcacaacagtgccaaccaagcacatcggtcacaggtcagtcagccgcgggagaaggtgcgacggtcgatatggccaaaagtgggctggcagtaatggcggcagcaggcaggcggaagcagcagtcaaatcgtctgcaggctcacgtcccctcctagagcagcaggggagccctctcccacggcgtgaagacgacgcgcccgtgttccgtccctcaaacggctcacgcaacggctgcctcgcgaaccacccgtcccgtcgcattaacttcgtggcagggcaggcgacacctttggcaggcgaagcgggcgacgcttcacctccgccatgatgaccgcgtcaaaaaaggngccccacatcgtattaattcgtatcctcccccccgggcccttttctctctcttgtttgtgggaccggcaccggccacactccnaaagggatccttcttctcaaaggaagagggcccctagtcctcctactgatcagaggttcgaaggctggcccctcggaaaggttcgacagccgcctcagaacactcgggctccgcgccaactactgatcaggggttcgaatgctggcctcccgaagggttcgacagccgccccagaacacgcagagcgagggatgaa

SEQ ID NO: 10374 - DNA, 648 bp, Zea mays
  misc_feature: Ceres CLONE 1157105-R
cgaattgtgtaccgggccccccctcgagcgtagagaatttacaagaggcaaccccgaaggtcccatcgaatggatcgatcacgaaactgaagccttcgaagagattttaaatagccacggagacatatgtgctttctcgggtgccaggggaattgccaccattttagagaaaaagggctgcgaacatgtaaaaattttagcgcaatccgaagctgctttgtccttcgaagatgcgagagatccttcagccgaagctagcatggttggtggaaaatttttcaccgatgtctgggataatggtggccgagaaatggcccgagaaattattcgaaaaagcgaaaagggcattcacgatgctagagaagtagctgaggctgctgagaagagcgcagagcccgaagggcaactaggtattaactaatggtttttattgtgttgtaatttttggttttaaacttcgttcgcaatttgtaatagcaatgtagtcgtatcctgtcctccttcagatcctgctaaagcgtctccgggctctcacccgaagggagacgatgaaattaaaaagatggctgaagctattatggacgaagttgtcaatcggctcctgaatgaggctcagaagttgttctgagagaagataaatactattgc

SEQ ID NO: 10375 - DNA, 1836 bp, Zea mays
  misc_feature: Ceres CLONE 1157264
  misc_feature: Encodes the peptide sequence at SEQ ID NO. 10376
atctgacttcgggagcggctcctccgcgttgcctggatcgcccgggatcagtattttgcttccagtcagaggtccaaaatatcaaagggatgcagaaagatgtggttgcatgatggagtaccttgcctggaaattggcaggatacacaaacatagttgtactttacttgatctcgatgacattggactgcaaatatatgcacaacaattgcctcatgcacacacacataatggggccgcgagttgtagctcaaccatcgtctctggtttctttctaggtggagatggttaaaattgctggtcacttataattaccagcatcttatacgtcattgttgttcatcgccaacttattcaagtttgaaagtagaacactgagaagatggctgagaaagagaatattctaatgcagagatatgagatgggaaagttacttggaaaagggagttttgccaaagtttaccatgctcgcaatgttaagacttcagaaagcgttgctatcaaggtgattgacaaagataagatcaagaagtgtggtcttatggatcaaataattcaagagatttcggtgatgaagttggtaaaacatccaaacattgtccaattgtatgaggttatggctaccaaaaccaagatatattttgtgatagagtatgtcaagggaggagagttgttcaaaaaggttcaacgtggaaggttaaaagaagatgttgctcgtacatatttccaacaattgatcagtgctgttgacttctgccatactagacaagtttatcatagagatctaaagcccgaaaatcttcttcttgacggaagtcacaacttaaagatttcagactttggtttgagtgcacttccaaactgcaagagaaaagatgggttactccacacaatttgtgggactcctgcatatgttgctccagaagtaattagtcaaaaaggatatgatggtgcaaaagctgacatatgggcttgtggagtgatcctctatgtgttgttggcgggctatcttcctttccaagacaagaacatgatggacatgtataagaaaatttgcaaagcagaactcaaatggccaagttggttttcttcagatgttcgaaagcttctgcggcgcatccttcatccaaaccctaatagacgaatatctattgaagaaataaggactcatccttggtttagaattggtcttgatgcaagattgtttgattctacaacgagagattatgtgcctagtgacatggatttggctttgaattccttaaatagcaatatggtcgagtgtaattcagcggcagagaaactgactattttgaatgcttttgatatcatctccctgtctaacgggtttgatctctctggtatatttgagaactcaaacaaggagtctaaatttatgtctaccaacacagctatgacaattatcacaaagctaatggaggttgcaaagagcctggatctgaaggttataacaaaaactggtggattgttgaatatggaagctgccaaatcaggaataaaaggtgtgatgtctataaatgctgagatatttcaaatcacaccaaattatcatctcgtggagatcaagaaaatcaatggtgacatccttgagtatcataactttatgaaccaaagcatgagaccggcactagaagatattgtgtgggcatggcatggtgaacaacctgacgagaagtagactcatcaactttagataatcatcaacctacaaccttagatattgtggcagctttaatgctattagaaagtgtatcaggcattcaggccaaaaaaatgtcatgggacttaataatattaaaaaaaaaaaaaaaaaaaa

SEQ ID NO: 10376 - protein, 438 aa, Zea mays
  misc_feature: Ceres CLONE 1157264
  misc_feature (12)..(266): Pfam Name: Pkinase Pfam Description: Protein kinase domain
  misc_feature (307)..(364): Pfam Name: NAF Pfam Description: NAF domain
  misc_feature: SWISSPROT Homolog: EC 2.7.11.1 Non-specific serine/threonine protein kinase
MAEKENILMQRYEMGKLLGKGSFAKVYHARNVKTSESVAIKVIDKDKIKKCGLMDQIIQEISVMKLVKHPNIVQLYEVMATKTKIYFVIEYVKGGELFKKVQRGRLKEDVARTYFQQLISAVDFCHTRQVYHRDLKPENLLLDGSHNLKISDFGLSALPNCKRKDGLLHTICGTPAYVAPEVISQKGYDGAKADIWACGVILYVLLAGYLPFQDKNMMDMYKKICKAELKWPSWFSSDVRKLLRRILHPNPNRRISIEEIRTHPWFRIGLDARLFDSTTRDYVPSDMDLALNSLNSNMVECNSAAEKLTILNAFDIISLSNGFDLSGIFENSNKESKFMSTNTAMTIITKLMEVAKSLDLKVITKTGGLLNMEAAKSGIKGVMSINAEIFQITPNYHLVEIKKINGDILEYHNFMNQSMRPALEDIVWAWHGEQPDEK

SEQ ID NO: 10377 - DNA, 672 bp, Zea mays
  misc_feature: Ceres CLONE 1157707-R
  misc_feature (629)..(629): n is a, c, t, g, unknown, or other
gggcaattcattctagtattcagacaacaactatgtgtgtcatgagtagtaacatctgtaattgttgagcctatgctcttactttctcgacccctgggacattgttctgtaacttctgctgaatcacaatcttcagtgcattcctgagcagtagtgacatgctctgtctcaaaactcatgctggctacttctaacacagctgagcattcttgtttatcatctacaatgtcatagtcaaacttactgtcaacatcaacactttcatatgcatttctctttgtatcttttaggctgcagactttaatggaccccttctcgtcattatcaaccagcagtatcatactctgctttggaactgacacctcaacacgccaatcaccagtcttcatttgttgcaaatttgcagcattgtttatggctactttgttaatagataaaggagacatctgctttgctgaactgagagaactaccactgataacaaatacagaaggcccatgatttgttctcctaaaagaagtatctcttgatcctccatcatgtatacttctagcgtcatgatggtctccaaagtagttctcttttgttgatgatccagcttctgatggttcaggagtatgagaccctgnaatagctttccacagcttgtcaaaattactacgctcaagggag

SEQ ID NO: 10378 - DNA, 919 bp, Zea mays
  misc_feature: Ceres CLONE 1157707-R3
  misc_feature (788)..(788): n is a, c, t, g, unknown, or other
  misc_feature (819)..(819): n is a, c, t, g, unknown, or other
  misc_feature (868)..(868): n is a, c, t, g, unknown, or other
tacttctagtattcagacacaactatgtgtgtcatgagtagtaacatctgtaattgttgagcctatgctcttactttctcgacccctgggacattgttctgtaacttctgctgaatcacaatcttcagtgcattcctgagcagtagtgacatgctctgtctcaaaactcatgctggctacttctaacacagctgagcattcttgtttatcatctacaatgtcatagtcaaacttactgtcaacatcaacactttcatatgcatttctctttgtatcttttaggctgcagactttaatggaccccttctcgtcattatcaaccagcagtatcatactctgctttggaactgacacctcaacacgccaatcaccagtcttcatttgttgcaaatttgcagcattgtttatggctactttgttaatagataaaggagacatctgctttgctgaactgagagaactaccactgataacaaatacagaaggcccatgatttgttctcctaaaagaagtatctcttgatcctccatcatgtatacttctagcgtcatgatggtctccaaagtagttctcttttgttgatgatccagcttctgatggttcaggagtatgagaccctggaatagctttccacagcttgtcaaatttactacgctcaagggagcgaagtcaggaagtttttgaagagggtaccaaatacccagaactgacccgcatactttgaagagctaatgaggcagccttccttgtattctagtcagtactcttcagtgcatccataatacttngctagagctgatgataatgcctgctctgtgnaaagcactacagtcctgataatgctccttatcaagtcaatcgcagcggnctttcgccatgaagtggggttcctgagcagcttacaacacgaacagcatct

SEQ ID NO: 10379 - DNA, 833 bp, Zea mays
  misc_feature: Ceres CLONE 1157707-R4
  misc_feature (471)..(471): n is a, c, t, g, unknown, or other
tacttctagtattcagacacaactatgtgtgtcatgagtagtaacatctgtaattgttgagcctatgctcttactttctcgacccctgggacattgttctgtaacttctgctgaatcacaatcttcagtgcattcctgagcagtagtgacatgctctgtctcaaaactcatgctggctacttctaacacagctgagcattcttgtttatcatctacaatgtcatagtcaaacttactgtcaacatcaacactttcatatgcatttctctttgtatcttttaggctgcagactttaatggaccccttctcgtcattatcaaccagcagtatcatactctgctttggaactgacacctcaacacgccaatcaccagtcttcatttgttgcaaatttgcagcatttgttatggctactttgttaatagataaaggagacatctgctttgctgaactgagagaactaccactgantacaaatacagaaggcccatgattttgtctcctaaaagagtatctcttgatccctcatcatggataactctagcggcatgagggcctccaaaagagttctcctttggtgaatgacccaccttctgatggttcaggaattgaaaaccctggaaaaactttccccaagctgtgcaaattttctcccccccagggagccaaatccggaaatttttaaaaagaggtacccaaatcccccaaaagggacccccaaattttgaaaaaacttttagggggggacccctcctggtgttttgatggaaggccccttccggggggccccaaaaaaaattgtgttgaaaacggaaaaaaaatagccccccccc

SEQ ID NO: 10380 - DNA, 752 bp, Zea mays
  misc_feature: Ceres CLONE 1157707-R2
attttggtgagtgtatattcaacccaccccacacccatcccgaccccaccaccccccaaccccaatccaaaaggccaattcttatagtattcagaccacactatgtgtgtcatgagtagtaacatctgtaattgttgagcctatgctcttactttctcgacccctgggacattgttctgtaacttctgctgaatcacaatcttcagtgcattcctgagcagtagtgacatgctctgtctcaaaactcatgctggctacttctaacacagctgagcattcttgtttatcatctacaatgtcatagtcaaacttactgtcaacatcaacactttcatatgcatttctctttgtatcttttacgctgcaaactttaagggaccccttcctcctcattaatcaaccagcagtattcataactctggctttgcaaatgaaaccctcaaaaggccaatcacccatctttctttcgccgcaaaattttgagcaattgttttaagggttacttctgttcaaaaaaaaaaggacaaaatcctgctttttgcttgaaactcgacaaaaattacccccttgactaaccaatgacccaaaggccccatggatttcgttccccctaaaaaaaaagtattctccctgaaaccctcccatcaatggaaatactttctaaacgggccaaggagttggcctcccaaaagaaagattctcttttttggtggaaggaatcccagccttcctgtatggcgttcaagggagta

SEQ ID NO: 10381 - DNA, 776 bp, Zea mays
  misc_feature: Ceres CLONE 1158219-R
  misc_feature: Encodes the peptide sequence at SEQ ID NO. 10382
cctatagtgagtggtattaccctcgagttttttttttttttttttccttttttttttttttttttttttttttttttttttttttttttttttttttttttttgacgggggattactttttatataaatatacatatagcccaacaccagtattatttgtagacggcccgaataaccatcatacagtacccctctaggaggcccccggccgcgggaataaaaaaaagatacgtacatgtcttccgcccatcaatcgatttccgtttaaattttggacgtctaataatcccctttaaaaaaaaaaatccccgccgccccccaacgaaaaaaattcccttccgttcggccgaactcggaaaagggggggcgatttcttttccccccccccggggttttaaaccctttggatgtgggggggccaaattattaaagggaaatttgcccccaccctcttttatatttttctcccccccccacggggggtgtttgttttttttggaaagcgccccccctccaccaccgggggaaggaattttttttgcccccgccccacccccgtagttttttaatatttttcttcgggggggaggaaaaaaaaaaaaaccctctttctttcttcccgggcggaaaaatttctctgcggcccccggggaaaccccattttttttaaaaaggcccccacaccgcggggggaaacccccccttttttgttccccctctggggggggggtttattttcaatggtggggaaaaaaagaacaaaaaagtgttcttcg

SEQ ID NO: 10382 - protein, 64 aa, Zea mays
  misc_feature: Ceres CLONE 1158219-R
YSEWYYPRVFFFFFSFFFFFFFFFFFFFFFFFFLTGDYFLYKYTYSPTPVLFVDGPNNHHTVPL

SEQ ID NO: 10383 - DNA, 872 bp, Zea mays
  misc_feature: Ceres CLONE 1158233-R
  misc_feature (28)..(28): n is a, c, t, g, unknown, or other
  misc_feature (29)..(29): n is a, c, t, g, unknown, or other
cgattgggtaccgggccccccctcgagnntttttttttttttttttttttttctttttttttttttttttttttttttttttttgccaacgccatcataaatagcatgcattggatagcagcacagcacagcaactgagtaaactacaacttcagtcacattactttgacaatggccaaccgggtttcgggaactctgcaaaacttccctagttggacaacagcgtaaaataataaaacctaaaggctatggatttcctctctctctctctctctctaaaagaaaaaggatatctctgggggttggacaaaggaaaaaatggcttccccgaaaacctcgtacagaaaccccaagagatgaccgggggcctggtcctccttccaggcttgcctaagcactgcaaaaactctctgcgggagatcactgccctgatccctccggaccgcagctgatgggatgctctccaccgtctgcccaaaggacgaggcctgcatcatgccagggttgcctaactggttgggaaagccatccatggcaccttgcatgttccctcccatggaaactgaggccatggagttggctgttgcgtccgttgccatcttcttcaaaggtggctgagttgcagagagatctgtgctagattttcgcttattttgggtgttggttaagacccttttgttgctctgaaaaaaaggcgcatcgatggaaaaagcaacccgggaatagttttcaccgatcatacaagatttgcctgcagcaacagcaaggcacataaacccgccagcttccttcctttcatcccggtttccgccttccaagctgaattccggttcaaaagtgcaaatagtccaagggtgcgaaaaaaggagtta

SEQ ID NO: 10384 - DNA, 876 bp, Zea mays
  misc_feature: Ceres CLONE 1158472-R2
  misc_feature (731)..(731): n is a, c, t, g, unknown, or other
  misc_feature (769)..(769): n is a, c, t, g, unknown, or other
  misc_feature (810)..(810): n is a, c, t, g, unknown, or other
  misc_feature (811)..(811): n is a, c, t, g, unknown, or other
  misc_feature (836)..(836): n is a, c, t, g, unknown, or other
  misc_feature (842)..(842): n is a, c, t, g, unknown, or other
cgattgggtaccgggccccccctcgagagacttccgtctcgcccgaggccccctttttatggcggacacatcaccggctcgcccaaggccttggcttcgctcagaagcaaccttgactaaatcaccacaccgactgaccaaattgcaggggcatttaacgcacaggaggcctgacacctctatcctgacacgcgcctccggcagagccgaggtgaccgccgtcactccaccgctccactggccagtctgacagaaggacagcgccgcctgcgccactccgactgcagcgccactcgacagagtaagtctgacaggcagtcaggcctcgccaaaggcgccacggcgaactccgctccgcccgaccccagggctcggactcgggctaagacccggaagacgacgaactccgctccgcccgaccccagggctcggactcgggctaagacccggaagacggcgaactccgctccgcccgaccctagggctcggactcgggctaagacccggaagacggcgaactccgctccgcccgaccccagggctcggactcgggctaagacccggaagacggcgaactccgctccgcccgaccccagggctcggactcgggctaagacccggaagacggcgaactccgctccgcccgaccccagggctcggactcgggctaagacccggaagacgacgaaactccgcctcgcccgacccccaggctcggactccgccctggnctcggccgaacgacttcccgcctcgacgaccccttggntcggggctcggcctcgcaacggaagacagattcgacccagnnttcggagagccccacgtcgcccggnctcggncgcgggcccgcacgtcacagggagcgccatcacc

SEQ ID NO: 10385 - DNA, 870 bp, Zea mays
  misc_feature: Ceres CLONE 1158472-R
  misc_feature (41)..(41): n is a, c, t, g, unknown, or other
  misc_feature (42)..(42): n is a, c, t, g, unknown, or other
  misc_feature (822)..(822): n is a, c, t, g, unknown, or other
cctctttttcttcgccccagccccctatatgacaatttatnnttcctatgggtactcgtattcccctcgagagacttccgtctcgcccgaggccccctttttatggcggacacatcaccggctcgcccaaggccttggcttcgctcagaagcaaccttgactaaatcaccacaccgactgaccaaattgcaggggcatttaacgcacaggaggcctgacacctctatcctgacacgcgcctccggcagagccgaggtgaccgccgtcactccaccgctccactggccagtctgacagaaggacagcgccgcctgcgccactccgactgcagcgccactcgacagagtaagtctgacaggcagtcaggcctcccccaaaagcgccaccggcgaactccgctccgccccgaccccagggcttcggactccgggctaaaacccggaaaaaacgacaaactcccgctcccccccgacccaaggggtcggactcccgcctaaacacccgtaaaaaaggcgaaaatccgctcccgccccaacccctagggggtcggaaattcggggttaaaaaaccccggaaaaaaggtgaaaattcccgctccccccccaaaacccaaggggatcggaacttcggggcttaaaaaccccgaaaagaaaggggaaacttcccggcttcaccccaaaacccccaggggcttcggaaattccgggcctaaaaaaccccagaaagaagcgggaaacctcccgcttcccgcccgaaacaccaaggggacctggtaatctccgggccaaaacaccccggaaaagaacaaaaaatatatctccnctccttcccccgaaacacccgagggggtctcgacaacccccgcccttg

SEQ ID NO: 10386 - DNA, 860 bp, Zea mays
  misc_feature: Ceres CLONE 1158997-R
  misc_feature: Encodes the peptide sequence at SEQ ID NO. 10387
  misc_feature (840)..(840): n is a, c, t, g, unknown, or other
  misc_feature (842)..(842): n is a, c, t, g, unknown, or other
  misc_feature (843)..(843): n is a, c, t, g, unknown, or other
cgattgggtaccgggccccccctcgagttttttttttttttttttttggaagactgccaacttatatatatatatatatatatatatatatatatatacatatatatacatatatatatgatatatctatatatatataactacccctcacacactctcccattgtcccaaaaaaaaactggaaaagacacgcgcttatggagtcagcgcgcgcgggtgtggagaaggagacatagttgatccgagcctgcgtcccccggtcacgctgtgaccctgcccctccctgtccctgtgtctctgtgggagtgtggggagggcgacctggacccccatagatatagggattggccccggggaccggggcacacgggcatctacgtgcctgaaaaaatgccccccctagcgggcacacgcacacacacacaagagcggataaaggaggggctcctgacgcccacacgcaaacacccacatcctgattcggaaacccggcaaggaacctgcactatatagctgagaccaggctttttgatacaaactttggcctgagcttcccctaggaaccctaaatcatcttctaggtctataggttctggttgccataaagccgagacccccaccttctcgcctgaatacaaacatactctacagaacatatccttgctttccggggaatccccatccaattggaaatctcctagagaaccggtccccacgcccttgaagcgcgcgcgcgagatctcgcgcccgatttccctttggagagacttcaaaaaatcaccatttttcatacccttccagccacggatacagaagcgagatccacttcctcatctctcncnntttcccacggaggagaa

SEQ ID NO: 10387 - protein, 39 aa, Zea mays
  misc_feature: Ceres CLONE 1158997-R
DWVPGPPSSFFFFFFWKTANLYIYIYIYIYIYTYIYIYI

SEQ ID NO: 10388 - DNA, 864 bp, Zea mays
  misc_feature: Ceres CLONE 1159191-R
  misc_feature: Pfam Name: Pkinase Pfam Description: Protein kinase domain
tgggtaccgggcccccccctcgagttttttttttttttttttttctttttttttttttttttttttttttttttttttttttttttttttttttttttttttttgttttttttttttttttttattttttttctttttctttttgttttttgttatataaacacttactcaaaattgtttcccgttgaaccacccgagggggggagaccaaacaaacaccggggcaatgcatttacacaaaatcggaaaaaaaaaaaggaaggcgcccccacggaaaactaacggcaccagtgggggttgcccgcccaggaggctactctgaatcgtaaaagccgctaggggaaggaaaaaatacatccgaccccagaatatgaaccaccctggggatcggcggccgcccccccggaaaaaagttgacccactggttggggagaaagagaaaagcgtccaaggccccggggggcactccttcacaattgagatggacgattccccccccccggttctctccagccaaaaaatttaaccatccaaaaaggtttaaccccttctcgggggaggatgcatcggaaggccgctttccgttgagtattcccgggcccaaaaccccaaaaatggaaaccccggccttctcgggggctctcccaaaaagaaaaaactctggggcaaaaaaaccaaagggtcctggaactatggggaggaaaagtgattcttccccccctaaaggttcggaaggccaaagtctgaaacacgggcctcaaaaatgaccaaaaagaagagggggctcgatttgaaatccccatggtttatcccaggcaaaaatccgggaggaaaaaaaaaaagccctttgccactccaaggagg

SEQ ID NO: 10389 - DNA, 858 bp, Zea mays
  misc_feature: Ceres CLONE 1159403-R
  misc_feature: Encodes the peptide sequence at SEQ ID NO. 10390
  misc_feature (28)..(28): n is a, c, t, g, unknown, or other
caattgggtaccgggccccccctcgagntttttttttttttttttttcttttttttttttttttttttttttttttttttttttttttttttttttttttttttttttttttttttaaggaaggccccgcaaaatatgggggggaaattgggaaaacatacaacccaatttgttacggcccttgggggttaccaacaagtccggaaaaacgggggggggggaccccggcaccccaaaaaaggggacagcccaattgtccagttcaaatatctaattacttggtgaattaaaaacatatatataagcccccagcaccctccctgttgggtcccccaaattccccaaatattttgtggcttccggcccatttccggtggtggggggccccccaaaaacctcccaaataggggaaggggccatcatcccttcggaaccattttggtttccaaccattggcctgcattttccgggaaatccgttgcctcctctccaggcgcagtttctcagaattggccttaatataccccccattttctaaatgggggtgatctggtcccaatcttgaatccggggggggaaggttctccttgagttctggagccaactcgttcaaagtttttgcgaacgatgagaggttatagggggggggattagtcaaattttcctttttcccccacaaaagaaactacttctgccctgatgggctggaggacatcctcctctcccactttcccattaggtttgccaccggcaaaccatcaccgtccttatccaatcctttaacctgccgagggttgccctaaagaaaaattgccgtttgaaaacaacttggatgaatatcccctgtctccaaatata

SEQ ID NO: 10390 - protein, 95 aa, Zea mays
  misc_feature: Ceres CLONE 1159403-R
  misc_feature (9)..(9): Xaa is any aa, unknown, or other
IGYRAPPRXFFFFFFLFFFFFFFFFFFFFFFFFFFFFFKEGPAKYGGEIGKTYNPICYGPWGLPTSPEKRGGGTPAPQKRGQPNCPVQISNYLVN

SEQ ID NO: 10391 - DNA, 853 bp, Zea mays
  misc_feature: Ceres CLONE 1159472-R2
  misc_feature (853)..(853): n is a, c, t, g, unknown, or other
aattgggaccgggccccccctcgaggctcgcgagccggctcgggctcgatcaggctcggctcggctcggtgaggctcgcgagcctaaacgagcccgagccgagcctaattccatggctcgctacactaacgagccgagccgagccgagccggctcggtgaggctcgcgagccgactcgaggctcggtccaaactattacagctatcacttgtcagttgtcagtttgtttattagtgtccagtcatctagatccagtgaccagtgtgttgttttggtcataactcacaaggaactagagtgcagggacataattttttattatatggaacatattgtgcttcaaatttgagctaatgaccgtaattaatgttgttgagtacttgagtgtacaggctcgcgagccgagccgagccggctcacgagcctatatcgagccgagccgagcctcatcatcgagctcaagaagtgaccgagccgagcctggctcggctcgccattccaccgagcctcaccgagccggctcggctcgtttccagccctacccttagccatgtgtaatccttcgcgtcgtcacgcggcactgctggaccctcgcccctcggcttcagaggagctcttggaccgtcggacgagagcagttgggcgttatcccagccgttggatcttcgccttcttcattcgttttttctgtatcagtttactcattttacttctgtgaactattggcaagtcagttcgacccaagttactatatacaagagcgcgctgtgctaactgtatcgtacattttctttatatcagaatacgatgaaacagcaaaacttgcgttttcgtattatctataatgtaactn

SEQ ID NO: 10392 - DNA, 724 bp, Zea mays
  misc_feature: Ceres CLONE 1159472-R
tgggtaccgggccccccctcgaggctcgcgagccggctcgggctcgatcaggctcggctcggctcggtgaggctcgcgagcctaaacgagcccgagccgagcctaattccatggctcgctacactaacgagccgagccgagccgagccggctcggtgaggctcgcgagccgactcgaggctcggtccaaactattacagctatcacttgtcagttgtcagtttgtttattagtgtccagtcatctagatccagtgaccagtgtgttgttttggtcataactcacaaggaactagagtgcagggacataattttttattatatggaacatattgtgcttcaaatttgagctaatgaccgtaattaatgttgttgagtacttgagtgtacaggctcgcgagccgagccgagccggctcacgagcctatatcgagccgagccgagcctcatcatcgagctcaagaagtgaccgagccgagcctggctcggctcgccattccaccgagcctcaccgagccggctcggctcgtttcagccctacccttagccatgtgtaatccttcgcgtcgtcacgcggcactgctggaccctcgcccctcggcttcagaggagctcttggaccgtcggacgagagcagttgggcgttatcccagccggttgaatccttccccttcttcatcggttttttcggaatccgtttcctcatttaacttccgggaaacaatg

SEQ ID NO: 10393 - DNA, 979 bp, Zea mays
  misc_feature: Ceres CLONE 1159703-R
  misc_feature (979)..(979): n is a, c, t, g, unknown, or other
gggtaatatgctatggagtagttgaatctaggctaagtgagacaatgacaaagcgtgtaacgtttgccaagcagcctaggggcaaattcaaagaattaaagaacatcgacatcacttgtctaacggcaaactgccatgggctttctacaagaaagttctcagctgctctgtggcattggccctgtggcattagacagatccaaggattacccagaacgggacacctggaaagcgaaaacgctcctcgggttccagaattacttgcacacactgatcatcgctggaggttgtatcccctcttccatatcggaaagaacatccttcagctggacatcacctgcctcaaacatactgaaatctgccggacctacaccatccttgcttccttcgtcagccgaaaaacacacatctaacagccaccccaatgttgcagtcaaagtcgtgcgtaagcgaaaccgctcgcctcaaaattgaattgagctgcccaaatttctggtcaccaacaatgttggctaaccttcgaaaaccaatgaaaggggctcccttaaacgccctctttcaaatgcttgtccatccaaactggaaatctaaggggccttcccccggtgggcccttccagggcacccctgtgtttctccattcaggggttttttcaaactttcccaatcccggggtgaccctatggccctctccctttgaaacctcccggccttccttgggcccttttaaaattcccgcgggtttccccacctagaatccaaaatttggaaaaatccccctggggttttaaaaagcccccggaacccccacccttggtgggcctctccctgtgtaggaaaaacttgtgtcccacaaaataacacacccgcggggtgggctcccgttttcaccaccctcttataatttctaaaaatatttgtttacacaccccttttgtatcaccccccccgggtgttttttatatggcccccacaagaan

SEQ ID NO: 10394 - DNA, 1383 bp, Zea mays
  misc_feature: Ceres CLONE 1163260
  misc_feature: Encodes the peptide sequence at SEQ ID NO. 10395
tgttggctatcagatattcagatagtgtatgtgacacctgttttgcttccggtagaagctacggcagacccacttttacagagttttgataaacttgagaggaaaagggtcatagtttattcaacaaaggtacctggtccgatttctctgttccattgatgcagaatgatgggtgcatacgagacactgatgatcctaaaaaaggggacagcctgtgtatgtattctgaaggcagggatgaaccacatggtgaggagatgttagagcagatcactgatagtagcctttaccaacacatgggatccacatgtcagaatggaggatgtgtgagaaaaaaaggtgacagttgctgtggtcccctttatttgaggggagatgggaggttttttggtgacaaaaaagaaaaaaagagcaatctgggaactgctggagcgtctccaccaatatataacagttttatgagcatgagggatgatattgccgagctgctggtgatgctttaatgatcgatgtcaaggagttgtagtgacgcaacaggagatgatagagtgctgtcggatggatggagtgaaactgcctgctgccgaggtggccgacggagagcatgctgagttgaaaaggggtgttggccacgctccacgataaaaaaaatcattcccgtatgcccttgactaggaaaacatatgtcggcccatcatctcagaaaattctcatcctggaagtgatgtcctaaggattgagattcagattctcatcctgtcggagcatcgccaaatgtagcggtggcctgggcatcgcaaattctgtaggtactactagaatggtgaatggaggcgccgcaccacgcgggttatggcgccgaggtaacacagaacggcggcgacgcggcgggaagaggataacggcggtgtggcgtgagaagatctatggtgccgagctaggggtcacgtcggcttgcacgtcaaccctagccgccgtcgccacgtaagagctcgacgtcataggccatgacgccgagctaggggtctaaaaactgaagttatccagggatcttagtgtaagttttgttcaaaaaaaaaggttaaaaaacaaaaaaaaatcggcacaggtgggctctgccattggtggtcgtattagatcagagccggactttgtcaggacgtgagcagaaaatgcttaaattgacattattgcccacagctcagctcagctcagacaaccatcggctccgtccgtcctgtactagcaagaaacaattcaaaccgaccgtttctatccattcctgactccttttggccttgttactttaaaagacggacagagaaattgaaaaacaactcactataaggcgaaattgggtaccggaaccccccgcaaatgtcc

SEQ ID NO: 10395 - protein, 114 aa, Zea mays
  misc_feature: Ceres CLONE 1163260
MQNDGCIRDTDDPKKGDSLCMYSEGRDEPHGEEMLEQITDSSLYQHMGSTCQNGGCVRKKGDSCCGPLYLRGDGRFFGDKKEKKSNLGTAGASPPIYNSFMSMRDDIAELLVML

SEQ ID NO: 10396 - DNA, 670 bp, Zea mays
  misc_feature: Ceres CLONE 1163299-R
cgaattgggtaccgggccccccctcgagttttttttttttttttttttcttttttttttttttttttttttttttttttttttttttttttttttttttttttttttttaaccccggggtgaaaacaaatttgccgcccaataatacaaaaagggggctatttttccacaaaacaaaatcctaaacccaaacagacgggtttggcttaaaaaaaaaatcatcccccggggggcccttttttaagtccccaaaggggggaaatcaaacccccccaatcggatagttcaaagggaaccctctccaaaaggggggtcccccccctttccccccctcttctcagttggccttcccctttttaatggcatgtagggcgaggggtcaatttgcccagggagttcctttttgtctaccccaaaccttttttgcccctgggtaaaaacctccaaatcccaagcagaggaaacaaagggttttgcaagtcccttcgggccaaaaagtccagcccttccaaccctggggaaataaatttccgctgagtcggggatggcatattttttcacaatggtgaccccctcaatgtcaatgcccccgccaactaaatttggagccccaaaaattcccttggggccccccctgaagttcttatatcttggtagcctttcttcccgag

SEQ ID NO: 10397 - DNA, 834 bp, Zea mays
  misc_feature: Ceres CLONE 1163662-R
  misc_feature: SWISSPROT Homolog: EC 2.7.9.4 Alpha-glucan, water dikinase
  misc_feature (28)..(28): n is a, c, t, g, unknown, or other
  misc_feature (29)..(29): n is a, c, t, g, unknown, or other
cgattgggtaccgggccccccctcgagnntttttttttttttttttttttttttttttttttttttttttttttttttttttttttttttttgaaaaaacaaacggcccccattaatacccccaaattcccatggtcctcctggtgaaaacaaccataaaaacctccagttgggggcatccgggaccctgattccaaagaactatgcttttgcccatggacaaggaattttagtatttaaaaacccccccccggtggacatggacccctttatttgggttttctactttcccccccccggaacatcccccccccgaaaagctttggggcatgccttgaatttgaaaatacttcaggccccctccccggaaacccttaccatttgttatggggggcctccaaaattaaggactccaaatcttgccccccatgatcctctatctcaattccccggggaaagttatgaccccacttgacaaaaggggccctaaaaaccccgttcttatacactggcgttctatcagggtggctggacgggaggatccaatctctcttggccgggggaaggattccccaatggaaattttaccccccgggaacacggccgtcaaaaaatgagccgaaacccttgcttcttcttaaaacccccctgctgaagtttgggcaacgacaaaaaccaagttgttgctggaccacaaatattacctctgaagagaaatttgaaggtgtttgacttctaaggctgaagctatttgccacaatggttaatataaccccaaaatcctccacctgcaacatggttatgataaaggcttgcccatgggcagcctcttca

SEQ ID NO: 10398 - DNA, 857 bp, Zea mays
  misc_feature: Ceres CLONE 1164061-R
  misc_feature: Pfam Name: DSPc Pfam Description: Dual specificity phosphatase, catalytic domain
cgattgggtaccgggccccccctcgagttttttttttttttttttttgcaggctacaaatactagaccttgaactttcttttattgttgctcccttctctcctgatcgttcgtgggctaatcatataggctgtgtgaactaaacctacagacacaagttcagtctgatagtacaagttattactatgtgagccaggtacattgcctcatctatagtacaggaaaaaaatcacaatctcagctcattgctgaacaccttggtcagcttctgggacggggtcaggcttcctcctctgctgatctggagcgactcgatcgatttttgcatctccgtggccatggcgctgtcgacactgcctgcagatacacgcttgtgtgccttctgcaggagcagcttgagtgaactcgtacttaaaccaacattcttggtgcatattggacacaccttcatttctgtccgcttgcgaagccagaccatagataccttggcatgcagcctcttgtcaaggggcattagagcctttgcgaagccgacgtttggctgttttcgacggggtactttcttcattaagttccaggattttgcaagagttacgccctctctaagcataacataggcaagtacgactgtggcactccgacttttcccttcaaaggaatgaactacaaccttgccccccacatgatccacatgatccccgaagtctgatgcttcctcaaaaagatcactgatgtttgcatcatcatcatcgctaattgaaaagttcttgtatctcaaaagatcggtgaattgggaatcgtattgaccaatctcatttgaacagcaacatagtacatgcctaatgcccaaatgctgca

SEQ ID NO: 10399 - DNA, 623 bp, Zea mays
  misc_feature: Ceres CLONE 1164161-R
  misc_feature: Translation starting site: 323
ccaattgggtaccgggccccccctcgagttttttttttttttttttttttttttttaaagcagagaagaaacagcaatacgaaaccgaaccagaataccgtattacttaaaacgcgtgccacgataatattgttcaccaacaaaaggttctaacgcggatacaccgcgacgacgacgataaatcgagcagcgactgggccagccagccactgcagcagacacacgagacctgacacaaaccgcttagtccacctcctcgatcttggggccagggccaccgcttccagccggagcgtcctcgtccatgccgccggagcctcccatgtcggcacccgcgccctggtacatcttggcgatgatggggttgcaaaggctctccagctccttcatcttgtcatcgaactcgcccgcctcggcgagctggttggcgtccagccagctgatggccgcgtcgatggcgtcctcgatcttcttcttgtcgtcggcagccagcttggacgcgatcttctcgtccttgatcgtgttgcgcatgttgtaagcggtatttctcccacggagtttcttgggactcccacctttctttcttgggccccctcctgccccccccgaaattggaaacttca

SEQ ID NO: 10400 - DNA, 2599 bp, Zea mays
  misc_feature: Ceres CLONE 1164250
  misc_feature: Encodes the peptide sequence at SEQ ID NO. 10401
tagataacggatgggtgaaaatacactcttgcagtacacgtcagaggcaaccgtggggtcctttctttcttatccaaaaccaaaaccagcgaaaccaccggccccgcccttgaccaaaactagtccgtcagccggtggctcccgctcccctcgctgccgctcgtaactggggaaggccgcaaccccctcgggcaggcagcggctacccccaccaccaccagtgcaccaccactccaccagcgtggcagcgacgttgctgctgtcggcccgtacgtcctggcgtgtccttggcctacttaacccgcaaggacacgccgccattccgcagggcgagctcaagcctcaagctgggattggcccgtcggcagaacaagtgcacgcgggaccgggcaacatttcccgctgcagccaacaagcagagggggcgacgatatatagccacgggcggccgttgctggatccggcatcttcctcgatcggcaagacgataggatggggttccacctgctggcgttcgtggcggcgaggggcctcatgcaggcgttcaacctgtcggcgccgctcagcctccggctgccgctcgcgcgccacctgccggaggccctcgccgtcctgtacggcgtgctcgccgcgcaagccgcgtggctcaacggcgccctggcgcgcggcgccgctgggagccacagcgggagccggggcggcgtcgacgagtacgtccgccacgccatgctcagcgtctacgactgagaccaccggcggaaggtcgacggacagcaggcgccacgcgagggcgcttctagctgctgtccctgcccccgtcgtgctcgtggtggcaagtgcacgccgcgccggcgccggcgccgccctctgctagctagcggcgactagcagcgtagatctttgtaattcattgctcgctcgctcgtttggcgttccttcttgttcgtagcatgatttttgatagcatcgaaaaggtttgggaggttgctctctgtaacatgcaattgcaagccgtcggtggtagctagtggctggtaaattaaatacaagtgatgaattctgttagactgaattttctcgtcgccagccacgacgcattgatatatctccatgtgagcagctcgctcgctcctcctcgatcgggtcgccagaaaaacgctgggaagcccgaaaatgcgaccccatggtccatggacgacagcgaagttggtcatggtgcatgtgtggattgtgtgggccggggctcaaatgtcacatcttgtgcaaatacctgatccgtcctgcacttgcctgcgatacctcgtcatcatatatgaaccagctgattagtagcttagttgattagtactccagaacctagtgttgcttaattagatagctctttacgtccaagctatatatctgcgagagaccaaacaaaaaaaactatactgctggacccaggtgtgtatatatataatctctggtccagctataatctctggtccagcatgtgagttgctgacttatccgtgttgagaactacgttaccacggatcaccagatccgcacccttccctcccgtcagcagtagaggcgcaagaagatgtagagaacccgtctcccttcccataagcacgacagtggaaacacacgagacactggatatagggttgggcctctggcctctttctgatctatcatatgatggggtgtacaggttccttatatagagatgtgagacccctcaggggcagagccggtatttgcccacataaccctaactagggttacttaacactcccccttgggcgaataccgcgaccaacacatgcctcgttaaaactccgaaaaacccagtgggaaaaatatggagaaagagtgcatggtgatacaaattgcatttgcactttgttgcctcgttaaaaacctcatgtgagaaacttcaagaaaactcaccaagggaaaaagagtacaacagctgtcatcgggacagatttcgatcctctgggatctagattctatcgaatcttctacaagggctaactttagaaatgtgctccccctgatccttgcaaaaccgtatcaataaagcaaaacatcttcttctgaaagtatatgcacataaagatttagcaaacggattgcatatccttgcaaagattatttcaggaacttcacctcaactcacttctaggatacatgaggtaagtgcacgtatcaacataaataagccacttcaactagtggtgttcgatcgaccagatctacatatttgatagaaacttccataaaggttcacatattgatcatcaagctgacgccttcagggcatagaatatgacatttattgtttcacggttgtgatcaatataagcattcgctccccctgacgatgacatctgtcaaagtcgttatccctcattactcaagcatattcttcaagatatatgtctcattgttcatctggaataacgagaatggatgaggttgaggtgctatcattttctatcttacaccacaatttatacatagttgtgcaaagcaaataacatgtccttcaataggacttaggggataatatagttgcaatagtacatattctaaatatgatacatcg

SEQ ID NO: 10401 - protein, 84 aa, Zea mays
  misc_feature: Ceres CLONE 1164250
MGFHLLAFVAARGLMQAFNLSAPLSLRLPLARHLPEALAVLYGVLAAQAAWLNGALARGAAGSHSGSRGGVDEYVRHAMLSVYD

SEQ ID NO: 10402 - DNA, 935 bp, Zea mays
  misc_feature: Ceres CLONE 1164512-R
  misc_feature: Pfam Name: Piwi Pfam Description: Piwi domain
  misc_feature (1)..(1): n is a, c, t, g, unknown, or other
  misc_feature (2)..(2): n is a, c, t, g, unknown, or other
  misc_feature (12)..(12): n is a, c, t, g, unknown, or other
  misc_feature (13)..(13): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (23)..(23): n is a, c, t, g, unknown, or other
  misc_feature (24)..(24): n is a, c, t, g, unknown, or other
nnaaaacaaaannannnnnnggnngttttttcctctctttttccccccacgattgggtccgggccccccctcgagttttttttttttttttttttagatgagaactagattgatggcttccaatagtgcaatctaatccacgacaagcccatcttaataggagtatatcgcaaacagtttccaatgccatacaagtagttacagtacaaaatgtattaaagttaccggtgcataacggtgtcctagcatcaccaccataacgataattgcttgctcacagcatcagcgcagcgtcaatcttaccagtagaacatgacgcgcttcacgttttccttgagggcaggtaatggcctcacagcaacatttgcagcaccagccctggtgttgcgcgcccctggtggagggccacggtttgtcgtagcaccgctcgccacagatccgctgtcacttgtatctggctccatgcaaaaccgagctcggaaggctgccagatgagcatagcatgcaggaggaacgattgatactgagcgtgtgcacctggcatacgtgtaacacaagttgctggtgagagcttgcaacccattcagccgtaaatttgctctcatcccacagaacatgataatggccaggacggcttgttccctgaatgccaccatggctgccaccggcacaaatcacacctcggctgcatgccaaatctttgagctccaccacagtgcccggccgcatgctgccacttcctatcggcagcccgctgacccattgcgactattaccaaccaccctgccgctgatgacgccttcttggaccaccacacaaagcaacctgcaaggctggcacatcaccacccccaagaaagcccacggcccctctctaatgggcactcaagccccgctacaatccgaaacttggccaaaaacctgtcaccctcacat

SEQ ID NO: 10403 - DNA, 919 bp, Zea mays
  misc_feature: Ceres CLONE 1164555-R2
  misc_feature (654)..(654): n is a, c, t, g, unknown, or other
ccctacccccccccacttcccccctcccttgtgtgcacctcgcactctccacccaaactctatccttgatgtaaaaaaagggtctatggagagttaaatgaaatgaaacaagaacagcatgaacatgtcagatgcgagacctacacaagccaccaccaccgcaaccaggaagggctcgctccgctaacctaggcgcaagggcaaccacgaacgacgaaaacacacatccaaactgggtttgctgagccgcttcagcttcgtacttctcttctgcccagctgttcaagccgaagatgccacaccgaacccaggcaggagccatccactcttcttcgcgcgctgcacataggaaaggaacttctccctggcatcaggaatgtcgagagccagatcgtcgagcccatccctgacccttgagaaccccttggtcatctggttgatggttatgatcccttcaccaaagcactcctgcagcaggttcagggtcctctcgttcttcttctccattgccatcacgagcgccttcttgacaacttcatggttgaagaaagacatacccagctcacggatgcagttgcatgcctcccctatatcgcctccactctcatactcctccaggagctttgttatcttgtccttggcatcctccacagnccatccggttccaccgccccagcacctcagaagcctctcaccggcatgacgggccgacccaagggagcgtgccatgttcaatgtctcagccccactgcagtttgggggaagcttgctgctaacctccacccaggttagaggtgcgagaacgtcatcaatcacagcccctggctaggaaccagccccacttcatctggaggaacccaatatgtcccagggcggtggccttctgcagattccaggaagcatttacaatccccttgtg

SEQ ID NO: 10404 - DNA, 965 bp, Zea mays
  misc_feature: Ceres CLONE 1164555-R
  misc_feature: Translation starting site: 769
  misc_feature: Pfam Name: MA3 Pfam Description: MA3 domain
  misc_feature (6)..(6): n is a, c, t, g, unknown, or other
  misc_feature (20)..(20): n is a, c, t, g, unknown, or other
  misc_feature (21)..(21): n is a, c, t, g, unknown, or other
  misc_feature (42)..(42): n is a, c, t, g, unknown, or other
  misc_feature (43)..(43): n is a, c, t, g, unknown, or other
aaaaanaaaagaaggaaaannggcagcgagaaaccacaattnnaatctccattgcgtacccggccccccctcgagttttttttttttttttttttctcttctctgttttaccttgatgtaaaaaaaaagggcctatggagagttaaatgaaatgaaacaagaacagcatgaacatgtcagatgcgagacctacacaagccaccaccaccgcaaccaggaagggctcgctccgctaacctaggcgcaagggcaaccacgaacgacgaaaacacacatccaaactgggtttgctgagccgcttcagcttcgtacttctcttctgcccagctgttcaagccgaagatgccacaccgaacccaggcaggagccatccactcttcttcgcgcgctgcacataggaaaggaacttctccctggcatcaggaatgtcgagagccagatcgtcgagcccatccctgacccttgagaaccccttggtcatctggttgatggttatgatccccttcaccaaagcactcctgcagcaggttcagggccctctcgttcttctttctccattgccatcacgagcgtctttctttgacaaacttcatggttgaagaaagacataccccgcctcacggatgcagtcgcatgccctcccctatatcgcctccaactctcatactccctccaggaagcttttgttatctttgtccttgggcatcctcccccagcccatccggtatcccactgccccagaaacctcaataaatcttctcaacggaaatgacgcccaccgaccaaagggaagggtggccaggtgccaatgttttcaccccccactggaatatttggcgggaaccttcgctgccaaatcctcctcccaagttttaaaagtgggtgagtaccctcactacaaacaacagacccccgccaaaaaaacaccgaccccaactcacacttggacgcatcccaatttgtcc

SEQ ID NO: 10405 - DNA, 843 bp, Zea mays
  misc_feature: Ceres CLONE 1164778-R
  misc_feature (19)..(19): n is a, c, t, g, unknown, or other
gtggtttttgttttttttnaaacaacacacacccacaccacaccttaaataaaaaatacaattgagaatcgggacccccctcgcaggcccggccttgacctggaacaccagattgcccccattgtccatcgattcctggaaaaatctccgagacaagtttctgctcaacttccaagggtaccgacccgacaccgatgcattggccgaactatcactctacaaacaactagagaaggaaaccttacggcagtactaccgcaagttcctaaatctcaagtcacaactgccttctgtcgacgaccacctcaccataaactaccccatcggtgagcctctccgccctggtgacctataaagccactggcatcagaggatccaaccaaaaatctcacacagcacaaaccaacatgataaaaaaaaaatgaccaaatccggaacaatggtccatcccccgcaaaggccccacttctaaataaaaaacccccacaagtaccccttctcgccacccccacgccccccaaccctcgggaaccaaggcccatttccccacaccccaaaatctctggagacggagcaccacacccccgcacaaccacgccaggccaccctgcctccccaccattatcaccaaacacaatccacctccccggacggggtggagacgtcggatttccaccacttaatatgaaatcacacccccccccaagcgcccccggccgttaaaatcgcccccctgaccaaaccccctccggcccccgcgcaagcggccacacacacaaaaacacgaagccaaaaatcattaaccgggcaatagatattcaaacggccgtaaacaatctttgg

SEQ ID NO: 10406 - DNA, 811 bp, Zea mays
  misc_feature: Ceres CLONE 1164778-R3
ccgattgggtatcgggccccccctcgagggcccggccttgacctggtacaccagattgcccccattgtccatcgattcctggaaaaatctccgagacaagtttctgctcaacttccaagggtaccgacccgacaccgatgcattggccgagctatcactctacaaacaacaagagaaggaaaccttacgggagtactaccgcaagttcctaactctcaagtcacaactgccttcggtcgacgaccacatcaccatacactacgccatcggtggccttcgggctggtgtcttatacagtcactgcatcagggatccacccaaaaatctccaagagctctatcagctgttcgagaagtatgccagatccgaagagctccatcagcgcaaggtcgagtctcagagaaagcccaaggaccctctgcagtccagccgaacctggacaaggccttcgcagtcagactctggacgggacagccacagtcagcagcagatgcacaacatagccaaccagcaccccgccggcgaggccgttcgccgtcaagaatatccccccaggtccgcgggaaatggcatgcgaagccggggccggggacgggcgcagcaaccgcgccaaatatttactgcctggttttatgggggaagactgcgcgcatactacaaaggggattgccccgaaaacaaaagaccacccggagaacggaatggtctcggggggacaaacaagcccgaaaaacccagaaaaggttgttccgggcacaccattattaaccacccaccaaccccaaaacccctttacaaaatattggggccc

SEQ ID NO: 10407 - DNA, 1047 bp, Zea mays
  misc_feature: Ceres CLONE 1164778-R2
  misc_feature: Pfam Name: Retrotrans_gag Pfam Description: Retrotransposon gag protein
  misc_feature (16)..(16): n is a, c, t, g, unknown, or other
  misc_feature (29)..(29): n is a, c, t, g, unknown, or other
ccctccataaataacnaccccacctctcnttattctttcccaccccaccccccccacatgactatcgggccccccctcgagggcccgtccttgacctggtacaccagattgcccccattgtccatcgattcctggaaaaatctccgagacaagtttctgctcaacttccaagggtaccgacccgacaccgatgcattggccgagctatcactctacaaacaacaagagaaggaaaccttacgggagtactaccgcaagttcctaactctcaagtcacaactgccttcggtcgacgaccacatcaccatacactacgccatccgtggccttcgggatggtgtcttatacagtcactgcatcagggatccacccaaaaatctccaagagctctatcagctgttcgagaagtatgccagatccgaagagctccatcaacgcaaggtcgagtctcagacaaagcccaaggattctctgcagtcccgcccgaacccggacaaggccttcgctactctgactcttggacgcggacagccaccagttcagcgatcatatgccaaaccatagccaaccccgccacccccgcctgctcaggacagttccctccgtccatgaattatccccccctttgctcgccgttaaatggaccatgttaaaatcccggggtttcgagtaacggtccgccaccaaacccgcatcaagaatactttacttgccccacgttttttatggagaaaagaaactgtgtcgttattacccataatgcgggaattggcccctacgaaaccttctcacaccaccgccgtagtccgatattggtcatctggggcacaactcccacgcctcacataccacttaacaagttctcccctttctgcccgttattatacccctcacccctgccccaaataccttctttatcaaacggcccctcgccccacataaaccttcctttgcccaaattcacctgctgattcatgaactcacccaggcacgcgtacaatgtgcggaaccacattcctggttcccgaggcaccccaaacccactcc

SEQ ID NO: 10408 - DNA, 801 bp, Zea mays
  misc_feature: Ceres CLONE 1165010-R
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (29)..(29): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (44)..(44): n is a, c, t, g, unknown, or other
  misc_feature (45)..(45): n is a, c, t, g, unknown, or other
  misc_feature (55)..(55): n is a, c, t, g, unknown, or other
  misc_feature (65)..(65): n is a, c, t, g, unknown, or other
tttttgtgtttnnnnnnnnnnnntnnntntnnnnnttccgtctnngccgccgccnaccccccccntataaacgaattgggtaccgggccccccctcgagtttttttttttttttttttccacaaatccctttccagcaagagaaaaacagggtacaaaactttggactgttgaaagcagttcgccagcgtacaactcatgctgtacataacatagctaaccagctacacatgtgaactgaccatcagacccaccaccaccaaccccgccaggagccaacagaacaaaaaaaggagattaaggagtccaatgtttgtccttaggtcaaataagtggggcttctaggcatgctaagtgagtgagagagagagagagagagatcaaagaagaattcttggctcatggaggtggcagctggggccttaaatacagactataaacatgtatacagctatgctctacaagattccattggttgaacagcctgttgaagatcaccacgtcacataccattaggaaaggttagtgcaggggggagaagattattcatggtcctgcatcgttgtcaagacagttcgacgtccctcctcggcatcgggggtctttcctccgtcggcaatccgtccgtgcccatccgaaaaaacccgaaagattgcactcctttggggggccagcaaaaatcccccaaaatcgtcctgaaacctgcccctggggtttccattggggggggaaacccaaaggaaaaggggggtttttgggcggccaaaggggggttttcaccggggaaattctccgggaattt

SEQ ID NO: 10409 - DNA, 855 bp, Zea mays
  misc_feature: Ceres CLONE 1165128-R
cgattgggtaccgggccccccctcgagcttgtaccccggtattgtaataaatttatctaaactctgtactatttgaagtaaggaatgtgtttactagcctcttgggactagtaattgtttcacatttgagtcccaaaggatcgggacgcttcaggtggtatcggagcccataggattggccgtaggtcgcagccctgaccctaaaacttaccttagaaagaaaataccccttacctcaggaaaagttttctcttcccttccccggttttaacaagacccttcttttcctattccagatggaagacactctggccattaagtcatcctactgctcagaagtggaagggttcccccgcctcttgcgaagctgtcgctccgcatgggaatccgcaagaagccggaatacgtctggacggaacatttcgagggcggaatgataagatgctctatggcagtctacctgggggaaagccaaagctatcccaaccaacgttccttccaagtcacttttaccggagtccatttcctagatgcttgccaaaatgtcgcccgaaaagccctccgacagctatgccagaactacaacaaagtaatcattgaaacccctcttcgctactttccacccagcaacaagaatacccccacctggaggaaaagacttcaggccctatcaggaggagatcctattgagaatgatcccaccattgtctacatggctggataccttcatacccttgataccaatatgatgacctcgccctccactgcacctccctaaactcccaagtggggaagcctggagcagaaagtcaggggactttcagaaagaaaagcgtccctccaagagagcttctc

SEQ ID NO: 10410 - DNA, 896 bp, Zea mays
  misc_feature: Ceres CLONE 1165148-R
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
nnnnnnnnnnnnnnnnnnntttattttttatatttaacaattcttataataccgcaatgaatgcactgccccttaccaaccgtcaaataaacgttcttttgtaaaaataaagggcctcattttgtctctctccagggccacaaaaaaggcaataaggtttacagttgcttacccttagaaacaaaacaaacaggcacaaggcatataaccctcctttccgttctcacaaccagttcctgctggcattcatggccgcccggacaaaaccttcccatgtcgaataaccactcaaaaatacatccgccaatgcccccatcacatcaaaggcctcctgcaaatcacctgacaaggccatgcctccaacccatgaaaccaggtccttgaacagccccaccatctcctccatgttgcccagtttctctttcttctgaatcccccattgttgaaggttgcccaaggattcttctttctcatccgccttgatcaagctgaacgatttgcccttcttgaagaactgttgaacctgctcaaccaagccgttgaacaccagcatcggttggactatggcaaaaagcttcttgtgtgcccttgaatcaaagaatgaattttctcctgcccaaactgttgatgataacaagtccaatgcccgtttgagggtcaaccgcccggaccaatgttgcatgtaggaatggcaaacgcccccttgaaaaaacacaggccgttgtcgccaccccaccccccccatgaccccgcaagaaatgaaataaaccttcatgaatttgaaaccgtctccttcaaaggaaccttgaaaccaccaccggtaacccaaagaaaaaaatgcctgaaacccccataaaggaaatatcccgtggttggggaaacccccaccaacttcc

SEQ ID NO: 10411 - DNA, 2563 bp, Zea mays
  misc_feature: Ceres CLONE 1165199
  misc_feature: Encodes the peptide sequence at SEQ ID NO. 10412
accgaccccgaccccgatccccgccggtgcttcgccaccccgatccccaccgcgcgatggcggagccggctccggctcccccggtgaccgcgccgctggtggggctgctgtacgacgagcggatgtgcgcgcacgcgacgcccgacgggaaggaacacccggagaaccccgagcggctgcgctccatctggcgcaagctcaacgccgcgggcgtcgcgtccaggtgtgtggcccttaaggcaaaggaagctgaggacaagtatatagcttctgttcacagcaagagacatataaagctgatgaaggaaattagctcaacaatatatgatgccagcaggaacaagattgctaggaaattcaattccatttacttcaataagggttcctcggaatctgctgttcttgcagctggttctgtcatagaggtagctgagaaagttgctgcaggtgagttaagttctgctattgctctagtcagacctccaggccaccatgcagaacatgatgaggctatgggattttgcctcttcaacaatgtggcggttgcagctaattatctcttaaacgagaggcctgatttaggtatcaagaagatattgattgtcgattgggatgttcaccatggaaatggcacacagaaaatgttttacgatgatcctcgtgtattgttcttctcagttcacagatttgattatggaagcttctatcctgctgaaggggatgcttctcattgtttcatcggggaagaagctggtaaagggtataacatcaatgttccctgggagcatggcaagtgtggtgatgctgattatattgctgcatgggaccatgtactgcttcctgtcactaaagtttttgatcctgatataattctggtatcagcggggtttgatgcagcattgggtgatcctctcggtgggtgctgcattacaccaaatggatatgcactgctactaacaaagttgttaggatttgctcaaggaaggatagtgatggcccttgaaggaggttataaccttaggtccatagcgaactcagtttatgcttgtgcaaaagttctcttgggagacaaattcacattcaacactccagagatgcaaccatttgaatctacatggagagtaatacaagcggtacgcaatgaattgaagacatgctggcctgttctgagtagcaagttgccagaaaatgtatcattgaggattaagcctgcaccaagcgagctctacgcttcttctgattccgaatctgatagtgaagatgttgatgagctccttggcactgttgcatctgtcaatgttattgaagctactggtgttgctataagtgaacacctctcaaagatgaaacttgatgatgacagccttgcagtgaagactaactcaagttgctcagcagcagaacagcatccagttgattcagtaaaagtacataacaatgcatctgttgtgctgaccaaaaaaatatctgatttatctcttgagtggcgatcagatttatcgaaaactgatgtctggtatgccagttttggatcaaacatgtggagaccaagatttctatgctatattcaaggagggaaggctgagggtatgaatataccatgctgcggatcacgtgacacaagctcaccaaagggaaccgtgtggaagactgtacctcacaggttgcttttcggtagatcgtctaccccttgttggggaactggtggtgtggcttttctcaaccctgagataaactacaatgagaagttgtatgtctgcatgtacaaaataacgttggagcagttcaatgacatcttgtttcaggagaatcgtttagtgctggaggatggcaaagacggaaacactgtgtatcctgactctcctttgattggttcatctgaaatcaagtttatatctacaaacagagctgttcatcttgaacctattaaggatagctggtactccaatgtactttatcttgggaatgaggatgaagttccaattctaactatgacgtgccccgcatcagatattgagaggtataaatctggtgagctgcgtttagcacctccatcagagacgtatgcggccactctgataaagggactagtggaaggcaagcaaatggatgcggacggagctgccagctacatcaacgctgctgctgcaagagccttgtgaaggctgcttcagcgtgtgcttttgtacagccagtaaggagtagtaaggatacactatctgttagcgtggcgacaccaggaaaccttcattgtccgcaaatggagaacttggatccaatttgaattgggcagcatgattcgagctcgccctagcttgattactggtgaacggtgatctcccctggctggttgattctgggagaaacactagctgtgtcggggtggagcaacactagttggcggttgcaacaggtgctctcactgcactggtatcgtgcttgtctgacataccgtagtatttgcatggcatgctggtgatgttatttgtgcaattactgcattatgttcaaaaaaaaaaaaaaaaaaaaaaaaaaaaaaaaaagaaaaaaaaaaaaaaaaaaa

SEQ ID NO: 10412 - protein, 701 aa, Zea mays
  misc_feature: Ceres CLONE 1165199
  misc_feature (14)..(337): Pfam Name: Hist_deacetyl Pfam Description: Histone deacetylase domain
MAEPAPAPPVTAPLVGLLYDERMCAHATPDGKEHPENPERLRSIWRKLNAAGVASRCVALKAKEAEDKYIASVHSKRHIKLMKEISSTIYDASRNKIARKFNSIYFNKGSSESAVLAAGSVIEVAEKVAAGELSSAIALVRPPGHHAEHDEAMGFCLFNNVAVAANYLLNERPDLGIKKILIVDWDVHHGNGTQKMFYDDPRVLFFSVHRFDYGSFYPAEGDASHCFIGEEAGKGYNINVPWEHGKCGDADYIAAWDHVLLPVTKVFDPDIILVSAGFDAALGDPLGGCCITPNGYALLLTKLLGFAQGRIVMALEGGYNLRSIANSVYACAKVLLGDKFTFNTPEMQPFESTWRVIQAVRNELKTCWPVLSSKLPENVSLRIKPAPSELYASSDSESDSEDVDELLGTVASVNVIEATGVAISEHLSKMKLDDDSLAVKTNSSCSAAEQHPVDSVKVHNNASVVLTKKISDLSLEWRSDLSKTDVWYASFGSNMWRPRFLCYIQGGKAEGMNIPCCGSRDTSSPKGTVWKTVPHRLLFGRSSTPCWGTGGVAFLNPEINYNEKLYVCMYKITLEQFNDILFQENRLVLEDGKDGNTVYPDSPLIGSSEIKFISTNRAVHLEPIKDSWYSNVLYLGNEDEVPILTMTCPASDIERYKSGELRLAPPSETYAATLIKGLVEGKQMDADGAASYINAAAARAL

SEQ ID NO: 10413 - DNA, 919 bp, Zea mays
  misc_feature: Ceres CLONE 1165577-R
  misc_feature: Pfam Name: Glycos_transf_1 Pfam Description: Glycosyl transferases group 1
  misc_feature: Pfam Name: TMEM14 Pfam Description: Transmembrane proteins 14C
  misc_feature: SWISSPROT Homolog: EC 2.4.1.13 Sucrose synthase
  misc_feature (34)..(34): n is a, c, t, g, unknown, or other
  misc_feature (49)..(49): n is a, c, t, g, unknown, or other
atccccatttcaacctttctaccataatacttanccctcctcctttatntcgattgggtaccgggccccccctcgagtctttttgctgttgttactaggcgcgaatgctatctgatattacccataagacgaactaacctgagggaacagccaacagagcatccacccagggataaaaagagaataattcccttaaagacaccaaaggcgaccaaaactggatgaaaaaacaaaaaaaaaaatgccgaggcatcaacctccgaccatgaccagggatacatgggacgcacacaccaggtggtaacatcttcccggacttcttgaagcgcgaccccatcaccgagcagaagcgcggccagatatacctaaaccaatcgaccatgcaaagacatggtctaacaggtacttgagtgcgtaccaaccacatgaccaagggtgaagatttctggattccactcttcatatatcccaccatatgaatgcccgtgcgttgcaacggaaacacataataccacggtacgttacgggccctggttgactgggcagagatccagcagaactgcctgaacaatttgtgcgtcttgatgaggtcatgcatcttctctatctccgcgatctcttccctgtcctaggacttcttgacatcattgaacccgggcacgacaacaagatttgccacctccctcaacttaacgcactttaacaaagctttggaccaaacccggataatgcctttcacccctttgaaggctttgcacaatgaaaaaaaaagtggggggttttgacacgggccccccctatatcccccaagggggattcctctcccttttccccccccgcgataaataataaaaatttttctcccacgaaaaaaaaggggaggggggggggttccttgggcgcctccccccccagaatg

SEQ ID NO: 10414 - DNA, 843 bp, Zea mays
  misc_feature: Ceres CLONE 1165871-R
  misc_feature: Pfam Name: RVP Pfam Description: Retroviral aspartyl protease
cgaggaccggatcatccgtaatactatcttttcgctgtggtagatgttcggtcttaaagtccgaactattttgtgaaagaccggaccatccgactttgagagccgaattgtccgtgattaacaactcatgaactctgtgtgtattcatcatttaaactttatttaggatttagccgattctccatcggctctagcattacaggaatgaaacctttcttatctatacttatgaactgataatcagaaaaatctactcctgtgagacatgtagcagtctcataagtccagagtacaggggcatcggccacagcgatgcaggccgatacatcagcatgtacttgttctatgtcatcacctacccattgtattagcatttgatgtaatgtagaaggtatacattgattggcgtgaatccaatctctgcctaggattaaactgtaatttccttctacatcagcgacgaagaatgcagcagcaagggtcttagtcccgatggttaattcaacggacgtgactcccctggctttgatcgaactatctccaacaccgctgagggtcatgttggttttgacaagttcgtcatcttgcttacctaattttctgtataatgaataaggcattagatttatagccgcccctccatctaccaacatcttagcaatcgatattccatccatgtgaccgcgcacgaagagcggctttaaatgatttaccgattcctttgggttagtaaaagcggcttccttaaggaccaaaaccaattgggcaaaaacaggttcatcgtcgccgataatagaacaaccgccggaaaatgtatgaccttcatatcaatacctaggcgtt

SEQ ID NO: 10415 - DNA, 682 bp, Zea mays
  misc_feature: Ceres CLONE 1165886-R
cgaattgggtaccgggccccccctcgagtttttttttttttttttttttttttttttttttttttttttttttttggggaacagggattttacaatagatcaagtttgctaattaataaaacattcttctttttgaatcttgggctaatcaaaaatctttagtagtgtaacaagtggctacaatcatgttccttctgtcttgcactcgatcaactgtaactatgtgccaagggacctttattttcataatggcttctagccttaaaaaccactactctgggagtgcagggaacactagaaagggcccaaagggggatatcaccccgagaagctgcccccaattcagcaccatgaacaccacttgatcccctgggaagaaaacaacatcttgacatttttgtgcccatgaaaataaagcccctgcacctactggagcaattgacttgaaaaatgacattgcaggtgtcgaaaaaccatttggggtgcctctttgttcttgggacacagcatttttctgtaaaaatgaaattcctggggggacagggatcgcaaaaacacttctcatcctggctgcggaacaaatagccaaggaaaatttcactcccgataggcatgtcctaaagggataagttgcaagaacaaatatggacacagcaaatgcaattcgtggctgagttgactg

SEQ ID NO: 10416 - DNA, 872 bp, Zea mays
  misc_feature: Ceres CLONE 1166473-R
  misc_feature (691)..(691): n is a, c, t, g, unknown, or other
  misc_feature (722)..(722): n is a, c, t, g, unknown, or other
  misc_feature (814)..(814): n is a, c, t, g, unknown, or other
cgattgggtaccgggccccccctcgagcttaaccactcgctcggcgctacaacgagactgcggacgagctggcaaaaatagcctcggggcgaacaacggttcccccggacgtcttctcccgggatctgcatcaaccctccgtcaagatcgacgacacgcccgagcctgaggcgccctcggtccagcccgaggtaccctcgacatagcccgaggcaccctcagctcggcccgaggcgccctcggttcagcccgaggcgccctcggttcagcccgaggtaccctcgacctccgagggcgaggcactgcgcatcgaggaggagcggagcggggccactgaaagggaattaggcttacatgtagtccctaattattttggtggttgaattgcccaacacaaacaattggactaactagtttgcccaagtgtatagactatacaggtgtaaaaggttcacactcagccaataaaaagaccaagtttttggattcaacaaaggagcaaagtggcaaccgaaggcacccctggtctggcgcaccggactgtccggtgtgccaccggacatgtccggtgcaccagggggactcagactcgaactcgccaccttcgggaatttccagaggcgactccgctataattcaccggactgtccggtgtacaccggacagtgtccggtgcgccaaggaggtcggnctcaggaactcgccagcttcggaaaactccnacggctagtccactataattcaccggactgtccggtgtgcaccgcactgtccggtgcgactccggagcaacggtcatctccgcgccaacggntctctggcgcgcatttaatgcgcgctctgcgcgcgcagatgccaggcgcgcccactcc

SEQ ID NO: 10417 - DNA, 783 bp, Zea mays
  misc_feature: Ceres CLONE 1166682-R
ctgtaccccccctggcatcgtccacccaccgtcccggtttatcctcaattgggtacggagcccccccactgtccgatcaccggtgcaccaccggactgtccggtggccccacctgttagagctccaacggtcgaaccctaacggttgggtgacgtggctggcgcaccggactgtttggtgcgcccatcgacatcagcccctcccaacgggcattttggtgacctctccacctactctccccacccacccctacccgccgctctcacgccgtctttggcccctcctctcacgatcttcaccgctcccccccctgccgccgttcttccgttcagtcccgtccctctaacctccctctcgtggctcgttactacccacttagctcctcaactacactctgctagacacggctcgtcaacccgcctggcaaatacactccaatccctccgcctccatcatttgcttttctctcccgtccgcgctcgttctttcgccccttcctcacgggccggttccttcacttccacatctcatctcccacccgctctatgcctcgttgctctgttcctccacgacatcccttcccgcgcctactcactccatacaagtcacctaacagaatgtcgcccgacactgtctcctcgccacactcaccgctatacacagcgtctcgcgaccgcaccctgccccttcgtgtcctattcacttaccgcctgcctttacggcctaccactcctcgattctaacactccagctagtagccgtaccgctctcatcctgccttaa

SEQ ID NO: 10418 - DNA, 569 bp, Zea mays
  misc_feature: Ceres CLONE 1166816-R
ctcgagcagcggtgatgtagacggccagccagcctcctggatcctgcttaggttcatatttgtcgacatttgataccttgaagttagggggccattgaatggccctaaggcgtggagtaagggcagacactccacacgtgtcttcttgtcgtcggggatgatgtctgtcccggggaggggagtagttgttgtggttcctcgaccgtccccgggtagtaccgccagtcgaggccattgccgactccgttctggtggcctgactccgagctgggatgccatgatccctgtcgtactcctcccggggtcggatctcgttctcatgtcgtcgttcacgcgaagcgtttatggagcttcacgtgtcccgacggctgttgatggcgtgtcgtatgtcgttcggcgggtgagcgataggtagaagatggttggctgcttgggtgaacagtcgtcgatagccctcggcgtcgggattccgaggtagtccatcagctatcggagctagtacccctccgacttcgctcggcgtgtttcgtgctcggtcgaagtcggggggtgggggggcagcccggaga

SEQ ID NO: 10419 - DNA, 831 bp, Zea mays
  misc_feature: Ceres CLONE 1167286-R2
  misc_feature (185)..(185): n is a, c, t, g, unknown, or other
tttttttcgattggtacgggcccccctcagatttacgggatagagatatagtataagaaataggctattaagtaactctaaatgaattgtggatacatctgtatccttaacatactgaaacgactgccattattcgtatcaaaccaatagcgattcataaaagctaaatcttgtaatcaatggtngggccaataatgaatttttttttgcttatgttattaagacgctttgggtcttgattttcgaaaatttgtccaaaaggttttgttaatgttggatttttccattggcaaaaaatgaataggaattctccccttcccgttaaacttttcccaatttccgaagtaccaaaaaaatttgaaaaagaaaattgaaaaaatttctccaatttcttcctaacggggggttctttaggggaaaaaaggggaattccaaaaattttttttttttccgggggaaacccaaaaaaaaaaaaattcctatgaaaagaaaaaaattgggcgcccccccccccccctatttttatccaattaaacccaaattttttccccagagggtgttttttttttagaaaaatttttttttaaaaaaaaaaaaagttaatcccacattttaattacatataacctttttttaaaaagaggcgccctaatatatggaccccgttataaaaataaatttttattggcgaattcttcagagaaaaaatatcctcctcttctttttttcttccccccaaaaaaaaaaaaaaaaaattgtggggggaaaaaaaaaaaaccaatttggggtttgtgctcttttatatgttgggggtgaaaaaaacaatggggg

SEQ ID NO: 10420 - DNA, 556 bp, Zea mays
  misc_feature: Ceres CLONE 1167286-R
tcgagatatagtataagaaattggctattaagtaactctaaatgaattgtggatacatctgtatccttaacatactgaaacgactgccattattcgtatcaaaccaatagcgattcataaaagctaaatcttgtaatcaatggtgggccaataatgaatttttttgcatatgtattaagacgcttggtctgatttcgaaattgtccagagttttttatgttgttttcattgcaaaatgatggatctccttccgtaactttccaattacgagtacgagaattgaaagacatgaaaattctcaattctctacggcgtctaggagatggatctaatattttcaggaacaagaaaaccagaagaatctttttctctattcactaccattccgcgacttcgacttctattagtttcttttctccgttaaggcaatagctatagttcgatatagaatccctttctcaaagtaatggaaaccattcccttataggaaatggtccgaacatcgctattccaccttttaggtttaggtatcccgaaaagtgacacctgtgaagaa

SEQ ID NO: 10421 - DNA, 596 bp, Zea mays
  misc_feature: Ceres CLONE 1167296-R
  misc_feature: Encodes the peptide sequence at SEQ ID NO. 10422
  misc_feature (571)..(571): n is a, c, t, g, unknown, or other
caattgggtaccgggccccccctcgagctcgtgcagtccgcggtcatggtggccacgcacgacgacggcggcgcgcacggcgacgccgggggaggtgggagcgacggcggcagcttcccgaggggcggcgacgccgccgacgacagcttggtgagcctcaccatgaactccacgctcatgtaccagggccaggagatggcggcggcgctggccggcgacgccaggaaagggagcggcggcggccgagggagtccgtccagcttgtacttccccaatggcttcgcatgagtatttaatctccttcatcaagcaagagcaatgcattttcgtttctctctacatatatccatccgaagatgatccttttctctacctcgcgctagctctttcaacactctccgtgggattggatctttaatttgcattgcgatgtgaggacgatggtcgtgtatctagctatagcttgctactgttcaacgagctaggagagagagatgagctagcagtactagcactgcaaggatttcatgatattttatgtggattaattgttcgatgcacatcttacaantaatgattgatcgattgggcatcat

SEQ ID NO: 10422 - protein, 95 aa, Zea mays
  misc_feature: Ceres CLONE 1167296-R
QLGTGPPLELVQSAVMVATHDDGGAHGDAGGGGSDGGSFPRGGDAADDSLVSLTMNSTLMYQGQEMAAALAGDARKGSGGGRGSPSSLYFPNGFA

SEQ ID NO: 10423 - DNA, 675 bp, Zea mays
  misc_feature: Ceres CLONE 1167544-R
caattgggtaccgggccccccctcgagttttttttttttttttttttagtccaagatactcatatacgagatgacagaaaggatcccaactccaaacacacagccaaatccccaaaatgagcacatgcacaccagccaacaaccttgctaccatagtccaaagtcacccaccatcgtatagatagatatatacacacacagctgaggcatacccccttcccagactacgcgggcaagtttgtcacaggaccatgtagttcccgtttttcttgtaaattgtgaattcagattcaaggccctccaatatctccaggaccgattctctcttggatcccttgaagtgcttggcaacatcctccagcgataccccattgcagctcgcaaccagatctagcacagaatctacagtagcagtcgccgtgccagttaactcagctccatgctcgtatgtcctttgcagttttgttgctggctcctcagcacaaacagtttgacctctctttgctgaagggtttgcatcactggcctctgccgctgctgggacaccatttccgcctgcttcacttgcatggcaggaagatattgtgactctgctattctactagagacaccgtcagcggtaccgttaccaaagacttgctctgacaatccacacccctcaatagtcaggaatgg

SEQ ID NO: 10424 - DNA, 590 bp, Zea mays
  misc_feature: Ceres CLONE 1167707-R
  misc_feature: Encodes the peptide sequence at SEQ ID NO. 10425
cgattgggtaccgggccccccctcgagcggcggcgccggtgtcggcgtgggcggcatgcaccactcccgggagtcctcgacggggcggctcctcttctccgaccagctccgctccggcggcgacgtcgccgcggtggtgagcgtcccctggcgccggctcgggaacggcagcggcgcgggcagcgtcggggacgaggacgacgacggcgcgtccctgcgcggcgggtcgttcgcggagtcgccgtggtggtgctacgcgctcggcgcgttcgcgttcgtcgccgtgttcgccttcttcctgatcgtgctgtggggcgccagcaggtcgtacaagccccacgtcgtcgtcaaggtccgaccctcgatcttatggcacttaagcctagtctcctgtagccagctcacgttgcctcgtttgttctgtggtcactgggaaacccataaaactacctggcggggagggacaagcacaacgcatcgtcttcaaggtctcgggtttggcttcattttcaaaacgagctccagattgaggagtgttccttttttcctatggctgtatagcagcaggagcactgttctggtcttcagtg

SEQ ID NO: 10425 - protein, 196 aa, Zea mays
  misc_feature: Ceres CLONE 1167707-R
DWVPGPPSSGGAGVGVGGMHHSRESSTGRLLFSDQLRSGGDVAAVVSVPWRRLGNGSGAGSVGDEDDDGASLRGGSFAESPWWCYALGAFAFVAVFAFFLIVLWGASRSYKPHVVVKVRPSILWHLSLVSCSQLTLPRLFCGHWETHKTTWRGGTSTTHRLQGLGFGFIFKTSSRLRSVPFFLWLYSSRSTVLVFS

SEQ ID NO: 10426 - DNA, 590 bp, Zea mays
  misc_feature: Ceres CLONE 1167760-R
  misc_feature: Encodes the peptide sequence at SEQ ID NO. 10427
  misc_feature (554)..(554): n is a, c, t, g, unknown, or other
cgattgggtaccgggccccccctcgagcaccaagaatctgctcagtctgggagcaccggacagtgtccggtgcgccaggctgattcgagcgaagtggccactctcgggaattcaccggcgacatacggttataattcaccagactgtccggtgtgcaccggactgtccggtgagccaacggtcggccgggccaacggtcggtcgcgcgatctgcgcgggacacgtggccgaggcaacggctagaagggggcaccggactgtccagtgtgcaccggacatgtccggtgcgccaacgggtctctggctgccaacggtcggctgcgccagttaaggaaagaaatcgggcaccggacagtgtccggtgtgcaccggattgtccggtgcgccagtcgacagaaggcaagatcagccttcctatattgctctcaacggctcctagctgccttggggctagaaaaggaacccctatgggcgtggaggagcacgccaggcattcctacaacattcctaagcaccaggacgtctattcgccgcctcggattcgtggtgataanaattatagctccagatggaggagggaaggccgtgag

SEQ ID NO: 10427 - protein, 109 aa, Zea mays
  misc_feature: Ceres CLONE 1167760-R
DWVPGPPSSTKNLLSLGAPDSVRCARLIRAKWPLSGIHRRHTVIIHQTVRCAPDCPVSQRSAGPTVGRAICAGHVAEATARRGHRTVQCAPDMSGAPTGLWLPTVGCAS

SEQ ID NO: 10428 - DNA, 583 bp, Zea mays
  misc_feature: Ceres CLONE 1167776-R
gcaactaatttattgccaaatacctataacgaattcagtatttcacacacaacacaacctcttacattcgcgctccgcggagagcaaataaaatggttcagattttatctgcccaatctatctcagatctggcaacttgtacagctgtcctgtttaaaccgcgtcccaggctgcagcatgcatagtatgcaaacatttggaaaccttcctactctgacgaaagaacaatctatccatgtacactgaaattacagattagctattacaactacatcagacttgattattgtccactggtatcgcaatcatacaatgttgcttgagatctgaaatgctgattatgcagctccccagttaggagctgaagtcacgggaggacgcaactacggttaaaaaccgatggcatcacaaaggattaccagggaactgatcgcaagtggatccctgatgtcctgttgggtgattggccctcttggctataccctatggaccttgaaactggtaaagagatttctgatcgcaaccgacataatccggcagatggcgggggcttcggcccgccccggatcacgtgcgggcgaga

SEQ ID NO: 10429 - DNA, 891 bp, Zea mays
  misc_feature: Ceres CLONE 1167784-R
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (825)..(825): n is a, c, t, g, unknown, or other
  misc_feature (838)..(838): n is a, c, t, g, unknown, or other
  misc_feature (840)..(840): n is a, c, t, g, unknown, or other
  misc_feature (842)..(842): n is a, c, t, g, unknown, or other
  misc_feature (843)..(843): n is a, c, t, g, unknown, or other
  misc_feature (844)..(844): n is a, c, t, g, unknown, or other
  misc_feature (845)..(845): n is a, c, t, g, unknown, or other
  misc_feature (846)..(846): n is a, c, t, g, unknown, or other
  misc_feature (847)..(847): n is a, c, t, g, unknown, or other
  misc_feature (848)..(848): n is a, c, t, g, unknown, or other
aagactgcatttgtgatacatctgttgtaatctctgtgtctacaaagaatggatcatatcatgacggtataacactctggcaaaaactgttctccaagaataaagaactaatgagttgggagccgggaggaagactatggggacatacattgaacacgataaattactatgagggcagtggcattctataaacatcgctgagggcggtgtacccatgactcagctccaaggcatcacagatgctgcagttgtaccggaatcttcaggcccggatcctaataagcacggacttcacgatttacatataaacaggaagagaaaaaagcttgtcggatttgacagcacaaggcaaagaatccggtaggactcaaacagatgtgtaaatggcaaattgcttcagaaggatgtcaagcggttcaagagtaaacttcctagcgaaaagatagcacggtctctttgatccattccacaaacacgggttctgcatcacaagtttcttgacatcacttgctacatggaaggtctcatcaactgctgtgatgctcgtcaagagatcataggtgacgtcatgagcgctataagaccttgggatgccattttccctcataccaatccacgtgtgtaacagaccacttagagatcccaccaggatctaccatattgaacagggccggccaataatgctcatctgcaatacagttgcgcccttctgctcgtctgcagtatagcttcgacttcttgcagtactagnnnacagccagaatcctttaannnnnattctttggaactgaaaaccactgggtgccctctctaaaaccctcaccnctgattcccgatncntnnnnnnngagtgcctttcactgggaagggtgacatggaacctcgtaacca

SEQ ID NO: 10430 - DNA, 671 bp, Zea mays
  misc_feature: Ceres CLONE 1167824-R
  misc_feature: Pfam Name: Smr Pfam Description: Smr domain
  misc_feature (28)..(28): n is a, c, t, g, unknown, or other
  misc_feature (29)..(29): n is a, c, t, g, unknown, or other
cgattgggtaccgggccccccctcgagnntttttttttttttttttcttttttttttttttttttttttttttttttttttaaattttaagacgtatacatttggctgacaaaaagcctgacatgaatgttacatgagctatcttaagttcttaacgctactatcctgctagcaatctctgccatatacaaaagtacaggccaacttatcttttcttttctttttcccttctttttcatcggatccagttgggaacaacagctaggacgaccggttccattactaaagcaggatgcggagcaggcctggttgcacctgcgtgtacaaaaggccgtgttccatgaaatactgctcgacggcggcagtcagccttgctggggggcgggcgcttgatattatcataacctggagtcggcgaccggttgatctcacgatctttcttcgggtgttgagctcgaagttcaggacgtgtattgccctcgctggtgtgaaaaaccccccaaaaccgattgggggaattttggcccccgggaaggaggcctctgcaattgggggggggttggaaaacttttgggcaaaaaggtgtgtttttttctaaaccttcctccccgaacaaaaaaggggtttggaaaaagggaaaaacccccgcggcaaaaaaaatctcggtgccc

SEQ ID NO: 10431 - DNA, 796 bp, Zea mays
  misc_feature: Ceres CLONE 1167843-R
  misc_feature (39)..(39): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (54)..(54): n is a, c, t, g, unknown, or other
  misc_feature (55)..(55): n is a, c, t, g, unknown, or other
ggggttgttcccccccccccaccttctttttgtcggcgncannnncccaaatanncacgaatgggtaccgggccccccctcgagtttttttttttttttttttggaaaaaaccttaagtcattagatggaaaacaagattctggtcggaaactacaaaaaggatcgagcggaacaaacatattataaagatatgtaaaaatcaaagtgcggtttttttttttttcgatgtggtctcgctctattctctctaaaaagaagcagcagcagctggtgctttctcttcagcagaagtttcgaatgtctctccaacaagctctgggacatcgtcatccatcctcctttcttgaaggggtgcctgaaggcggcatttacccctttccaccagaaaagcccggttttccgggaaaatggcctccagcctaacccttccttttaaaggggtggtgcccccacgggtttctctccccgcccccccacgccctgcggcgcgtgggtggaaatctgcaaggaaaagaaataaccttcttgcaaacacctcctcctccccattgggagagagagaaacccgggttaaaaaaaccccccccgtggggttttttgccgccaaacatttggaaagcttttgaacaccccttagaggcgtgggaggtaagtcggggaaaaacaaaaacatttccttccccctaaaaaaaggcggcaacatctccccctcaaaaaaaccgccaaaaggagagcgaaaaaccccccacccctcccccccacaaaagggggcgtgcgggcgacccccctcctccc

SEQ ID NO: 10432 - DNA, 837 bp, Zea mays
  misc_feature: Ceres CLONE 1167972-R
tcgagtttttttttttttttttttctttttttatttttttttttttttttttttttttttttttttttttttttttttttttttttttttttttttgaaaaaaaggggcctccttcaacccccccttaggaaaaaacctctttttttgggggtacaaaaaatgggttgggggaaccccgaacttcccaactggtcagggaaaggggggtttattcccattcccccgggacaaacccccctttaagccctgtttggagggccctggaccggaccgggaatttggttaaatttcccctcaaatcccccccaaaccgaaaaattgggggccaaaccaaagcatggaaaaaattttccctcccaaaaaaaggccccccccatatcccccggggtctaaccactttgcttgaaatgggggccttccttttttctgagaaaatcccaacgcccccttattcttgaaaaattcccgggttccccccggtattgggggggggaataaagcccaacgatttcggacccaaaaaagtaaagggccgccaaaaacttggttcccgggtgaaaaccggggctatgtcaacagggacccggaggggccctcacccccccccaagccatttttaaggggggggacaaaggtcccccgggactggaaaaaaaaatgggccaaaaaggtttaccccccttcgccggattggccaaactcccccggtccaggtttttaaacgcccccccaccccttggaaaaacaactggaaaattttcccccaaagagggaaaaaaaagcgcccttttccatcaaaccagttaattaggggagttttgtcctttcccgcgagg

SEQ ID NO: 10433 - DNA, 855 bp, Zea mays
  misc_feature: Ceres CLONE 1168019-R2
  misc_feature (855)..(855): n is a, c, t, g, unknown, or other
cgagctaggctaaggataacctctatccacaagatctaagcaaggctaagcatttttgtaaatcatatttttgatacttcacagaagtatctataaaggtatggatatcaaggaaagcaatgcatcaaagggtttcaagcaactcctatgaacctaatgcacatttcactagacttaaagtgtgcgaaaattatttaaaaacacaaggaaaggggttgcatgcaccggggcttgccttcgttcgtaggtgagtcaggctcggactcgcagatgtcgaagtagagccaagtccctgtctgagattccaaaggtggtggtgtcttctcttgagtcacctcactctcttcttcgttttctaaatataaccatataggtatatatataagaatgaatgccatgtaatgctcatgagagtgcgaagataataaagatttattatctaagtcttgaatacaactttccttcacggaactccgagaacatagggtttccggagtcggtaaaggagttcaaagggcagggggtggttttgcgtcctaattatcaaacatggtccaaatccaattcaaaactctacccatggcttttaaataatgcattagagcttatgtaaaaaggttgaagcatttctgggattattacctattttccaaaaatccccaactaacactttaaactacttaaaaatggcttaaaaatccctaattttatcctaaaaatcatcgagacctattttcttttacattcctagcagaaaattaccaacccctacgcaaaaatggggtttcaccaatctttcaggattctttcccacacaatttttctaatagggttttcaaaagattcctggctgan

SEQ ID NO: 10434 - DNA, 844 bp, Zea mays
  misc_feature: Ceres CLONE 1168019-R
  misc_feature (13)..(13): n is a, c, t, g, unknown, or other
  misc_feature (14)..(14): n is a, c, t, g, unknown, or other
  misc_feature (16)..(16): n is a, c, t, g, unknown, or other
  misc_feature (17)..(17): n is a, c, t, g, unknown, or other
  misc_feature (38)..(38): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (47)..(47): n is a, c, t, g, unknown, or other
tttttttttttcnncnngaggggccatcactccccccnannnnnnanaagaaaaccgaatgtgtacagggccccccctcgagctaggctaaggataacctctatccacaagatctaagcaaggctaagcatttttgtaaatcatatttttgatacttcacagaagtatctataaaggcatggatatcaaggaaagcaatgcatcaaagggtttcaagcaactcctatgaacctaatgcacatttcactagacttaaagtgtgcgaaaattatttaaaaacacaaggaaaggggatgcatgcaccgggcgcttgccttcgttcgcaggtgagtcagcgctcggactcgcagatgtcgaagaagagccaagtccctggtctgaaaattcaaaaggcggcaggacgacttcctcctgaagccccctcaactcctccttctttcgttccccaaaacacaaacccccactaaggttcatatgtccacccccccccccaaaggcccatgctaattgccccaattgaaaagtagggcaccaccaaacaaagcatctcactctctcccaacaccttttggaaatacccatcttttcccttacaagggaaaatcccggacaaacccctaccgcgtctctcccgggaacatcgggcataacgggagctctcaaaacccctccacgcggcgccgagtttattggcgttctcccaaaacaaatccaggaaccgcgggccaccacacaccaaaattcctataagtttcttacccccgcgggcctctcttcccaacacaaccgcaccacacacaactcaaatgtgtcaagaaagcctccgcaccaccaccctcttatg

SEQ ID NO: 10435 - DNA, 839 bp, Zea mays
  misc_feature: Ceres CLONE 1168160-R
tcgagtttttttttttttttttttttttttttttttttttttttttttttttttttttggtaaaggcaggacattaacaaacttacagaactacccctaaacggggctatttcctcagcaatacaagaaacccacatattattcttaccaaaaaataaagaaacccctgcccttgaattaaaaaataggaaaggggacctttcgaccaacgcttcccagcacaaccccctttgatgccttcgcctattgaccacgggctgggctggttgacgtttggagtttttctcatttaccataatttgggtaaacccccctctggcataggggaacaaaagcaaaatcgttccagcattgctgccaaatccactaaactcaacctgaagcggcctttttgcggacgactctctttcgacgagggttaaacaacgttgtctcaggtccaccctggttgatgcctaaaaaaccaaggccagaaacaattgcatccttggatataaaccaccttgaatcttgttgggccatataaacccccacgggcctcttgtatgggctgagcagtcgatctgagtactgtggatcagcttcctcgccaagccatgctcgccttgatgcctcaccaatctgaatattcaacagtctgcaatatagaaacattgtggtagtgcccgaatacccctcctagaacaagagcagttctattattctttggaatataaaaatggcccgagtcataattgctgagcatggaaatgccaattaagattacccgaataatttgtccaagatgggaacccaagaacccccaattaggaggcccctgaaaatgtgaaaaacgtgaa

SEQ ID NO: 10436 - DNA, 861 bp, Zea mays
  misc_feature: Ceres CLONE 1168170-R
  misc_feature: Encodes the peptide sequence at SEQ ID NO. 10437
  misc_feature (782)..(782): n is a, c, t, g, unknown, or other
  misc_feature (823)..(823): n is a, c, t, g, unknown, or other
  misc_feature (848)..(848): n is a, c, t, g, unknown, or other
cgattgggtccgggccccccctcgagaggaaaggtgggaggagtaccatgtcatactcgatgctgagtgacatgaactctagactcctgaacctgatcaccgtcttaagcctgagcgggtgatgaaagcttgccatctagagtcttaacgggaactagaggtgtttcacgcgacagacacctacctagcgcggcaactatcagtgtttggactaagggttctaaccaactagtaaataatgtcacgtgtccagaatatagatggtgtgcgagttgatacaagcagtttatcctggttcgggcaatgcaaagccctacttccagctgagaggggatgaagcttatattactcacacctaggtgcctacagtagggattacaagcacaacatgagaggggaagtccctaagtctttagaactattgaggcaagtaccaatatcgaaagactcgatggaaaactactgagtgttcgcctgcccttggaagagttactactgccctatttatacacctaggagatgtatactggtgaagcctggtccatcgtattcctgaaagggaaatggggttaaccttttcctacaattaattttggtggttgaatgtccaacacaaacatatggactaactagttgctctagaactcatgtattacaagtgcataaggttcaacacaaaccaataaaagatccaagttagggactaaattgaaatggagaaaggacttgagtgtgctgtggtctggcgcaccggactgtccgatgtgccaccggacagtgtncggtgcacccaggccatacaggagcccagcagccactctcnggaaaacacaggcgcactccgatantattcaccggact

SEQ ID NO: 10437 - protein, 39 aa, Zea mays
  misc_feature: Ceres CLONE 1168170-R
IGSGPPLERKGGRSTMSYSMLSDMNSRLLNLITVLSLSG

SEQ ID NO: 10438 - DNA, 838 bp, Zea mays
  misc_feature: Ceres CLONE 1168203-R
  misc_feature: Encodes the peptide sequence at SEQ ID NO. 10439
  misc_feature (727)..(727): n is a, c, t, g, unknown, or other
caattgggaccgggccccccctcgaggagggagtcaagatcggtgggtggggtggagccagcaaggggaaacacatcttcgtcaaagacgacatgacgagagatgatgatgcggtgggaggtgaggtccagacaccggtaccccttgtggtcaggggagtagccaaggaatagacagcgggtggagcgaggagaaagcttatgtggagcgatagcggaagtgttagggtagcaggctcagccgaacacgcgaaggtggtcataggaaggggttgtgccgtaaagggcgaagtggggggtagggtggcgtaccgccttcgagggaagacggttgaggaggtgggtggcagtatgcagggcctctgcccagtagctggcagggagagacgcctggaagaggagacagcggagcatattagtggtggtgcggatcatgcgttcggctcggccgttctgggcagaagtgtaggggcacgagagacgcaactggacgccatgagtgaggaagaaggagcgagaggcgttgttatcgaacttgcggccattgtcacactgcagagcacggaccgggcgacgaaactgagtggatacccaggtgaaaaagtgtgtgagggtggtgaatgtgtccgacttcaaccgaagcgggaaggtccagagaaaatgggaaaatcatccaaaatcagcagataatatttataaccagaaagactgagtacagggggagtccnaagggtcacatgaaccagatcaaaagcctgctcagcccgagaagaagaagtagtaaatgggagacgagtatgtcggcctaacttgacagcatgacagagacccctcaaatg

SEQ ID NO: 10439 - protein, 56 aa, Zea mays
  misc_feature: Ceres CLONE 1168203-R
IGTGPPLEEGVKIGGWGGASKGKHIFVKDDMTRDDDAVGGEVQTPVPLVVRGVAKE

SEQ ID NO: 10440 - DNA, 710 bp, Zea mays
  misc_feature: Ceres CLONE 1168203-R2
  misc_feature: Pfam Name: rve Pfam Description: Integrase core domain
  misc_feature: SWISSPROT Homolog: EC 2.7.7.49 RNA-directed DNA polymerase
  misc_feature (18)..(18): n is a, c, t, g, unknown, or other
  misc_feature (43)..(43): n is a, c, t, g, unknown, or other
  misc_feature (44)..(44): n is a, c, t, g, unknown, or other
  misc_feature (46)..(46): n is a, c, t, g, unknown, or other
tttttttttttttttttntttttctttttttgtttggaggccnngnagattatattacgtatgggtacgggccccccctcgaggagggatcaagatcggtgggtggggtggagccagcaaggggaaacacatcttcgtcaaagacgacatgacgagagatgatgatgcggtgggaggtgaggtccagacaccggtaccccttgtggtcaggggagtagccaaggaatagacagcgggtggagcgaggagaaagcttatgtggagcgatagcggaagtgttagggtagcaggctcagccgaacacgcgaaggtggtcataggaaggggttgtgccgtaaagggcgaagtggggggtagggtggcgtaccgccttcgagggaagacggttgaggaggtgggtggcagtatgcagggcctctgcccagtagctggcagggagagacgcctggaagaggagacagcgcagcatattagtggtggtgcggatcatgcgttcggctcgggcgttctgggcagaagtgtaggggcacgagagacgcaactggacgccatgagtgaggaagaaggagcgagaggcggtggtatcgaactttgcggccatttgtcacccttgcagagcacggacccggccgacgaaactgaagtggataacccaggtgaaaaaactgtgtgaagggtggtgaaatgtgttccgactttcaaccggaaag

SEQ ID NO: 10441 - DNA, 747 bp, Zea mays
  misc_feature: Ceres CLONE 1168295-R
tttttttttgtctttttttttttttcttcgaagttccccacccccggggggaataaaaacgatatggtacgggccccccctcgagttttttttttttttttttttggtcacaaactagcatgtccatttcttgtactgctggccacaattcccagcacccagcttgcttcgtaatataccagaatttgccgagttttacatgccacgtcaaaatcaaaatggcacgcgtatatatactgtccaccaaatccctgtaccccaccttccttctgctcgctatatatctcgttccacagattattacgaacccaacctggtaatctcagtatcgccgtcgtcatctcagttgcggcggcgtagtcgtcgtcgttgtcgtctggttgagtatcatgttaggccccttctccccggaggacgagtactcggccggcacgggcaggtcccagttcctcgagtacgagtcggacgaccccccccgtgccgttgtccagagacagcttgttcaccgtcaccccgatggcgaaaccgttctcccacgttcgaaaaaccccggtcgatgccgcccattcccggaagtgcccacaaacaacctcacacctgcacgctgccagctgcccgggcgtctgttgtaaccctccctgaaacccgaacacccaaactttgccggttcccggatgccgccataggcccctcgtaacctccgccgaacgcccccttggaaaagcggtaccgagaggatcccccggt

SEQ ID NO: 10442 - DNA, 827 bp, Zea mays
  misc_feature: Ceres CLONE 1168388-R
  misc_feature (612)..(612): n is a, c, t, g, unknown, or other
  misc_feature (725)..(725): n is a, c, t, g, unknown, or other
  misc_feature (726)..(726): n is a, c, t, g, unknown, or other
  misc_feature (827)..(827): n is a, c, t, g, unknown, or other
tcgagctgtgggtcatgaccccccgtcgggacggggaccacatctagctcccgaaggatgtcaacgtgaggcacaggcctagggagatcaccattctccggcataccaagatgtttgccttcgttgggaccccctaggtcgacgtggaaacattcacgacttgggccgcagtcctcgtcgccgaggctgcggctaccgtcggaacagtcggaaaggtagtagtcgcacgcggtcataaagtcccgcatggcactggggataccaagtccggagaaatcccaacagaagtcgggctcatcatcttcctcggaccccgagggcccgtaggtcgagacggccgtcagccggtcccagggtgaccgcatacgataccccagagggtttggactcgcctctacgagagcgtccaccaaagcgaagtcgcttggcgggtcaaggctgaatccaaaaggcgtgagatgggaatcggttggttcctcttgatcgacgggcggtgacgaagtcacgtcagggactgactgcaccgtcgtctcaggtacgagggtgacgcccagcaagtccttcgtgagcgtgctggcgtcgtctgtttgcttggggttggcgtgttgcggngagacgacgctcgtcttcgtctcagacgcgaggtcgatgcccgacgtgccccccgttggggcgccggcgccgtcgactcgcacgacagccgacgaggtgccgcctcctgcttnnggcttggtgcgccgcctcctcctttcgtcgtggggggggcgagatcgaatgggtgtcttccactacggcgggaaaggcgtcgtcgattccgcccgccggcn

SEQ ID NO: 10443 - DNA, 997 bp, Zea mays
  misc_feature: Ceres CLONE 1168405-R
  misc_feature (43)..(43): n is a, c, t, g, unknown, or other
  misc_feature (849)..(849): n is a, c, t, g, unknown, or other
  misc_feature (850)..(850): n is a, c, t, g, unknown, or other
  misc_feature (871)..(871): n is a, c, t, g, unknown, or other
  misc_feature (872)..(872): n is a, c, t, g, unknown, or other
  misc_feature (874)..(874): n is a, c, t, g, unknown, or other
  misc_feature (877)..(877): n is a, c, t, g, unknown, or other
  misc_feature (878)..(878): n is a, c, t, g, unknown, or other
  misc_feature (879)..(879): n is a, c, t, g, unknown, or other
  misc_feature (882)..(882): n is a, c, t, g, unknown, or other
  misc_feature (883)..(883): n is a, c, t, g, unknown, or other
  misc_feature (884)..(884): n is a, c, t, g, unknown, or other
  misc_feature (885)..(885): n is a, c, t, g, unknown, or other
  misc_feature (886)..(886): n is a, c, t, g, unknown, or other
  misc_feature (888)..(888): n is a, c, t, g, unknown, or other
  misc_feature (889)..(889): n is a, c, t, g, unknown, or other
  misc_feature (890)..(890): n is a, c, t, g, unknown, or other
  misc_feature (891)..(891): n is a, c, t, g, unknown, or other
  misc_feature (892)..(892): n is a, c, t, g, unknown, or other
  misc_feature (893)..(893): n is a, c, t, g, unknown, or other
  misc_feature (895)..(895): n is a, c, t, g, unknown, or other
  misc_feature (896)..(896): n is a, c, t, g, unknown, or other
  misc_feature (897)..(897): n is a, c, t, g, unknown, or other
cccccccctacacaaacacgcccctcccccacacccaaacaanccccctctttttatatggctaagctaagctaagtaaccagcttccagccatcggttgcagcataagctttagggtcaacaacacatacatacactgaaacctaactaaatccgattacaaaaaggcacttccaaatcagttccggaagaggaaaaactcgaagtctggatgcctgtttctactcgcctgcccattcttcagcacgctggccctgaacaacacggccgcagcctcactcagcgggcgcgatctctccttcaaaatctcggatgcttcactgtcctgcaactgcccgccttcaaattcggacttgctcatctcaaaccaccactctgccttggaattgaaagactgcaggcccatgactggaaaaacagcggccccacctgctgagttgttccgacgaatccaggggccaaaaaagtgatatgccaaaaaggtaccctggaattttccatcaggaatccggtatatgggataccttgcacaccaataccagatacaagggcacgtcccctgaaaagagagcatacccaagacgctggatgaagatcttgcaggttggcctccaaattcttttggttccccaaaaatttggcaatttgacggtttcccaccgggaaatccagccatttacctttgccaaaaaattgccgccggtgagtatggcttgttcattttccaaaaaattcaaaataaccacttcccccttctgttgactgttggatcttcttccaaaccccaaaaaaaagggtttaatttactggaaaccaattgttttggcaaaagcctgtcaaaaaaagggnnaagctcaaccatttttccccnncnccnnngtnnnnntnnnnnncnnnttttccttacacagccttccccacagggttcctttaaggtgccggaagagtggcaccccaaaacttagggaccaaaatggtggaaactgccaggttcttt

SEQ ID NO: 10444 - DNA, 828 bp, Zea mays
  misc_feature: Ceres CLONE 1168405-R2
  misc_feature: Pfam Name: DUF789 Pfam Description: Protein of unknown function (DUF789)
tcgagtttttttttttttttttttgactagcattattattatattgctaagctaagctaagcaaacagcttccagtcatcggttgcagcataagctttagtgtcaacaacacatacatacactgaaacctaactaaatccgattacgaagaggcacttccaaatcagctccgggagaggaagaactcgtagtctggatgtctgtttctactcgtctgcccattcttcagcacgctggccctggacaacacggccgcagcctcactcagcgtgcgcgatctctccttcagaatctcggatgcttcactgtcctgcgactgcccgccttcagattcggacttgctcatctcaaaccaccactctgccttggcattgtaagactgcaggcccatgactggcaaaacagcggccccacctgctgagctgctccgacgaatccagtggccaagagagtgatatgtcaagaatgtagcctggaattttccatcaggtatccggtatatgggataccatgcaacacaataccagatacaagtgcacgttccatgaaaagagagcataccaagacgctggatggagatcatgcaggctggcctccagattctttgggccccagatatttggcaatttgacgggttcgcaccggcaatcagctcatttaccttgccaaataattgtcgccgagagtatggctgttcatattccaaaaattcaaataccagctccccatctggtgactgttgatcatcttcagtacgcagagtagaatggtttattttctgcaacagattgttttggaaaaagcttttgcaatattggggggacaggt

SEQ ID NO: 10445 - DNA, 839 bp, Zea mays
  misc_feature: Ceres CLONE 1168439-R
tcgagggctgaagacgaagctatgacagtcgccttcgacgcccgaggaaaaaagaggctgaatagggtttttgatgttatcaggttcgtctaccctaattactgctatcccatgcaaaagcaagggaagaaaaggaaaactgctacctcggcatcttctagtgtgttgaggtcgaagaaggttaaagttttgacgtgctgacccaggcacattgaaacggtcgatgtgctaaagttaagtgaaggcatggttcctgccacagaaccagggcaatctatgccagtcgagtctagtataaatccggtcgaagagccgcaactagagaagacgacagaacagtataggcgctgagtccatcgtgtgtaatgggtctacctgaaagggaaatagggtcaaaccttttcctaaatgattttggtggttgaaatgcccaacacaaataattggactaactagtttgctctagattatatattctacaggtgctaaaggttcaacacaaaccaataaaaagatccaagttagggttcaaaatgaaaggtgcaaaagaaaccgaagagaaccctggtctggcgcaccagatcgttcagcgtgccaccggatagtgtccggtgcactaggggtcgtacagtctgaactcttcaccttcgggtttctcagacgccactccgctataattcactggactgtccggtgtgccagcggagcaacgactaagaagcgcaacagtcgactccaacggtcgcctgcaacgtaaacagtgcacaaacagttcgcgcagagtcagagcagcgccagaaggcgcaccggacagtgaaacaggcctgtccgggtgcgca

SEQ ID NO: 10446 - DNA, 887 bp, Zea mays
  misc_feature: Ceres CLONE 1210900-R
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
nnnnnnnnnnnnnnnnnnnnnnnnnncccacacccccacaacaatccctnnnnannnnccgaattgggtaccgggccccccctcgagttttttttttttttttttttctttttttttttttttttttttggggatttgctctgcagctgggatttaaataacccgagttacaacaatcgtcttggctctttgggggctggcaaagaattagccccggtacaagatggggtcccgtctcattctacagaaggggagacagattcagcatactggcaatgataaatattttagttgacctagttcttacgttcaccttacatcacctaaaattaactagccatgaagacaacaaacgtcacttgaaaagagtctcgagtattcattggccaacatggcaaggcactaggctgttgtacacaaggaaccctttggcaacaataaggctcgtaaagcataatattggttggacatattccttaccctgcttcaagggcactttctctgaatataggaaaccccatgctcttcatactctgctttggagaaccacatctgctggaacgacccaagagatgctagattgctccctccaatccaaacactgaaacgtctctctactgagtttccgcttgccataaccttgacacgagcagcttgaggagactcctccaatacttctttctccaggcgctcctttaactgcagaattgatgatgacccaccagagagcaagatgttactgaatagctcttttcgtatgtcaacgtcgcacttatttacgctatcaatgaccattccttgaaggccacggactggtattgaatctgcaaattcatcaaatccaggaatagtctggggatagagatggatttaaatagaatatccgg

SEQ ID NO: 10447 - DNA, 868 bp, Zea mays
  misc_feature: Ceres CLONE 1210918-R
  misc_feature: Pfam Name: HORMA Pfam Description: HORMA domain
  misc_feature (705)..(705): n is a, c, t, g, unknown, or other
  misc_feature (727)..(727): n is a, c, t, g, unknown, or other
  misc_feature (728)..(728): n is a, c, t, g, unknown, or other
  misc_feature (734)..(734): n is a, c, t, g, unknown, or other
  misc_feature (735)..(735): n is a, c, t, g, unknown, or other
  misc_feature (820)..(820): n is a, c, t, g, unknown, or other
  misc_feature (868)..(868): n is a, c, t, g, unknown, or other
cgattgggtaccgggccccccctcgaggtcgacggtatcgataagcttttttttttttttttttattttttttttttttttttttttttttcgcagccagatcttaaaggggactcatgttatattaaaaccggcatttcaatctcgaaattctaaagggtaggagcgtctcacacttttcttccccccaaagtagcagtatactattagggcagtacacgctagacgtgaatgaacgattcacacagccttcacgccaagctctagcagcagcagggtaacttttggggcaaactctactcctcctcgtcccactcgtccttcttgtacgacaccagcgggtccaccttatgaatcttggggtcgaaggagtgcagcttaaccatctgcgggttgtcgatgagcttggcgtcactctcgacccaggtgcccggagcgtcgacgtccgtgtccgtgtaggccagcacgtcaaacacgcatggctcgtcgaggcaggggaggtaggtgatgcaagacgcgatctggcgcatgatggcctggatctccctcatgatctccttatcgctcttctccttgatggcccccttctcgacgaccctcgggtcgggaaaaaatgttgaagttccagcgtcgaacacctccgctggtggcttttgctcattatgaccagcacgatccgctgcagcttcccgggctccagcattnctgaaaaactggaaaggtgagnnttttgnnaaataaaattctttcccgccttcgtcctgggggaagcaaaatggttgaacccgaacttccttcaccttgctaaggtcccccgggnaaaaccaacacagcgggttttaataaaagaatgccatttcccccgggn

SEQ ID NO: 10448 - DNA, 974 bp, Zea mays
  misc_feature: Ceres CLONE 1210974-R
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (18)..(18): n is a, c, t, g, unknown, or other
  misc_feature (974)..(974): n is a, c, t, g, unknown, or other
ccccccccccccnnnccnccccccacttgaccaccccacaccctttaatcgaatgaggacgggccccccctcgagttttttttttttttttttcattgttaaaatgagatccttgttcacaccacttccacacaaggacctaataagttagaaatgtgcaaacatcttaactttgctaggagaaggaaacatagcaatgagaaaattcaagctttatgagattagtggttagcggagactttgagcttgtttgttgctgctctttggcgccattgccacacgacgcttcaacggatccatatgctgctgaagaatccggttgtgtagtggaaaattgtcgccgtcgcgaacctcatctccttgccggcagctggattgggaagtttgctgggcatcttgcacccgagttatcagtacaagctgccgaggagaccgcgctcgccggcaatgcccaagacgttgagaacaggaaagcagaataaaagtcgcggtaggaaatgtgtacgtaatccgcttcagagatctgaaatccagaactggaaagcaagtgaacgaggcatgttttcatataaaattgcaccctaatttaacaagcccaaaatggcaaatattcttactggtgaatcccaatagtgacaccatgttgaattgcaacagaaaccaacataaggttaaaccctggaaccgttccaaaaaaaatctcattacatggaaaagccattcccccgccgggtgaatcccaaacctgcctagtaccaatgtcggaccccaagaaccttggacaaccactaccacccacccgcccccaagcaaaaatagttaaaccgccccccttaagggatggctaaattaatttcttgaaccaaggcaaaaaatgacaacgcgcccctgccccttcactcaaccctttgtgcccatatgaagggacacccacccaaaaaccccagcaaaagccttaaaaaattttttctccn

SEQ ID NO: 10449 - DNA, 833 bp, Zea mays
  misc_feature: Ceres CLONE 1211042-R
  misc_feature: Encodes the peptide sequence at SEQ ID NO. 10450
tgggtaccgggccccccctcgagtttttttttttttttttatttttttttttttttttttttttttttttttttttttttttttttttttttttttttttttttttttaaaaataattccccacaaaaatcccccccccccttttttaaatacaacaagggccctaatttggaaggacagcatttgggaggttttgttacactaaaacctggggggggggaacacctcccccctcatcaaatttaccggtccatgatccagggtatatcgatccggcccaaggaaaatgccatttttttctaaaagggccaggccttccccccccccataccgggaaaaaaaaagtttcaggtattcgatgccctgcatgcccctgaaaatgccctctaaccggggggaaacaattggttcttgggaaaaaaaaaacccttccccagggtaaaacaggaccccccccccaggaggaaggccccgtcaaaaaaaaatctcagcatttgggatcataaccttctcaaaggaggtggaaccccaaaaaaaaaatcctggcccaccttttttccaaactttccaaattaatggcggggggtgggttccccgcatcccaaggggccagtttggttggggatcaaaaggacccatggaaaattttgtcccccactcccccccaagatagggccgaaattcagaaacaaaatcctctcacaagggtttctcttggggcaaaaacccctttacttgggaaaaaaattttgggggggggccccaaaaaattttggaacttttgcaaaaagtttcaaagggaaagggggccccgttcaaacccccttggaaca

SEQ ID NO: 10450 - protein, 100 aa, Zea mays
  misc_feature: Ceres CLONE 1211042-R
WVPGPPSSFFFFFYFFFFFFFFFFFFFFFFFFFFFFKNNSPQKSPPPFFKYNKGPNLEGQHLGGFVTLKPGGGEHLPPHQIYRSMIQGISIRPKENAIFF

SEQ ID NO: 10451 - DNA, 783 bp, Zea mays
  misc_feature: Ceres CLONE 1211081-R
  misc_feature (23)..(23): n is a, c, t, g, unknown, or other
tatccttctccacaccctccctncccgatcccccgccaaaaaaaatctcaccgattggctaccggcccccccctcgaggtcgacggtatcgataagcttttttttttttttttttccgcttgcaaacgtgttcttattccgagctacgagtcattatccagtagtacaagagcagcacatgccatcagcagctgataaggcttacgacaattcaaataacagggacaagaagacattattagcaatggcccgaagctgttgcatgctgacagtaatacctgctcggtccatataaggttcccctagtgcttctccatgtggaggccgtaaacgaccagtccaacacgacaagaatattggatcaggcaagggtgttcacacctgggacaacaccatggcagctatgatctaaatgtacactgcgatggctgactgaaacgctgtccacacgcacagccaggcacaaagattgtcccttcatctactgtgagccccaggaaccaaaaggagtgccccatgattgttgcggatgcacagctgcccctcccatctgcgggtggggtctgggcctaactcattcggcaaaaataacccctcccatccagaaaaattttcctccattccttccattcctttaattggatcttcaaccgaaaattaccctttataggcccaacccccttaaaaaaccccgtggacccgcacctgtgcaacactccagcggggttcaccttcccccaaacttttgataaacgctttcctcctaagtccctcacagggtct

SEQ ID NO: 10452 - DNA, 963 bp, Zea mays
  misc_feature: Ceres CLONE 1211081-R2
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (62)..(62): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
nnnnnnnnnnnnnnnnnnnnnnnnnnnnnnnnnnnnntttttttnnnttttccgtttttatnttannnccccacattgggtaccgggccccccctcgaggtcgacggtatcgataagcttttttttttttttttttccgcttgccaacgtgtccttattccgagctacgagcctttatccggtagcacaagagcaccacatgccatcagcagctgataaggcttacgacaattcaaataaaagggacgagaagacattattagcactggtccgaagctgttgcatgctgacagtaatacctgctcggtccatataaggttcccctactgcttctccatgtggaggccgtaaacgaccagtccaacacgacaagaatattgaatcaggcaagggtgttcacacctgggacaacaccatggtagctatgatctaaatgtagactgcgatggctgactgatacgctgtcagacgcacagccaggtacaatgattgtcccttcatctactgtgagccccaggaaccagaacgagtgccccatgattgttgtgcctgcagagttgcccctcccatctgcagcggtgggctggatccagcatatccgccgaaaataacccatccatccagaaatcttccatccattccttctattccctttagtagcatctttcaaccaaacataccttaccaaagccaaaccccttagaaaaaaccagcgacacgatctgtgacaaccccaagcgtgctcaacttcccccaaactatgcaaaagattctaccaaggccatcgggtggaagccacgcttgcctaatccccggaaaactaaaaaggtttggagggaggtgaacggacctccccagggaaggggtgggggcggggctccggcgcggcccaaagccctaaaatgggaaaaacaagcccccaggtttccagattcccccaaaccccgccaaaagtgaaaaaaa

SEQ ID NO: 10453 - DNA, 796 bp, Zea mays
  misc_feature: Ceres CLONE 1211096-R
ccctattacgtactcaaggacattatcacgggccaaaaaacgcggacaaacatgcgggcacttcaacatgcccttgcttcccctgcagtcgcatataccagttacagagtactggtacacatatacacctcatctagccgacctagtgtacatggaatgttgtgaaacaactaaaacgtcctaaaatacttcttgatttcgaacaggatggaggatatggagacaaggaccttgttgagagcagagccgccggtgattctcttgacacactcggagagcctggtgtagtatagcaggagctgtgcgagcggcgctctcaagatctccatcccgcagacaaagttgctgaaagatgcgatcgcatcgtagtgcatcagctcgatcgcgtccttatacccggattcgcgaaatcctttaccattggctcacactctcggtaatgatggctttctcggaatttgcagtcgtctcatccgctggacgagatttgaggaatgtgatcaaattactgaactgctcccagagccactcttccccataatattgtgatgttgctcttaagaacctcctccaaatgttgttgagctgtccccccctcagttccagcttctgtcaaatggaaattggtagatcataattgtttatacaaagacaccctagtacctatcgttttgaaaaatcttgaccccttaacacgccaaacctgcatggcatgcgcatcgctccgatttaaagcagttggaggccccctgtcctattgaaggcactaaaaactggaagtcattaccccctgaac

SEQ ID NO: 10454 - DNA, 853 bp, Zea mays
  misc_feature: Ceres CLONE 1213256-R
cgattgggtaccgggccccccctcgaggtcgacggtatcgataagcctttttttttttttttttggagtgaaagctcttgcttcgggtactaactttattggtggccgaccacagatggggtgcatctgacttggacgcccgaatcctttggctttccgacgcaagcacacctcaaaagcctaaattgaccgtgcaatcttcttcctgtccgtcaccacatttgctagtatttggcttccgatcctggtatggatacgaaaccccgaggaggggacccctaaataacctgttggagcccctcatctaaacgtggatttgcctggggtctcctcaccgtaacttcgcatctgtggactgaacgggcctgctggtttcacccacagagccgtggggctcccccttgtggccgcctcaactttatccgccatacgggtcctataaggccgaccgcctgatgcgcccaaccttttggttggaaaagtcagagccttttcccacgggatactggctttctgatattccttgagatgccaaagtgcatgccccagattcaccaatgttggttcccacatttcactcagataagatgaagtatggtccaatgctaactcaaacaccggaactgcttttcggtactccttcatattatacacaacaacccccaactcattgtaaataagtggatcagatgggcacatggattttgcttgtgtgaaaaactgctctgcaagtttgaaattgtgcattcgcacatattgcatgcccatgtttcaagtcggcaaatgacatccaggaaataacccgagctgccgtccgaaaatgcacccttgccttgggcaccttcctcttgag

SEQ ID NO: 10455 - DNA, 869 bp, Zea mays
  misc_feature: Ceres CLONE 1213321-R
  misc_feature: Encodes the peptide sequence at SEQ ID NO. 10456
cgattgggtaccggtccccccctcgagtttttttttttttttttttttttttttttttttttttttttttttttttttttttttttttttttttttaacccaaataaaactaactttaaagttccaaaaaatccgttccaaaaaaaacgaccccctaaagatgacttttataaaaaagcaatttgcttaacttgggtttgcccaatgagcgatccccgggttgtacaagggggacagcgatcccaaaaaaattggcccccgcaaaaatctggcccatcggtactctctaaaattgtacaaaaaacttctgggcttgggggtggggggagtctataggttatccaaagttccctgttttggggccggcccccttaaatctgttttggaaataccaaaaatccagtccctcccgccagggaaaggccaaaatttttttcggaggggaacatgtgagctcccccctgtcaccgggggtttttgatttggcaaacctttccgacggtttgagcaaaaaaaaaccaacctttaaggggacccttgcccccagcccaccagcaaaaaaaccttcccgtttcccatgccccgttaaaaccaatgcctgttttttctaccctaaaaaaaaactgcccgttaaactgatggcttctggatttcagggcattggtgcgatgggaaaaactaaatttttcaacatttccggttccccccctttgggggtcctcttggaacttggggaaaaacctttgcctccttcccaaaatttttcctcccccaaaaaaaaaaaactcccaaaaaagaaaccgccccccccttgcctttagggtttcccccgggaaataggggctatttctttttgcagtaagaaaaaa

SEQ ID NO: 10456 - protein, 111 aa, Zea mays
  misc_feature: Ceres CLONE 1213321-R
RLGTGPPLEFFFFFFFFFFFFFFFFFFFFFFFNPNKTNFKVPKNPFQKKRPPKDDFYKKAICLTWVCPMSDPRVVQGGQRSQKNWPPQKSGPSVLSKIVQKTSGLGGGGSL

SEQ ID NO: 10457 - DNA, 896 bp, Zea mays
  misc_feature: Ceres CLONE 1213378-R
  misc_feature (16)..(16): n is a, c, t, g, unknown, or other
  misc_feature (17)..(17): n is a, c, t, g, unknown, or other
  misc_feature (22)..(22): n is a, c, t, g, unknown, or other
  misc_feature (896)..(896): n is a, c, t, g, unknown, or other
cgattgtgtactagtnncccantcgagtttttttttttttttttttcttttttttttttttttttttttttttttttttttttttttttttttttttttttttttttttttttttttttttttttttttttttttttttttttttttttttttttttttttttttttttttttattgttttagtttaaattgtgcaaagaccgcggaggaagaaaagcccaaaaaaaaaaaaaaaaaaaaaaaaaaaaaaaaaaaaaaaaaagaaaaaaaaaagaacggggggaccaccccgggcgccccgaaggacacccggccggggggggaagggggaaaaaaagcgggggggaggaaggggggggggggggggggggggggggggggggggggggggggaggggggggggcccccccccggggggggggggggggggggggggccccagggggggggggggggggcgcccccccccgggggcccggagaagaagggaggcggcccccccggggggggggggggggggggcccccccccccgtcggacccgaggggcgggggggtgggggtaggggcccggggggggcgacaggaagagggggggggggggggcggccccggggggggccagaaaagaggggggggggggggcaccgcaaccccttttccgtgtggtgttcaagaaaaaaaaagaaatattgagcccgcccccccgccgctcctcttgtaaaaaaaaaaaaagcacacgggggggggtttgtaaacaaacacccccctctccctcaaaaagaaagagaaaaaaaggcccgcccgcaccaaaaaaatagacaaaagaccaccccccctccagattaaatagaaaaaaaaagagaggagggaccccgggggggcggggttttctn

SEQ ID NO: 10458 - DNA, 1864 bp, Zea mays
  misc_feature: Ceres CLONE 1213384
  misc_feature: Encodes the peptide sequence at SEQ ID NO. 10459
agatgggcaaatcaagttgccccaggggcaggacgcgcttaccagggacgatcccgtgaaagggtgctgcaccggcccggatcgtggacagatctatccccaagagccctagggtctcggcgtagatgatgttgaggctgctgcctccgtccatgaggaccttggtgagcctagcgttgccgatgacggggtcgacgacgagcgggtaccttcctgggctcagcacatagtcggggtggtcgccttggtcgaaggtgatgggcttgtcgaaccagtctaggtagaccggcgccactaccttcaccgagcagacctcccgacactcctgcttgcggtgccgagccgaggcgttcgccacctgcccgccatagatcatgaagcagtcgcggacctccgggaactcctcgtccttgtcgccccccttcttgctgttgccttggtccttgccaccttctgccgagggtcccgccttgatgaagtaacgccggagcatgtcgcactcctcaagggtgtgcttgacgggacccctgtgataggggcacgactcctttagcatcttgttaaacgtgttgactcctccgggaggcttccgaggattcctgtgctcggtagcagcgacgagatccgcgtcaacggcgttgcgcgttgcttgcgccttcttcttggccttctttttcgagccacgctggacgaacgcctcgggggcgtcttccttctgtcttccttgaggctgcttgtccttccggaagatggcttcgaccgcctcctgaccagagaagaacttggtggcgatgtccatcaattcgctcgccttggtgggagtcttgcgccccagtttgctcaccaggtcccgacacgtggtgccggcgaggaatgccccgatgacgtctgagtcagtgatgttgggtagctcggtgcgctgctttgaaaaccgccggatgtactctcgcaaggattcccctgtttgttggcggcaacttcggaggtcccatgagttcccagggcgcacgtacgtaccttggaagtttcccgcgaaggatttgaccaggtcgtcccagtcggagatctgtgcaggaggcagatgctccagccatgcccgggcagcgtcggagaggaataggggtaggttgcgaatgatgaggttgtcgtcattcgtccctcccaactggcatgccagtcggtaatccgcaagccacaactcaagccttgtctcccttgagtacttggtgatggtagtcggggctcggaaccgggctgggaacggcgcccgtcgtatggcccggctgaagaccctcggacctggcagttcgaacgaggggctccggtcctcctcactgtcgtagcgtcctccgcgcctggggtggtagcctcggcgcaccttttcttcgaggcgggctcgatggtctcggcggtggtgctcctcgccgaggcgatccggggcagcaggcgtcccgtcccacgtgcgcccggtgcggaccgaggcctcccgcataagtcgggaggacgttgtgcgatgctccgaggggcacccttgccttcgggaggcagagctctcagctcatcggaccgctgtgttttctaggagacccttgagtttgccctggatacgccgcccctcggtggtggatggctccggcatcgctcggagtagcatcgctgctgcagctagattctggccgaccccgctgaaggccgggggcagccttgccctggcatcatcaacgattcgacgctggatgtcttgggcccgatgaggcgctcctccgacaagtgctcggtctgcccactcctgctcgatgttttgtcggagctgcacaagccgccccgcttcttcgtcgagcttggcctgcatctcgcggaattg

SEQ ID NO: 10459 - protein, 130 aa, Zea mays
  misc_feature: Ceres CLONE 1213384
MSINSLALVGVLRPSLLTRSRHVVPARNAPMTSESVMLGSSVRCFENRRMYSRKDSPVCWRQLRRSHEFPGRTYVPWKFPAKDLTRSSQSEICAGGRCSSHARAASERNRGRLRMMRLSSFVPPNWHASR

SEQ ID NO: 10460 - DNA, 841 bp, Zea mays
  misc_feature: Ceres CLONE 1213505-R
  misc_feature: Pfam Name: PRT_C Pfam Description: Plant phosphoribosyltransferase C-terminal
  misc_feature (374)..(374): n is a, c, t, g, unknown, or other
ggggtccgggccccccctcgagtttttttttttttttttagcatcacacacatgcatgcataagtagacacagtcacgcatcatgcgtccagttgttacaggaaaggttcacagccatatgaatacataaccaactatgcaacacacagaagctcaaaaagtaaacgaagatagctagcagccccttttttccggatacacttaagagagagcaacaaccatctgtgagctgcaactgagaggcgaaaccaccggccagcgatggggccatgcacctgccgcgcctacagcatgctgtcggtcctcgccggcagacgcctgaagaagttgagcgggacagatggcatcttgtggcggaacctggggtgcctcancacgtacaggcctgcgaggaagaccacgacccggaacggagtgacgtacaggacgatggcggcgacgaagcagaagaccacgaacagcgcggtcgcccttgggtccctccagctcagcagcgactgcagccgctcgccttgtgtggcaaggtcgccgaccacggtctggatcctccccgcgacgctgcgcagcttgtcataccgcatccgcaccaagtccggcgggcgggaggtggggaaggtgtccaactcctcgtcaagctcgtccgggtgggcggtctctgcgtgggagaggcgggtgtccatgtgcggtggctgccttcggccgcccacctgtagtaccccaccccgaatcaggaaacaggtagaaggaaaatagtgtggggcagttattcaacctttggggttatagaaaccccggtattccaaaaaagaagtaccattgggaatcaggttaccggggggga

SEQ ID NO: 10461 - DNA, 961 bp, Zea mays
  misc_feature: Ceres CLONE 1213505-R2
cctctcatcatcccacccgttgttacatgaaaggtacacagccatatgaatacataaccaactatgcaacacacagaagctcaaaaatgtatactaagatagctagcagccccttttttccggatacacttaaaagagagcaacaaccatctgtgagctgcaactgagaggcgaaaccaccggccagcgatggggccatgcacctgccgcgcctacagaatgctgtaggacgtcggcggaagacacctgaagaagttgatcgggacatatggcatcttgtggcaggaacctggggtgcctcagcccgtactggcctgctatgataaccctcactcgaaactggaagatgttcatgtatataggcggccacgaaacccaaaaatcttgaaaatctctttcccccccttttgagtcccccccgacacaagaaacaaattgcaatccccttcccacatatgattggccagggtccccccaagtacatgatccggggatatttttctcctgttaactttgtaccaaagcacgtgtacttctacgtgtcatagtgggtctccttaatatcttcgatcacctctatatatataatctgtggagataagagtgagttacagaaaatacccccccccactaccaactctccccattcaacacacttcggggacgaaagaaaaattttcgcttttcctgtcctcataacaaagctcattagtactaccacacacctctgcgtgtggaagacatttataaatgcccacaacaaaccccaatatatacttagcagactacccccataaagaagtatacatacagctttctcatgccatacactatgtaacggtgaactagtatgatctgttggggggaaaaaatcgtacatagataattgtataagtataatacgaaatttcatactaacgactcatctcggacctacgtgttcttcacatcatcaaccaca

SEQ ID NO: 10462 - DNA, 816 bp, Zea mays
  misc_feature: Ceres CLONE 1213521-R
  misc_feature: Encodes the peptide sequence at SEQ ID NO. 10463
tgggtaccgggccccccctcgagcagcaagaatctgctcagtctgggagcaccggacagtgtccggtgcgccagactgattcgagcgaagtggccactctcgggaattcaccggcgacatacggctataattcaccagactgtccggtgtgcaccggactgtccggtgagccaacggtcggccgggccaacggtcggtcgcgcgatctgcgcgggacacgtggccgaggcaacggctagaagggggcaccggactgtccagtgtgcaccggacatgtccggtgcgccaacggctctctggctgccaacggtcggctgcgccagttaaggaaagaaatcgggcaccggacagtgtccggtgtgcaccggactgtccggtgcgccagtcgacagaaggcaacaccacccttcctagattgctctcaacggctcctagctgccttggggctataaaagggacccctaggcgcatggaggagcacaccaagcattcctacaacattcctaagcaccaagacatcgattccacgcctttgattctttgtgatagcaattagagctctagttgagtagtgaactccttgagttgtgttgtgagctctcgttgcgacttgtgtgcgtggtgttgctgtgatttcttgtcttgagtgcgttgctaatccctcccttgctccgtgtttctttgtgaatttcaagtgcaagggcgagaggctccaagttgtggagattcctcgcaaacgggatttgagaaaaagcaaggaaaacaccgtgggtattccaggtggggtcttttggacccgctttgataaggggttgc

SEQ ID NO: 10463 - protein, 108 aa, Zea mays
  misc_feature: Ceres CLONE 1213521-R
WVPGPPSSSKNLLSLGAPDSVRCARLIRAKWPLSGIHRRHTAIIHQTVRCAPDCPVSQRSAGPTVGRAICAGHVAEATARRGHRTVQCAPDMSGAPTALWLPTVGCAS

SEQ ID NO: 10464 - DNA, 842 bp, Zea mays
  misc_feature: Ceres CLONE 1213550-R
  misc_feature: Encodes the peptide sequence at SEQ ID NO. 10465
cgattgggtaccgggccccccctcgagttttttttttttttttttttctttttttttttttttttttttttttttttttttttttttttttttttttaaaaagggtactgtgggcccgtttcccctttcagggcatatatatattggggattttttacagtacatgatttaaatgctaaaaataataaagtccgggggaaaaggcaggcatacattattaatcagtccccccccaacatggagcacattgtcaaaccgtcgggggcccgacaatgctagctgcatgcatctgcatcatgcatgtcgttgaatcccacggtttgatttgcccttaggatccactaaacaaaaaaacatggttgggggtgcgggggttgtgtctgctaacacagcatgggtacctttctttctgttgacctttaaatgcccgtcttgatgcaaacggtataaaaaggagggtaggcaggcccctggactggacccccggggctgctggctctctgctacgtactgctgcaccagcatcccattcccagatcccagtacgtaaaatggacgtactgtaccccacaggaacagtagtgtgttacttggcatgctagcttgttgttactgtacctcctacatgttgctcctcttctaccttccctccctggtgatgagttgcaattgcagttgcacgtaaaatagagccgccaaaagcaaaccgcatgctctcgtccttgctgcacactgcagactgcccaagatgcatgtgcaccgtccctccactccactatgtcatagactctcaaaaggtaggtgttgatcaaaaagcatctgtcggccgggcggatcaatac

SEQ ID NO: 10465 - protein, 54 aa, Zea mays
  misc_feature: Ceres CLONE 1213550-R
IGYRAPPRVFFFFFFLFFFFFFFFFFFFFFFLKRVLWARFPFQGIYILGIFYST

SEQ ID NO: 10466 - DNA, 884 bp, Zea mays
  misc_feature: Ceres CLONE 1213553-R
  misc_feature: SWISSPROT Homolog: EC 2.7.11.24 Mitogen-activated protein kinase
tgggtaccggcgcccccctcgagttttttttttttttttttttctttttttttgttttttttttttttttatttttttttttttttctaatgaagatgatgatcaaaatggcaactcttcaaatatgctaagatttgcaagccgtacaccaaggaattcaaaagagcaaaatattggattcgagtaactcttcaaaatggcaactcttcaaataatgtttccttctgtgactgcagcgtgtaacctcccatggcctgcgatgggttggtactgtccaaccttgcaggcatttggagaaaaccgtatgcttgtgggatctgttgaagatcacgataccttgaatccggcactgggccattaactcttactgatcctaacagatgtatagcatttggttgcttcataacaagttgaggcaagtgatacaaactttaatttgtgaaagtacagatctctctcctcaagcattgatggaagcagtctccaatcatacccaaccaccatcccccattagattcaatgcctaaaacaacacaccatttgacccattctttccataccgcaaagagaggacctgttatttattcaggggccaggtcttgaatttgggaacgacactctcatgcccttctttggcatcccaacgggccggtttccactatttcccccccaaccatcatttaacccccctccctccccattaataaaccccccccaccacctcccataaaactacactactaccccccccccacaccccctcctaatcatcccccccctcccacccccggcattttccctttaaactcccctcccccccctcatccattaaactctcccctcccccacatcgcccttgctccacattgacaccccgacccata

SEQ ID NO: 10467 - DNA, 906 bp, Zea mays
  misc_feature: Ceres CLONE 1213572-R
  misc_feature (736)..(736): n is a, c, t, g, unknown, or other
cgggccccccctcgagttttttttttttttttttttctttttttttttttttttttttttttttttttttttttttttttttttttttttttttttttggagaacgaaaggtaccccggactacctaaccccataaaacgacagaaaatccccgggaaactgggggaactatttccaactatatttacattttacaacccccaaacaggcccggtaagggatacaaagaaaaaaagaccccgactaatccccattggcggaaaccccatcttcaacccggactggcagaaggccaaaaccagaagggacgaccccgatggttccaatgggatctgggataagccaaaccgactgaagatcactggtcccctcctcccccctaaaaattggtggaacttgggcaagggctgttggcggaacctctactggagggtgcgggctttgaggcatggtcccgttgccattgaaccccttgaacggttcctctcccgggaaggggtccccttggtcacgaaacaaggtgcgtccctccttcaaaatggactaacccacccccctttccttgggtggggggccaaattcgtcctctgctccacccctccccagccccttggggtatgaacttacaacttcccacatcccactcctacaaccccgttatctcctctctcccccgccccccaatttactcaccccctcctcaacccatatactttctccccccccacccgactcntccctcctaccaccctcacccctcagccacccccccacattttacttccacccccctggcctcccccatctttttgtctttcctccccccgcccgcccgccttctgcttctcacttccgccctccaccgcccccctccaccactctctttatcacctccaccccagcccg

SEQ ID NO: 10468 - DNA, 859 bp, Zea mays
  misc_feature: Ceres CLONE 1213977-R
  misc_feature: Pfam Name: Aldose_epim Pfam Description: Aldose 1-epimerase
  misc_feature (733)..(733): n is a, c, t, g, unknown, or other
  misc_feature (770)..(770): n is a, c, t, g, unknown, or other
tctatctaagatatacagagggatattgtaatgagagataggacaaggttccatcatttcagagatgggaaatgcagttgtggggactactggtaaaatttgggagaggaaataaaacttttattgcttaagaaaatggatccactggacattataagtttaaagtacaatgttttcaactgatgctgagaagttgtgttgcagtccaagactgtcccggctctagcttgacatccccaagctttgcattttccacgcacacaaagtctctgtaacaagcctccatctgagtatgcgggttccacaagaccgcatccgaccaatttgtgtttttgatgattattttatcacccaagccattatcaaactgcaattcattgggagcatcaagatagacggtatccacaaatccaggaaaagtgactgcatccctgtcttctttaccctctattgggttcttagggtctggatccttattgagggttttacaaccctttagacctctcacggaggcccccgcagaagaagcacggaagtaagtatgcagcgcagtgctgaaagaaaatggtttatcgtctgtgtttgtaatctttagctcagtggaaagggagtccgcgccaacaatgaccttgtatagagcctggaaagcaaagtcccacatggctcgactatagggactatccttaagctcaagagtaacagcagcattgtcatctgcattctgagaatcgancacagaccagtccatgttcctttccaacctatgctgntgaattagcccaggtccaactgtgggaaacaatgtgggatccctccgctagtgggcttactcttatttgagacagcatctggtctgaca

SEQ ID NO: 10469 - DNA, 824 bp, Zea mays
  misc_feature: Ceres CLONE 1214302-R
ccgattgggtaccgggccccccctcgagtttttttttttttttttcttttttttttttttttttttttttttttttttttttttttttttttttttttatatcacaaaagtcccatccctagtcccctcaattacatcccaaaagtctcctccctaggcataaataaaacacatctcctcctcccgtactaataagagacaatttcccatacataggcataataaaagtcccaattttcaaaacccaataacatggaagctcccgggcgctgatccccatcgggttacagggaaaaggggtgggcgatcccccccctagggaagagggtttctactaagtctaactcgctgtcttgttcatgcgtcggtaagggagttggaggggtctgatgttcggtaaatggagatgtaggtaccggggggggggaaaaccaaggataatgaaccgacctgggggggggggggggccccgggacctccagcaataggggaagcttatgaatttttctatataccctataaagctaatcccccctagaggttctatttttctctcttcatggaggggggccccatcttccccactaaaggccctactaacttgctagcctttcatgcaaacgggcaagggcatcctttaatgattataaaaaaatatccgcgtcatacctattagggacaaaacttttaatctttaacccaccaaaaaacaagttatcaacatatgttatttgtttccccaccccatctttctataaggggatctccaatattctatggcgttttcttccattagctggccttttttccagatcctgttcccg

SEQ ID NO: 10470 - DNA, 1059 bp, Zea mays
  misc_feature: Ceres CLONE 1214410-R
  misc_feature: Pfam Name: Peptidase_A22B Pfam Description: Signal peptide peptidase
  misc_feature (1059)..(1059): n is a, c, t, g, unknown, or other
tccccccccctcccccccctctcctctcgcctcttacctcattaatcaaaacctccctctaaataagatatagaattattgatctgatgttttcctactaagcgtctttgttttatgccctatgttttagatttctgaatcatcttgattgatataataaactcagatctctatttcatgagatttctcaatgggattagataatgcaggtccttcccacagctccgcaagatcctttctccgccatgacatgaagatcaccggtcctaacgtagatggtaccagataaagtagagctggctgaggtgagtgggtcaagacacctgcagctagagccgccaccaagccaatggcatatccgggaagtgcataccaaatgtatttgtgtcccttgtaagactttagatcaaaactattcaccacatctctagattttcgatgctcaaacgctagcatcaaagcttaaagcattgcccccatagtctctgtttcaagaactagcattcctgaactctgcccttttttatcttgccgcactctcaccttcccaaatcctcttctctagaacactttcacccccaatcccgcttccaccctcgtctcacttctccctatataattcaaccccacttatttccttcactcctctcactcccaccccccctcgcctatcacctaaagtaaactatcgcttatacccatcttccttttccctcctgcatatactcctttctccaccctccccacccaccctcacatctccttccccatccctgattcctcatatcaaacttgaccatatttacaactctctcctcccactcatattttccctctcacccccagacgctcttatctgactgtaactatcgttcaacatatctttccacttcgttcctaaccataacattcgacccatctactaacatcctttccacacctaccttcttcgcacttacctacattacatcctcttcacatcatcttctcccatcattcctctctcacctactcatctctcactccgactccctctctctctttcatcctctactctcn

SEQ ID NO: 10471 - DNA, 777 bp, Zea mays
  misc_feature: Ceres CLONE 1214458-R2
ggctagcaaggcagccgatgttctgcggataacgactcaaagcaaagaactaacacactcagaggaggaagaaacggggtaatgaagcggatttattctgtttggtccaagctgcccattctctgtacgggtcacgcactccatgtctccatctactggcacttggtgtttgggaggttgcacgcggaatggatggccttggcgcagctggcgtatggcctgttcttgatcttgttccactaattactgcggagaaacccaatcagcgttcctcagagatcacacacccctggatcgggcgccaatcagcggacgcaactgcctagcacgtgcacggtcgacgtacacccccgaaggctcgctcgcgctaagacagcactagcagcgcgagggcggcacggacacggaagtcttgacgcagaaccttctcccggccatctgaaatcggccgaatgtcttgggattaactacgccgcataaccgtttattcagtttaaaaaagcactcccgtggtggctaggcccagggggaatattggacctttttttttaaaaaaaaatgtttttaagaaaaggggtttccggggtggaattcccttccaggcgggggggggaaatttattattttcccaaaaagggggccccccccccgaggggggggaaaattcccccttttttttgtccccccgttttaaaaaaaggggttttataatgaccccggccttgggagccaaaaaaatggggggacaccccacccctttttttcccccctcaccaa

SEQ ID NO: 10472 - DNA, 841 bp, Zea mays
  misc_feature: Ceres CLONE 1214458-R
gtgaccgggccccccctcgaggtcgacggtatcgataagcttttttttgttttttttgtacatgcgcacacatatataaaacttcccatcggctagcaaggcagccgatgttctcggagaacacactcaaagcagagaagtaacacactcagaggaggaagaaacagggtaatgaaccggatttattctgtttggtccaaactgcccgttcgctgtccgggtctcgcactccatgtctccatctactggcacttggcgtctgggaggttgcacgcggaaaggatggcctcggcgcagctggcgtatggcctgttcttgaacttgttccagtaattactgcagaggaaacccaaatcagagttcctcagcacatcgcaacacccctggctcggggcgccactccagcaggacgcgcactgcctcagcaccgggccccgggcgacgttgcaccccccgtcaggctctctccccgctaaaagcagcaccagctgcgcgacgggcgccacggacacggcactcttgacgcgcaaccttctcacggccatcttaaatcggcggatgtcttgggttcactatgctgctgacctgttgtcagtttaaagagcactcctgtgtgttggccaggggagatctgcactttttttaatacaaaagctctaagcaagggtttgcgtgcaaattccttcaggccggggggaatcatctatttctcagaacgggccctcccccacgggtggaaaattccccccttttggcccccccttttcaaaaaggttttaaataggccgccccttggaccaaaatccggggatcctaaacccttgttttccctccgggggga

SEQ ID NO: 10473 - DNA, 836 bp, Zea mays
  misc_feature: Ceres CLONE 1214528-R
  misc_feature: Pfam Name: FA_desaturase Pfam Description: Fatty acid desaturase
  misc_feature: SWISSPROT Homolog: EC 1.14.99.33 Delta(12)-fatty acid dehydrogenase
  misc_feature (813)..(813): n is a, c, t, g, unknown, or other
gcgttgggttgtcaccgtaataatgtcgttgggctctcaagaacaagatccttgtatgaaatgtattctactgatcatatattatttcatttgatcgagagttttaccacaggtttctacaaattaatgcttttttaatctcgaaaaggctttacaccaaaacaaaaagaacataatgaatgggccaagatgaatttatgtaacttgtctgcctggttcactgcagtatgtcctcatgttctttgtccattgagttttggatctgcctcatagtacacgacatctcctgtatcgcttacgaaatggtcttgtttcatactctttatgaggcttcccagtaagtgaagtggcagaggtccagagtttttcggttctctgtagtactttcctagtactggtttagctgcttctgttgcttctactagatgataatgtgggatctgcgggaaaagatgatgtatcacatgagttccaatatcgtggtggatgttattgatccatccgtagtcacgatctaatgttgtgagccctcctctcaggtaactccattcctttccacgataccaagggagcttgtcttcatgtccatggtggtgcaagtaagtgacgaagtccaaccacattacaaatatccaataagggatgccatatagtttgagcatctggattggacccatgacaaagttgagacaaacaagcaaagcagccattgcagtccaacaggcagttgatgtcagaacatctttcttctcttttggaagaaacagtcactgtccggatgataatgagaaccttgtttccctggacttctgntccaccagtagaaagttatgcga

SEQ ID NO: 10474 - DNA, 827 bp, Zea mays
  misc_feature: Ceres CLONE 1215167-R
gaccgggccccccctcgagttttttttttttttttttttgactagcattattattatattagctaagctaagctaagcaaacagcttccagtcatcggttgcagcataagctttagtgtcaacaacacatacatacactgaaacctaactaaatccgattacgaagaggcacttccaaatcagctccgggagaggaagaactcgtagtctggatgtctgtttctactcgtctgcccattcttcagcacgctggccctggacaacacggccgcagcctcactcagcgtgcgcgatctctccttcagaatctcggatgcttcactgtcctgcgactgcccgccttcagattcggacttgctcatctcaaaccaccactctgccttggcattgtaagactgcaggcccatgactggcaaaacagcggccccacctgctgagctgctccgacgaatccagtggccaagagagtgatatgtcaagaatgtagcctggaattttccatcaggtatccggtatatgggataccatgcaacacaataccagatacaagtgcacgttccatgaaaagagagcataccaagacgctggatggagatcatgcaggctggcctccagattctttgggtccccagatatttggcaatttgacggtttcgcaccggcaatcagctcatttaccttgtcaaataattgtcgccgtgagtatggctgttcatattcaaaaaattcaaataccagctccccatctgctgactgttgatcatcttcagtacgcagagtagatggtttatttactggaacagattgttttggaaaagctttgcaat

SEQ ID NO: 10475 - DNA, 790 bp, Zea mays
  misc_feature: Ceres CLONE 1215167-R2
gctaagaaacggcttccagtcatcggttgcagcataagctttagtgtcaacaacacatacatacactgaaacctaactaaatccgattacgaagaggcacttccaaatcagctccgggagaggaagaactcgtagtctggatgtctgtttctactcgtctgcccattcttcagcacgctggccctggacaacacggccgcagcctcactcagcgtgcgcgatctctccttcagaatctcggatgcttcactgtcctgcgactgcccgccttcagattcggacttgctcatctcaaaccaccactctgccttggcattgtaagactgcaggcccatgactggcaaaacagcggccccacctgctgagctgctccgacgaatccagtggccaagagagtgatatgtcaagaatgtagcctggaattttccatcaggtatccggtatatgggataccatgcaacacaataccagatacaagtgcacgttccatgaaaagagagcataccaagacgctggatggagatcatgcaggctggcctccagattctttgggtccccagatatttggcaatttgacggtttcgcaccggcaatcagctcatttaccttgtcaaataattgtcgccgtgagtatggctgttcatattcaaaaattcaaataccagctccccatctgctgactggtgatcatcttcagtacgcagagtagatggtttatttactggaacagattgtttttggaaaagctttgcaaatattgcgggcaggttcagctgtggagatgtttcac

SEQ ID NO: 10476 - DNA, 828 bp, Zea mays
  misc_feature: Ceres CLONE 1215176-R
  misc_feature (804)..(804): n is a, c, t, g, unknown, or other
aattgggtaccgggccccccctcgagttttttttttttttttttttccaaaaatccctttccagcaagagaaaaacagggtacaaaactttggactgttgaaagcagttcgccagcgtacaactcatgctgtacataacatagctaaccagctacacatgtgaactgaccatcagacccaccaccaccaaccccgccaggagccaacagaacaaaaaaaggagattaaggagtccaatgtttgtccttaggtcaaataagtggggcttctaggcatgctaagtgagtgagagagagagagagagagatcaaagaagaattcttggctcatggaggtggcagctggggccttaaatacagactataaacatgtatacagctatgctctacaagattccattggttgaagaggttgttgaagatcaccacgtcacataccattaggagaggttagtgcagggggagaagattattcatgttctgcatcgttgtcagtcagctcgtcgtcctcctcgtcatcggtgtcttcctcgtcgtcatcgtccgtgccatccgaagaaccgaagattgcatccttggcggcagcagaatcaccaaatcgtctgagctgccctgggttcattggtggtaccgaggaaagtggttttggtgctagtggtttcaggtaattcgggattatttccccaggcctaatgtagatggcgccttttgactgagccgcttttatgattgtagctgcatcagatgatgatccaatgcgtgcaccggctgcaatggctgcagcccttatagatgaaccctcagnatttgcacgagaatcaatactgtc

SEQ ID NO: 10477 - DNA, 783 bp, Zea mays
  misc_feature: Ceres CLONE 1215220-R
ttcagagtatattgcggatgaatgattaagctcaaagttggggtctcacaaaccgatcgacggcggctgttctcgacagatctaaacttaagcaaaacccaaccctaatgtggcgtcggctgctgaataaatagagtattagggcgtgcgtgacccctggacgcgcccctaatgggctccaacgtgatacacggcccaacagacggtgtcgcagcaccaaaacagaatctgaacgctgacttgtttcgacgattcccgttgactccggccgaattttagggtggaaccagttgggttggttagataatctccttatctttccaaccatatcaagttcgtcgcaatcggagtctggatgcatcttgggcgttcattttagtgcagactggtcctggaacccgagatggagtcgcagtcgagtcggacttgatctccttcctgttgtgggcgcccttgctgctcctcctcaacaactaggcctttcccaagtccttgctgtcctctccaaggttcctaatcattaaaacatccatggcccccagcgtaagctctgaaacacaattgactagggtagaacgtacctggaagaattagctgtcgtgcacgcgaatcctggtatcgggccatataatggatttatagaaagggaaggtcttaatcaaaaacttttggtaaaaggtttaaaatcaggaaaagggtcatttggcttaaccctttcccattaaacccaggggttggggggctaatgggctcaaagaaggggggttctagggggtttaaaat

SEQ ID NO: 10478 - DNA, 866 bp, Zea mays
  misc_feature: Ceres CLONE 1215326-R
  misc_feature: Encodes the peptide sequence at SEQ ID NO. 10479
  misc_feature (866)..(866): n is a, c, t, g, unknown, or other
cgattgggtaccgggccccccctctctctctctctctctctctctctctctctctctctctctctctctctctctcgctcactcacgctcactatgacactgactagctcgaaaacgagcgacagcgcgggagatagatcactagcagacgaaaaagagagatagagatgaagaaaggagatagaccccatcatttgtttcttaagagctagactgctcaatctctctccttagagcattacccctaaccaaacttccaatggtgctcaaggccaactcgataccctccgaggactatccggtgcaatccgcttgcacagatagctagcgaatgtcatcgtctgaacatagtcatcatgtacacatctccacaaacgcttctctaaccggatatgatctgtaaaatatttcccgcaatacctcacgcaccctgtacgtatgcaagcacgtcctatcccatttctccaagtacttcctcaagtccccttcgtcactcatcttcttaccaattctgggaaccttcgacaaaggcttgagcacacatgcttccactcttagcagcaaaggagatcccttccccagagcatttaattccatacccctgcaggctcccctacgagagccacccgtttcgaaagtctacgtggtctcggaagttccggaaacggatgagcctccacacgggtgatcttccgtccaagatccttggccttagctcggtttctggccgcgaggtgaaacttctggatgccccctttgtgagtcccaatacctggtccaaagctaaatggcgggccttaaggaacacccaaccatagaaatccgtggaaacattatcccccaaaaacatctacccaaacccccan

SEQ ID NO: 10479 - protein, 91 aa, Zea mays
  misc_feature: Ceres CLONE 1215326-R
MLPLLAAKEIPSPEHLIPYPCRLPYESHPFRKSTWSRKFRKRMSLHTGDLPSKILGLSSVSGREVKLLDAPFVSPNTWSKAKWRALRNTQP

SEQ ID NO: 10480 - DNA, 836 bp, Zea mays
  misc_feature: Ceres CLONE 1215448-R
  misc_feature (718)..(718): n is a, c, t, g, unknown, or other
  misc_feature (786)..(786): n is a, c, t, g, unknown, or other
tgggtaccgggccccccctcgagtccgacccggttcccccccaccccacccccggcgccccgtcttgcgccgttacctgctcctcgtgcagccacgacgccacagctcgcgcccatctccgcgccacgcgcggccacgtcgaccccgcatgcgccacgcgcggccacgtcgaccccgcctgcgccacgcgcggccacgtcgaccccgcctgcgccacgtgtggccccgtcgatcctgcctgcgccacgcgtggccccgtcgaccccgcctgcgccacgcgcggccccgtcgaccccgcctcgcttcgccaaccccacgctcgtctaccaccgccgcggccacgccactacctccgcgccccccgactcgggcccgtcgacgagcgcgccccgcttcgccgaccccgccgtcgtctatcaccgccgcgagccggccacaccagccgtgcgctccgagccgtccgtataccacccggtcgccatccaccgcgaccccggacacgtccacccgatggtgactcggcgcgccgctggcgttttttgccccgtcgaccggctgatcctggcagctgatacgtccagcactccacccgacgcttccccggtgccctcctccgttcgcactgccctcgccgacccacattggcgtcgtgctatggaggaggagtacgcggccctcttggccaacacacctaggacctgttgccgtgtccaccagncaccaacgtggtcaccggcaagtggctatttcgccacagctgacctcggatggctcctcgacgctacnaggggccgttgggtccttcgggcttcacacagcgccccggagtggactac

SEQ ID NO: 10481 - DNA, 816 bp, Zea mays
  misc_feature: Ceres CLONE 1215689-R
ggtacgaggccccccctcgagttttttttttttttttttttcatttttttttttttttttttttttttttttttttttttaggaaacaacacgtgcaaaacatccccaaaaaacaagcaaacaacaaaattggtatctagtctgtcttgaatctgtgtgaaatcctctccaggccatccttgcactcttccattgccctcatcgacttgtctccaagggttgcaccatacgcagatacgcttcccttcacttgtgctgataccatcgtttgccctgaaagcagcacaagccccaaactcgatacaccactgccttgcatctgcagcttgctgctttaggattgcgatgaaggacctcacatgctgcatcactctctccaccgcaccccgagaccgcacctccatctcaccaaacattgtcttgagcttctccagcaaaacttcagcacggttgatagactcgtcgactgcgtgttctttgccagcgttagcccatgtcaccccagctgaggcgtcatccttcagttctccttcgaaaacaactctgattccttgacgctcccattggttccgggcctcctcaagggcgcgtgcatgctcccgggcctttttggctacctcctctgcccaagcccttgccataaataacgccttcctctccacttcaagctcatactgaagttgcacaacagccgagttatcactctcaaatttccttttggagtttctcaatcctactcttctcgaaagataccctcccccttcttgcttcaatacgtttctgcaggtggttcctcctccctaactccccaaattc

SEQ ID NO: 10482 - DNA, 870 bp, Zea mays
  misc_feature: Ceres CLONE 1216599-R
  misc_feature: Encodes the peptide sequence at SEQ ID NO. 10483
  misc_feature (812)..(812): n is a, c, t, g, unknown, or other
gggtaccgggccccccctcgagtttttttttttttttttttctttttttttttttttttttttttttttttttttttttttttttttttttttttttgcacaaaagggggttccctaacccccgggcaatccaataaaaaaaccttataaagagatcccccggtggggaattactagggaatacccaaaaaaagttgctagcataaaaggaaacccctcctggtacataatctaatctactatcaacataaacaacaaactccggggcgacaatcagtcaaatgggtgcctggaaccccaaaaagcccaaaatttgctccccccactccgggactactgggacccgggcagaaaaggccgggacccccacttatgctcccttgctcccagcttcatggggcatttccccgggggatcccccaatccaaaatgggggatttaaaaaacccggggggcccatggcaaatacttaatttccaatgggaaaaacgatggacccaatggcttaccctttcccgaaatgggaagggcctggtctgcatcaaaactcttaaaaaaaactacttttgcaaactttgacttcttaaagatcccaggccccccctccccaatagggccctgaataccgaatatgcttttggtggcctcaacaaaaagaataacttctggactgctgaaatggaaaataaaggcggctggaccatctgcagggtttgcattcgaagatggggctccttgagggggccccccccgcttcatcttcttaatggggctcccgttacagggccgcttcctccttgtgactggataanccctgtctcccccatcgaaatcgctgatgaaataatccccccatatagatcttcggcc

SEQ ID NO: 10483 - protein, 38 aa, Zea mays
  misc_feature: Ceres CLONE 1216599-R
GTGPPLEFFFFFFSFFFFFFFFFFFFFFFFFFAQKGVP

SEQ ID NO: 10484 - DNA, 719 bp, Zea mays
  misc_feature: Ceres CLONE 1216603-R
  misc_feature: Pfam Name: TLC Pfam Description: TLC ATP/ADP transporter
  misc_feature: Functional homolog of the protein sequence given in SEQ ID NO 96869
  misc_feature: Useful for making plants with atered amino acid content
cgaatggtgactggtattcccctcgagtttttttttttttttttttaggggggggggggggactagtgagctctctctctctctctctctccccaaggtaaggtgtggaattggcgagtgagccgaatgtaaggatcatgaactgctggattaaagcaccgcctgatttccccaatgggttgcagaccacatcaattgcagctttgcctttaaccttggtgtcctcatccaatgggatataagccatttctttgcaaggatcgaacaagctgtacttggcactcttgctgaagatattctggagggcaccaacgtacactgctgcgagtagcggtgtcataccaagcttggcaaccaatggtgctaatgggccaccaaacagtatcagagagaagaaggcaacaccggtcaatagcagaacggttggtgtgatctttgcagctactccccaaccatacttcttaaacacgtattggcttagaagcatcattgtgaatgttgcaatacctgtgcaggttgagaagtcgcccataaatgctgagtattcgttcgggctagggaactgagctttaagctttgatttccatgtgacttcaacaaggttgatactaattccatatgcaaccaccaaagtagcaagatccctaatgtatggtgatgacaccaagaacttcaagctctccattgttcccatctgtggtttcaccttcttcttcttg

SEQ ID NO: 10485 - DNA, 925 bp, Zea mays
  misc_feature: Ceres CLONE 1216823-R
  misc_feature (1)..(1): n is a, c, t, g, unknown, or other
  misc_feature (862)..(862): n is a, c, t, g, unknown, or other
  misc_feature (896)..(896): n is a, c, t, g, unknown, or other
  misc_feature (925)..(925): n is a, c, t, g, unknown, or other
nccaccaacgaattgggtaccgggccccccctcgagttttttttttttttttttttcacaataaaaacatggctatcatttaaggtacaataaagtgcagatattagttctcctccctcgagtgtcagcaaagcacacggatataaacttctcctagacgatacacggatagatatggagctttcatcaggattcaatcctgccagtaacaaggtggtggtgcatcacttcacttgccttcctcgatgatcctgatggctttgttcacagcagcggttttctcatcggggatggctccaccctctgggagatcaaatttcctgcggctcagtgatcgctgcttccctgggggctgagggtccacaacctccagcattgcttcgagctcctctagcatagatttcttcgcggccctcaccatgtagtcaggtccctcgagtgcatctacggtgatgagcagcacgatgatcttctcgggggggggggggactagtgagctctctctctctctctctctctccttccacaggttcatcttcgcctgagcagtggttgcaatgctgacaacctggggggggggggggtttgggtgctataataaatgtgaataattgtagcttaaacctcgggactagtttattgatgttaaggaagcaaggatgagaggagggtaaaacctgagtgggttgaaggaatcggggttacccttgcccgtagatgagttattggcttctttttttcgagtaagggccatccttacaaaaaaaaagcgtgggttatgtccgacattcagatgattttatggcacggacgggacgtgtgggtgaaaaggggcgaccccatgtgtatctacgatcggggnctagataaccggcgtagaatctacacctcttttngtcgtagagttggacaatcgcggcctgcn

SEQ ID NO: 10486 - DNA, 876 bp, Zea mays
  misc_feature: Ceres CLONE 1216832-R
  misc_feature (732)..(732): n is a, c, t, g, unknown, or other
  misc_feature (750)..(750): n is a, c, t, g, unknown, or other
  misc_feature (841)..(841): n is a, c, t, g, unknown, or other
  misc_feature (855)..(855): n is a, c, t, g, unknown, or other
  misc_feature (860)..(860): n is a, c, t, g, unknown, or other
  misc_feature (861)..(861): n is a, c, t, g, unknown, or other
  misc_feature (870)..(870): n is a, c, t, g, unknown, or other
  misc_feature (876)..(876): n is a, c, t, g, unknown, or other
tcgagggtatgatcgtcgcttcgcctaggcgcatggcgctccggcccgctctgtgtagctcgtgtctgaatatagaatagtgctccgtggcgccagtgagccttacgccggcgaccgcttcgccgcagtggctcagccacgccgtgctagaggaatcggatggaggcgatggtctgtggaccgttgatctcgcgacatgaggcttagattagatcctaggataacccttcacgtaataaaatcgggaccgccaagggttcggatttgttaatggcgtggtcgcgcgagggctgtggatctggtatcgaacgaccgcgagcgcatactggtttgtttataagattagtttaatctgcaccgtgggcttcagatccaacggtccaggttcaatggtaccccttcgccgtgtcatgtttgcataagggaccccctgactatatcaaaaataacccgctgtaaggaaaatggaccccgggccttttggctaattgagttttggtgtttgatgaacaacacaatccgtgaactaataagttttcaagtgtttgtgtttgtagttcacaggatgcgaagagaattggaccaaggcaataaggatgcaacacctcaaaagaagacataaaaagatgcataggagtccaatactcaagaacaaagaagcccgaagaaatcagcgaagaaatccaagataagggctgtcagccagcgcctggtggcgaccgggacattggntgtccggtgtgcaccggnactgtccggtgagggcacagacagtctgcgcagagaagccgcagacaggcgctctctggtggtagcacccggactgtcccgtgtgcaccgnaactgtccggtggncacgnncaaaacggncatggn

SEQ ID NO: 10487 - DNA, 714 bp, Zea mays
  misc_feature: Ceres CLONE 1216873-R
  misc_feature: Encodes the peptide sequence at SEQ ID NO. 10488
cgattgggtaccgggccccccctcgagtccgacccggttcccccccaccccacccccggcgccccgtcttgcgccgttacctgctcctcgtgcagccacgacgccacagctcgcgcccatctccgcgccacgcgcggccacgtcgaccccgcatgcgccacgcgcggccacgtcgaccccgcctgcgccacgcgcggccacgtcgaccccgcctgcgccacgtgtggccccgtcgatcctgcctgcgccacgcgtggccccgtcgaccccgcctgcgccacgcgcggccccgtcgaccccgcctcgcttcgccaaccccacgctcgtctaccaccgccgcggccacgccactacctccgcgccccccgactcgggcccgtcgacgagcgcgccccgcttcgccgaccccgccgtcgtctatcaccgccgcgagccggccacaccagccgtgcgctccgagccgtccgtataccacccggtcgccatccaccgcgaccccggacacgtcccacccgatggtgactcggcgcgccgactggcgttttttgccccgtcgaccggctgatcctggcagctgatacgtccagcactccacccgacgcttcgccggtgccctcctccgttcgcattgccctcggcgacccacaattggcgtcgttgctatggaaggaggactactcgatccctcttggacacccacactgaggagctggt

SEQ ID NO: 10488 - protein, 187 aa, Zea mays
  misc_feature: Ceres CLONE 1216873-R
DWVPGPPSSPTRFPPTPPPAPRLAPLPAPRAATTPQLAPISAPRAATSTPHAPRAATSTPPAPRAATSTPPAPRVAPSILPAPRVAPSTPPAPRAAPSTPPRFANPTLVYHRRGHATTSAPPDSGPSTSAPRFADPAVVYHRREPATPAVRSEPSVYHPVAIHRDPGHVPPDGDSARRLAFFAPSTG

SEQ ID NO: 10489 - DNA, 807 bp, Zea mays
  misc_feature: Ceres CLONE 1216873-R2
  misc_feature (679)..(679): n is a, c, t, g, unknown, or other
  misc_feature (749)..(749): n is a, c, t, g, unknown, or other
tcgagtccgacccggttcccccccaccccacccccggcgccccgtcttgcgccgttacctgctcctcgtgcagccacgacgccacagctcgcgcccatctccgcgccacgcgcggccacgtcgaccccgcatgcgccacgcgcggccacgtcgaccccgcctgcgccacgcgcggccacgtcgaccccgcctgcgccacgtgtggccccgtcgatcctgcctgcgccacgcgtggccccgtcgaccccgcctgcgccacgcgcggccccgtcgaccccgcctcgcttcgccaaccccacgctcgtctaccaccgccgcggccacgccactacctccgcgccccccgactcgggcccgtcgacgagcgcgccccgcttcgccgaccccgccgtcgtctatcaccgccgcgagccggccacaccagccgtgcgctccgagccgtccgtataccacccggtcgccatccaccgcgaccccggacacgtccacccgatggtgactcggcgcgccgctggcgttttttgccccgtcgaccggctgatcctggcagctgatacgtccagcactccacccgacgcttccccggtgccctcctccgttcgcactgccctcgccgacccacattggcgtcgtgctatggaggaggagtacgcggccctcttggccaacacacctaggnactggtgccgtgtccaccagcaccaacgtggtcaccggcaagtggctatttcgccacaagctgacctcgnatggctccctcgactgctacaaggcccgttgggtccttcggggctcacacagcgcccc

SEQ ID NO: 10490 - DNA, 877 bp, Zea mays
  misc_feature: Ceres CLONE 1217336-R
  misc_feature: Pfam Name: Abhydrolase_2 Pfam Description: Phospholipase/Carboxylesterase
tcgagtttttttttttttttttttcttttttttttttttttttttttttttttttttttttttttttttttttttttttttttttttttttttttttgggcccccacgggttttttttttttttaaaaaacatcaaaaaaaaaaggaccgcttttcttaaagacataaaggacgtaaattagggcgggggaaaaaaaagccccttgggaaaaaagcagctaacatcaagggttttaaaagttataaaaccaaacccccccccaaaaaatatgggggcgccaaaccctttggggataccccaaaaaaaaactttttttttaaggaaatcggccgaggccaagggacgagttaaaccccttggaaagggcgcccagtttttcagggatcgaaaaagggccccacccgttggagggtttgaaaggcaaaaatgaaaatcctgggttccccaaaaacccagggggtttccccccctcccgggaaaagaaaaattcttccactcttccatgacaaaacaggatggggaaggagcccaccctttttaaagaaaaatgggaaccctcccttttgctcctcagggtccttgagcaagggagcccccccctcaaactgatgactgcggtgagggggattggaaaaggaaagcccccttgggaatttgccatgaacataaaagggtggtgagggaagggaacggggggggcccatgttgaaaccgccaatcccaaggttctcatttaaagggttcaaaaaaaaaaaaaatttcaatggtgggcactgaaaaaccccagcccccccaagggggcccgggcaattaataaaggggcccccaaggcaaaaccgtgtttgtggaggggaatcccccaaaaggccggggagg

SEQ ID NO: 10491 - DNA, 868 bp, Zea mays
  misc_feature: Ceres CLONE 1217480-R
  misc_feature (625)..(625): n is a, c, t, g, unknown, or other
  misc_feature (639)..(639): n is a, c, t, g, unknown, or other
  misc_feature (690)..(690): n is a, c, t, g, unknown, or other
  misc_feature (730)..(730): n is a, c, t, g, unknown, or other
  misc_feature (747)..(747): n is a, c, t, g, unknown, or other
  misc_feature (800)..(800): n is a, c, t, g, unknown, or other
  misc_feature (868)..(868): n is a, c, t, g, unknown, or other
tcgagttttttttttttttttttgaaagccgcaacccgcaagcataacatgttcagcacacatgcatttcgtgtttagcagactctaacgagtacaaaagcttaggagcttgtgcgaccaaaccattattcaaatcacttttttttctcaccaaaaacagatcccatcacacaagctgtccccttgtaaaactagaaccctctgcttcaatctcaaatcagctgcaaaatgcacccgccattttacaaccattcatgccgcaacacaaacttgacatccaaactttcatagcaccctgcaggctagataagaaccacctatgttgtagggctgtgggatccggcgacaagtcggccggtgcttccatgctgctgccctcaacagaatttctttattctgccattcctctagttttcaggacacaacaagtttcacgtgatcggcggctattgcttctttccatctttgagaaagaaaggctgtcgcttcttcactggaaaacatggtgcattgtaaatgttcatccactgccaaatctgcatcgcagcaggttgaataactgatttcatctgtagtaacactgaggctagaacggttatcactatcaggaacaccttcatttctngttccttcatgggnaacttgttgcaccaccttgactgatgcatgttttcttgtctttaaaatggngagtactgggtcattcttggaacctaagtccagcaagtgntcactaccatcttccantgcggacaatatagatcctattagcacacgagagtttttgctaagacccatgncacgttcatctacatctaactcagggttctggcactgtttctcaatctcagaccgtaagttcattccn

SEQ ID NO: 10492 - DNA, 799 bp, Zea mays
  misc_feature: Ceres CLONE 1217533-R
  misc_feature (726)..(726): n is a, c, t, g, unknown, or other
cgattgggtaccgggccccccctcgagttttttttttttttttttactcagaagaagaaaaaaattaattcttcaaaatgatgtacatggctcacttcattcgccaatgatcagtaaatcggccaaacaacccaacccaaccacaaacacgcacatgctaacggtacatgagaaagatgctgcagacagcaaggaactacgagttcccagctgctgatcatcattcgatcggggcctgtaacatcgccggtagcccatgaaacgacatccacataatattgtggctgaagtccattgttcatggcagcagcttctcttcacaaatgacacggattatgtgttagcatgtgtacagactgcgggaacagcagcagcaaaatgcccttcgccgctgctgtggccttggagcttgatgacggcgctaagactgagtagctcttagcgctccatgggcagctgatatccaatctcggtgccagcagggggaagaacgccccatctaattctgtgtgtctagtatgtcgtcagtcagctcatgatttcctggaagacgagagcaagctcttgtgcagcatttgcaactgccccttttcttcttgtaagagatggaagcttatttttggcattctccaattcaatgaagcataaattgcagcgctccctcctttgctctgcctcaaggtctacaccaacacaaggacctgacgatactgttgaatggatcanttggacaaaagtcctttacagcttcaccaaacaattcaatgcgacgccctaagtgtctgtcaattttactctt

SEQ ID NO: 10493 - DNA, 1092 bp, Zea mays
  misc_feature: Ceres CLONE 1217626-R
  misc_feature: Pfam Name: RnaseH Pfam Description: RNase H
aaccggtcgagattctaatcgccgcaaggcattgcatgagcgcggggtcctttgctgcgtaatctttttctacctggccggcaactatcttggactctgttttgatgatacaggtggtgactccgatggctcttagcttgcggaggccgaggatgactgcttcatattctgttatattgctctttgtttttttccgattccaaagcgaagctgaggcgtcccgcctttcttttacttgacccccgccttttgaggtgatttattggatttgagtttttgagacataattgtatctttaacctattgcagatggaaaatatgaaaatccttttcccatagtacggctccttggcccccaactccctccccccatgatgaggtgcgttatagaatgttgtttcccggttttaccccacaccctttgggatgggtgtggagtcctgtaaatatatatcatagacattatgaggctgaatccacagcacgcctacatatcttcaacctcccgcgccacaaatgattctcgtcgcccttccttcaccatctatctatctcatctctcccgcctatacacatatacgttctatctcagacaccacaaatacaccgatcacacaactaccactacttctctcgatactaatttttaaataaccatatgctggaccagacaacgaagaggacatcacttacactacagtaccccggaccctatataaactacaacacgaacaccgtcatattcactctcttatccagagcaaatggttctactgtcacgagatccacatctaaccgatgcgcccattcaaccttgccttctcttcaaccatcacccgcgagaataatctaccatttaaccgctcgggactgatgtttggttgaaaccgcggatggattgttgtacttacactgctggcagatgactccatgagagtagcgctagaagattgtacgtcacaaccccctttctctttttcagttgtaattgtgattatctcgactacgacagcatgtgcctacccgttgcgcatgccttatttcaccgctacgcttctcttctttctcgggcgcgctctctcacgttgtcaa

SEQ ID NO: 10494 - DNA, 1038 bp, Zea mays
  misc_feature: Ceres CLONE 1217626-R2
  misc_feature (1)..(1): n is a, c, t, g, unknown, or other
  misc_feature (993)..(993): n is a, c, t, g, unknown, or other
  misc_feature (1038)..(1038): n is a, c, t, g, unknown, or other
ntccaaataaacaattgggtccggggcccccctcaagcttctcatggccgcgaggtattgatgagcgcggggtcctttgctgtgtaatcgttttcgacttggcccggaactatctcggacactgcttggatgatccaagggagactccgagggcctttagcttgcataggccgaggatgactgcttcatattccgctatattgtttgtgcctctgcccgattccaaagtgaagctgaggcgagctgcctatttttaatgaaatgcttcttgtgaggtgatgattggagtgaggtgttgtgtacctcaatggtaccatgcgacaacgcacatgtgataggccacactttatttgtggacggttctggctgtgttcttggtcgtttagtataatgagtaagttttttttggaactcccactcccaacaattggttctgagcttggatgactgactgtcgtaccccggcatcggtagcgctgtcttacttagagcgctgtctcactccatgatgttctattttttcggagaaatagtttggtacagattcccttggacaacagcttgatcttctttaaacttctaaactgcttcccttagcttcccgcccttctctttttgatggcggagagacacttagctaacctgggcgcgaaagcaaaagtgtatcttttcaaacgtctgggtcacttgaagttcagcgtttcgtgaggttctcttccaagaaatgcttctggtaaaaaaatgaactgagcactagggatagatttgtcttgtagcacgcttattttatacaaactgtactattagttcgaagaaacctatatgtctttcgttatctgtgttgctgttcgctgtttatcgatcaatccagccgctaagcgtgatgttgtcactactcgggtgtagattctttaagccagatgccgggatcttttgtttttacacaaactttacctacacacctctcctacgtttggagtcctttattgctgngtgtcttgatgcgatgatatgtgtcactgttgtccccttgtcttn

SEQ ID NO: 10495 - DNA, 834 bp, Zea mays
  misc_feature: Ceres CLONE 1217685-R
  misc_feature (584)..(584): n is a, c, t, g, unknown, or other
acgggccccccctcgagttttattttttctattatctcttttttttttttttttttttttttctttttctgtactttattctgtttttcttcttacttgtgttataaacttctttatgtgtcttatgactctattttatactaattacactttggaaatattttgtttctacaaattccaaaccactttccgttgggaaccaccacccaccatgtgaaccaaggaaggaggcttgagtttgttaataaatttgttctctgaggccacgccaccaccttgaccaaaaatagtcccatcgcgggtggatcttggacatgcggccgccaaaagcgtactcggcgcggcgggcgttgcggaaagcgcaacagccgcaggagcagacggcgatgagcaacaccacccccccggcgttgacgatggtgacgttgtgccagtggcggcacagctgctccatcaccccggccctgcacgagtcgcagccgtaccatagcaccgccgggtcggtctgccccggaaccctcctcgtcctgaccgccaccaccgccgggccctggcccgtcagcccgtcaccgccgtagacccangacgtgtgcggcttgcagcagccagactgaacgggcctcaggtcgcggcgcatgtagtcgtcaggcgtccatccggccaccttgaggcacgccctggatctggccacgcactccaccaccggacgccagtaccggtcggaaagacacgtggtctgcttagccacggcgcaataatccccgcatccgtgtactcgccggtagggccctcccggggcaccgttccggacacacaaccacccggcccgtgaca

SEQ ID NO: 10496 - DNA, 969 bp, Zea mays
  misc_feature: Ceres CLONE 1217803-R
aacgtctttattaatcctttataccaattaatttttacccttctttttttttctaattgggtaccgggccccccctcgaggatttttttttgcttcgtctgcacatactaacgccaaacctcctgaacaaggtggaagggtccacaataacaacattaggtaggatctcaaagtagaagagtaccccgaggaccacgattgcttcttgatctactgtggagatatggtgaacgccttgactcggcaccgcatgaaatagcgccaccagggctgcacgttatgggtgaattcgccagtctacctagactggcccgacaagtccatcacctgtcgaccagggcgactatttcgttggtgtgccgagctcggcaaattatccgctcgatgtgcaacccttcatcttttactgtgagactcaccaaggtcctcatggacggagtcaccagtctccacatgatctacgctgaaaccgtcggagtcctacggatccatctgtcctttgaccgggtggcagaggtacctttttccgtgaatataccaggtaaacacgcttccagccccttgaataaactcgcatgctgctcgcatggatctggactccctccaccttatcgagggaaaaaccttcacgttgtatgtgagacggtgtcctatctaactagcacacctgtgtttgggtagcccattgaatacgtccaaagacatgggtcgtctctctctaacagcctacctcaaggtcataaatggggtgcacaccacagttttctatccacggtatatcctcaccaatcaaactcagggtgacaaatgacaaagggtaagagccttcgaatttacttcctaggcccctcgtctgaacccgaatacccctcaattgccctagacgtggcagagtcctctccccaaggaaggtatccaaaaacatcctgtcgcgtctgattagacccaatttcccaatgcagtgtccca

SEQ ID NO: 10497 - DNA, 875 bp, Zea mays
  misc_feature: Ceres CLONE 1217875-R
  misc_feature (742)..(742): n is a, c, t, g, unknown, or other
  misc_feature (744)..(744): n is a, c, t, g, unknown, or other
  misc_feature (875)..(875): n is a, c, t, g, unknown, or other
caattgggtaccgggccccccctcgagttttttttttttttttttttatctgaagacattttgattaggatgacatggattacatcttcattcgcaactttcttaacacattttagtagcatgagataactttcacaatgaaactttgatgtatacttctccaaaaataatggtcaaccgtatacatgttagcaaaaacgaactacaactacaaagcctatttgcacgttttttgtcctgacacaagggggggagaggattaagttagcttcgttgtgacctcaaaggaaagaagtgttctacttgtacattactacattacatggaatttttttgcagaatggcttccttagcagaacgggtgccctagtcaggctttgtgtattcaagcagcatatgtggtgatctatagatgtttaccaatgtccaatacagaacttcttccacttctaactctccttcagctcttgctgcatatattccttcacagatgtcaagtagcctgtcacatgacggaaggttctcatatggtattctcattctcaagtctgagcactgaagcctaataaatctcgcaacagctagaacaaaagtaatatataaactccatatgctaaatttactgagtgtttcgccaataatgccctgaggtgtctcctcagaaacaactatagccatgggaccattcagcccttgacagcctgccaaatctgatgggtttgtatcatagaatgaccaccangnagtgccattatttaaatagcattcgccacttactgaatctatcgctgcttctaatcgccggacttcaccctgatcagtaactcgaaagtaccttgggtaagcatcaattatactgaagctgtttgcagttn

SEQ ID NO: 10498 - DNA, 1011 bp, Zea mays
  misc_feature: Ceres CLONE 1218185-R
  misc_feature (1011)..(1011): n is a, c, t, g, unknown, or other
gaccacgcccgaagaagaaccccttttattttcgaatggaacgatgtcattaatataaacgaataaataagagcagttctaatctataatcagattgcacaagtcacaagatagctggttctggtttttcataacaaaaaccgactacaaaaccaaagatcaacagcattgtagataactcacttatcaagaccctgcgacaggcttatatctcgataccaacgcggtcaatcatcctgctcaaccttcacactctgcagcttctaattcagttagtcctaattatcctcaaccctcttcatcggtctcataaagggaatctggtagggtcattctcatctactcgggccagccacaaaaaggggaatacatactcgcgcctaaagatttgggcccccccccacccacagcaaatcctataaatgaaccctcccatagcgcctaccacacacccgcaaaggctgattttattcctacacttgttccgctacagagaaatcaaagttcgcaagcgcttatgccgcacatagtcactcccgaccatcaaaaaaaatacttataaggaagtaaacggtcgaccctaccaacccgttggaatttgggagacagtaacgatccggggtccgggatatatactgtatcaactgtcgatgtttatattatattaacgcagtgcagagccaatccttatgcgtcctcgacctcaacctttacaactcgaagtgacacgagttactcaacaaggattagacgcgtccaggtttcgagttattgtcagagagccacgttagctaacctgcttgtttacccgctgcgggctacgcgatgatgatcgccgtcccatgtaccatgcggattctcggggcagaatcgataacataccacctatgtttatctaccacaaccactacaatcaggcgcagtaatgactccctaaaagatcaaatattggaaccatgcggcgccatgttaccataacctaattgtttcctcccacgctatacttttacn

SEQ ID NO: 10499 - DNA, 1033 bp, Zea mays
  misc_feature: Ceres CLONE 1218276-R
  misc_feature: Translation starting site: 104
  misc_feature (764)..(764): n is a, c, t, g, unknown, or other
  misc_feature (1033)..(1033): n is a, c, t, g, unknown, or other
cccctccaccaacatcatccccccctcaacatctaattttttcttcttcttttttattgggtaccggccccccctcgaggatgtatctgcgaaataaaaagaaatgcccagcaaatgccaggaaatttcaggtggaaactgtaagctactgaagcgaggtgaaatggtccagttgtccttacccatcagcttggccacactgcccaggacaggcagaaatgcaggccaacaatctcccactgccaaattgctcttcaatatgagtgtcgagtgcacgatcctgctggggcttctcaatcttcctctgcacatggttactcttctttgtttcctcaactatagcctcaccctcttgtccctgcacaaacaataatggctagttataagataccttcactagcaatagaaaggaaactttaaatttaactaactgtttttccctaaaaaaaccccacaaggaggattgctaaaaatcacaaaaaaccaattggaggccctttttcccccaagaaaatgttaaaaacaaggctttaaccaaaggtaggcttaagcaaattccccccctggcgggatcctttataagaaagggaaaaagaatttcctttgtaaacaaatctacaccccacaaaaaaacttggcccaccggctttataataaacactgggcctcttaaacaaaaaaaaaattctctaatccacatctctcgtttattttctctccaaaaaaaacaaacaaaattttccggggaaaaaatatttatcatncaccattcctaattttccaaaggggcgaaataacacaccaatataaaccccccttacagcggcaggggacaaattttctctcaaggggaaaatttctttttttaagaaaaaaagttctttttctttctttctccaaaagaggtgcctattttcctggggggtggggggcctacctgcttggtagagggaaaaatcacattttgttacaggggccccctcccccaaagagtcgggccccccccaatttcttgggtgaggcattaataaan

SEQ ID NO: 10500 - DNA, 785 bp, Zea mays
  misc_feature: Ceres CLONE 1218472-R
  misc_feature: Encodes the peptide sequence at SEQ ID NO. 10501
cgagcgaagtggccgctctcgggaattcgccgacggcgtacggctataattcaccggactgtccggtgtgcaccggactgtccggtgtgcaccggattgtccggtgatccaacggtcggacgggccaacggtcggccgcgcgatctgcgcgggacacgtggccgagccaacggctagaagggggcaccggactgtccggtgtgcaccggacatgtccggtgtgcaccggacatgtccggtgcgccaacggctccaagtctgccaacggtcggcttcgctatttaaggaaggaaatcgggcaccggacagtgtccggtgtgcaccggactgtccggtgcacccgacgacagaaggcaagaaaggccttccagatttgctctcaacggctcctagctgccttggggctattaaagggacccctaggtgcatggaggagcacaccaagcaaccttagagcattcttgatcatccacactcagtctttgcgcattcgtttgtcattctcagtgattcgagctccgttctagtgagaactttgagatagtcttttgagctcgattcttggccgtgtgtgtgcgcattttgctgtggatttgtgtgtgttgcttccctcccttactccgtatttctttgtgaatctcaagtgtaagggcgagagactccaagttgtggagattcctcgcaaacgggatattgaaaggaaaagcaaaacactgtggtattcaagttggcctttggactgcttgagaaggggttgattgcaacccctcgtcccgttgggaacc

SEQ ID NO: 10501 - protein, 80 aa, Zea mays
  misc_feature: Ceres CLONE 1218472-R
MSGVHRTCPVRQRLQVCQRSASLFKEGNRAPDSVRCAPDCPVHPTTEGKKGLPDLLSTAPSCLGAIKGTPRCMEEHTKQP

SEQ ID NO: 10502 - DNA, 852 bp, Zea mays
  misc_feature: Ceres CLONE 1218714-R2
  misc_feature (852)..(852): n is a, c, t, g, unknown, or other
ttgcataaaagccatgacaatgtcgagtgacctgtttcactgcaggagaaaaaagaggggtaagttcatagattattgcaacacaggttacacctcatctgagacatctgactatctgcgttcccaaaaaaaaaacgagatacttctaaacaagccgctacaattcccttgaactcccgcagcctcacttcttaacctcctcatactctgcctccggcgcctggtcgccgccaccctgaggtccagatcctgactgcgagccgccagagccaccaccagacatgtgctgtcgaatcttcgagacagccttgctgacaggctcaagcttggccttgatcttctcaatgtcatccgaggccatctcctgctggaggtcagcgatggctgcctcgatctcatatgcaacctctgccgggatcttgtccctgtactctcaaggactcttctcgatgatgtagatagtggagtcggcattgttcctgacgacaatgaggaatttccgctcctggtccttctggacatgcagctcagcttcttgcacccatcttctggatgtcaagctctgacagtccacgcgaggatcgcatgatgatgttctgcgccttcccggtagacttatctatgggtgagaccggccacattccgttggcatcaatgttcgatgaaacctccacctgaggcaagcctcttggggcaggtgtaatgcccaccagggcaaattcccctaggagcttgttgactgcacccatttcacgttcacaatgcaacacccggaatacaccctggtcccggttgccaggaaaaaccgggaaaaccccgaggttttcctttggggggataggaatggtacan

SEQ ID NO: 10503 - DNA, 862 bp, Zea mays
  misc_feature: Ceres CLONE 1218714-R
cccccccccaccctcccaccccacccctcccccccccccacacccccattgggtccgggccccccctcgagtttttttttttttttctcactttctttcttttttcttctctctttcctttttccgggcacaacaaggcttcactatgcacataaaagccatgacaatgccgtgcgacctgtttcactgcacgagaaaacaagaggggtaagttcataaattattgcaaccccggttacacctcatctgaaacatctgactatctgcgttcccaaaaaaaaaacagctacttctaaacaagccgctacaattcccttgaactcccgcagcctcactccttaacctcctcatactctggctccggcgcctggtcgcccccaccctgagggccagatccctgactgtcgagccgccagaacccccaccccaaaatgggctcgccccactcttccaagacacccccttgctcggcaagcccccaagctttgggccttgatactctctcaacggtcatcccaaaggcccctctcccttggccggaagggtccaaccgatgggccttccccccacaatctctcccaaaaggaacccccctctgcccgcgaaacactttggccccccggtaccctcctccaaaaaaactctttctctcaaaggctttaaaaaaaaagggggggctccgccaattttgttcccccttgtggccccaaggaaggggcctttttccccgccccccgggggccctcttctccggcgacacgaagacttccacctatttttctggaaaccatatttctctctgtgggggtgtttaatgaccacctctgagaacacgccccacccctaagggattcttctttag

SEQ ID NO: 10504 - DNA, 896 bp, Zea mays
  misc_feature: Ceres CLONE 1218825-R
  misc_feature (896)..(896): n is a, c, t, g, unknown, or other
acgggccccccctcgagttttttttttttttttttttcttttttttttaacaataagcccaaaatggcatcaacattgctataatcgacttttactcacacattggctacaaacacaagtaccacaagatctgcgtaggcagagactcgaacggccagccctgtatgaaaattctaacaatacaatccttcaaggtgaacgacaaaggaatattaagtttattggaactcaaattccgtaatgaaatgtggccacaaataatgacgagcccgactatgagtatgctcccccgtgtggatattcttccccaacttcagggcaattcaggccttggttttcttgggcacggtcaggcgctcccggaaatcatcctccatgaacaccaagccgtcccgtaggacgatcttgggctcccatcccagaacttccttcgcctttgagatatccaggcttcctctggcggggatcctcaaaaagtgtcttgcgggctttgtccaggcttcacatcctgggtcatatctttgcaattttacatttctcggaccaatttgcaagacacggggggcagacaacctgggggagtgcccgcagcaatcaaacgagacaaggcggtaatactccagatcaataaagtctttcatataatatccgcgtaaaggatcagtcgcatgaaagtgaaaaacatctccctattaaaatcgtggtgtctctacaagaagaaatacaatcacacataataaagtccgcgtagaatgtaaacgattgtaaaatcttatctccttgtatggtcattggaagtggctattaatgtcgcggccactctactatctggatatacaaatacgtgcacacccgctcgggagatggagggttgctcacatcatcttatgcgtccn

SEQ ID NO: 10505 - DNA, 876 bp, Zea mays
  misc_feature: Ceres CLONE 1218830-R
  misc_feature (441)..(441): n is a, c, t, g, unknown, or other
  misc_feature (467)..(467): n is a, c, t, g, unknown, or other
  misc_feature (514)..(514): n is a, c, t, g, unknown, or other
tcgaggcgacccagcgtacgacccagcagcgccagcctggcgcggcggtcaatgcgaccaaaagtgggccggcagtaatgacgctggcaggcgggcgggagcagcggtcacgtcgtcagccaagctcacgtcccatccgggggcaacaagagaaccccctctcacggcgtgaagacaacgcgcccgtgacccgttcctcgaacggctcgcgcacgcgcaacggccgcctcgccaacctctcgccccgtcgcattaactccgcggcaggacaggcggcgcctctggcaggagaagcgggcgacgcttcgccttcgccgtaataaccacaccaaaaaaggtacgccgcgtcgttcgatttcgtatccttttccttttttcctctttctctctctctctttgcatagggaccgggaaagggggataccccgaaaaagatccttnccccgtgaaggaaccgggctccgagncctccctactgatcagaaggttcgaaggctgaaccccccgaaggggntcgacagcccgcctcaagatcgcgtgggcccctacacccaactactgggccaaaggttccaaagggccggccccccgaagggtttcacgggctggcctcaggttaatcgggctcccgggcccattattggatcaggggttcgaagggttggcccccggaagggtttcaaaaccgcctccaaaacccgagaaagggaatggactaggggaacgttccaaaaaaaaaccagggggttcggtttgggtctcccagggaaccctaagaaatttttccaaaacccgcggggaagggaatttgtgaacggaaacccctccggggggggggatttagagccctaaacccccggcctaaggggaccgggg

SEQ ID NO: 10506 - DNA, 974 bp, Zea mays
  misc_feature: Ceres CLONE 1218830-R2
ccctcgaggcgacccggcgtacgacccagcagcgccagcctggcgcggcggtcaatgcgaccaaaagtgggccggcagtaatgacgctggcaggcgggcgggagcagcggtcacgtcgtcagccaagctcacgtcccatccgggggcaacaagagaaccccctctcacggcgtgaagacaacgcgcccgtgacccgttcctcgaacggctcgcgcacgcgcaacggccgcctcgccaacctctcgccccgtcgcattaactccgcggcaggacaggcggcgcctctggcaggagaagcgggcgacgcttcgccttcgccgtaataaccacaccaaaaaaggtacgccgcgtcgttcgatttcgtatccttttccttttttcctcccccactctctctcttgcaatagggaccgggaaagggggataccccgaaaaagatcctttccccgtgaaggaacggggctccgagacctccctactggatacgaggttcgaaaggctggacccccccgaaagggttcgacagaccggctataaatatgcggtggggccctaacacccccctaactgggtacgaagggttccaaaggcccggccccccctcaaaggggttccccccgggttggccttcaaggcgttactttcgggcctcccgccggcccctttttacttggataagggggggtttctaaaagggttgggccccccgggaggggggttttccaaactgtcctttaaaaactcctgaagacagggggagggactataggggggcacttttctaaataaaataacccaaggggctcgggggtgtggcctccccccaggggacccctaagagaaatttttcaagagacagccggggagacgattctttgtaagggagaatcctctcgggagggggggggttaagcccctcttacacccctttttatgggtggacgggggtgtgggaaaacccccccccgggtcat

SEQ ID NO: 10507 - DNA, 832 bp, Zea mays
  misc_feature: Ceres CLONE 1218970-R
  misc_feature (820)..(820): n is a, c, t, g, unknown, or other
  misc_feature (832)..(832): n is a, c, t, g, unknown, or other
gatcttctgcggagtgtccatgacgtcttgtaagaaaatctgtccatcgattaaacatagcaaacctccttgaccggctcggagtcggaactgtgactcgtgagaccaggggatgcatctctgacgaaggcaaagtcatctagaaaagaaacgcattttggtaaaatcagagctctggagctgtctctagatgtcgtgtccgccgctgctagctgaatcaggcaaagctacagcctacagcctagtcgtggcagcaaagtgcaagacgacgtctcctccacaaatgcccagccaacgggcaatccggaatcctcgggagacgaaatcgtagtcctggaacgaagtagtacttctttcgcaagtgaacgaaacgaaggcggtattctactttcgcaacgggtgtgcctcctttcacaacccatgcagctctaaccttgatgcaggcaggccagatgagtctcttagctctgttctttcgcagaaagctccagaagatgctctacctccctcaggaacagcctcgtcagctgcttttgccctctccggtacactacacacgaacggtagtttgtctttgacttcctttcgcgcttctcgccgctttcactcgcgtagtcttctggttgaatggaatcgaactgctcgagcagttcggcgtcagatgcttcagttccagagccctcttcaagttcagccattttgaccccgagaagatccacaagcaaacccagtgcaccctgatcaccgcagacttcccaaatagcactttggatcgctgcacaagatgtttctctgtcttcactatatccaaccctctccnagtaagaagcan

SEQ ID NO: 10508 - DNA, 556 bp, Zea mays
  misc_feature: Ceres CLONE 1219115-R
  misc_feature (391)..(391): n is a, c, t, g, unknown, or other
cgattgggtaccgggccccccctcgagtttttttttttttttttgcagtcgtgcactgtatagcacttggcacgggcaacgagtaaacatgtatacagtgaaatgtaactaaacatacacagtaaataagaaatatgatacgtgttatagattgatgtatgaaatcgattattttcttgccagccagaagttttcatgaatttttgcacaatcaatcgtatctttcatttcagcaaatgtgtgctatcacaggggccaagtcttcaagcacttcaaatccatgctgaacctgtaaacttgacccgatgataggctgacggtggcaatctggtccccgtagtgcagccttgaaagggtattctgcccgccagctagaccatagcagagcttncatggaggctccctttcttccagctgattgtttacagtaacaccaccctcgggccctcagaacctttaacgtagcccttgaagccaccttgttggcggggcaaaaccaggggaagaaaggaccaatcggtccccagggtctgtacaacattttccaataagcaac

SEQ ID NO: 10509 - DNA, 656 bp, Zea mays
  misc_feature: Ceres CLONE 1219220-R
  misc_feature: Encodes the peptide sequence at SEQ ID NO. 10510
acgattgggtaccgggccccccctcgagtttttttttttttttttttttttttttttttttttttttttttttttttttttttttttttttttttttttttttttttttttgggggtaaaccccttcccttccccttaaaatgaagggcttatcaaatttccccccattttgggtttttcccccaaggggaaaatcaaaaaatcctataatatacctgtttgtttccccccaaaaatttgggcccttttggtttgccccccacccggaaaaattgcttgggcccttttctttttaacccccaagggcccaaaaaaaatggcctgggaacctccctaagccaaaaaggtcttctgggaataaaccaaaaaggcccttttttttttcagggggggggggggggaaataaggaccccccccccccccccaaagtttttttttttttttttccccctttttaaaaaaacctaaaaaccctgggatttttaaaatttaaccaaaacctttttttccacaaaaaaagcccttccaaaaaatggcggaattaaatttaaacccccaaaaaaaaaaaccccttaggaaaaaaaaaaagccgccaaaaaccctccttttttttaaaaaaatacttaaaagtgccaaattgctaaagttaaaatcc

SEQ ID NO: 10510 - protein, 38 aa, Zea mays
  misc_feature: Ceres CLONE 1219220-R
DWVPGPPSSFFFFFFFFFFFFFFFFFFFFFFFFFFFWG

SEQ ID NO: 10511 - DNA, 760 bp, Zea mays
  misc_feature: Ceres CLONE 1219245-R
  misc_feature: Encodes the peptide sequence at SEQ ID NO. 10512
  misc_feature (402)..(402): n is a, c, t, g, unknown, or other
  misc_feature (411)..(411): n is a, c, t, g, unknown, or other
  misc_feature (419)..(419): n is a, c, t, g, unknown, or other
cgattgggtaccgggccccccctcgagctcgtgcagtccgcggtcatggtggccacgcgcgacgacggcggcgcgcacggcgacgccgggggaggtgggagcgacggcgggagcttcccgaggggcggcgacgccgccgacgacagcttggtgagcctcaccatgaactccacgctcatgtaccagggccaggagatggcggcggcgctggccggcgacgccaggaaagggagcggcggcggccgagggagtccgtccagcttgtacttccccaatggcttcgcatgagtatttaatctccttcatcaagcaagagcaatgcattttcgtttctctctacatatatccatccaaagatgatccttttctctacctcgcgctagctctttcaacactctccgntggattggnatcttaanttgcattgtgatgtgaggacgatggtcgtgtacctagctatagcttgctactggtcaacgagctaggagagagagatgagctagcagtattagccctgccaaggattcatgaatttttagggggattaattgtccgaggccttcttacaataatggatgatccatgggccaccacaaccggcttgctttaatacctgggccaaattcccccgggggactggaaaaaaccccccctttggaaggcgccttttttttggaaaccggggtccccccccaaccccaaatttgttataatttcccccccaaaaaggggaacgggggggggtggaggattttttcgg

SEQ ID NO: 10512 - protein, 95 aa, Zea mays
  misc_feature: Ceres CLONE 1219245-R
RLGTGPPLELVQSAVMVATRDDGGAHGDAGGGGSDGGSFPRGGDAADDSLVSLTMNSTLMYQGQEMAAALAGDARKGSGGGRGSPSSLYFPNGFA

SEQ ID NO: 10513 - DNA, 1224 bp, Zea mays
  misc_feature: Ceres CLONE 1219268
  misc_feature: Encodes the peptide sequence at SEQ ID NO. 10514
gcgcttcacttgcgacttcttcttggccttcttcttcgtgccacgctgggcggacgcctcggggacgtcttcctactgtcgtccctaaggctgcttgtccttccgaaagatggcttcgaccgcctcctgactagaggcgaacttggtggcgatgtccatcaattcgctcgccttggtgggagtcttgcgccccagtttgctcactaggtcgtggcaagtggtgccggcgaggaatgccccgatgacatccgagacggtgatgttgggtagctcggtgcgctgcttcgaaaaccgtcggatgtactctcgcagggactcccctggctgctggcggcagcttcggagatcccacgaattcccagggcgtacgtacgtaccttggaagtttccagcgaaggccttgaccaggtcgtctctgttggagatctgcgcaggaggaagatgctccagccaggcccgggcggcgtcagagaggaacatggggaggttgcggatgatgaggttgtcgtcgttcgttcctcccagctggcatgccagccggtagtccgcaagccacaactctggcctcgtttccccccagtacttggtgatggtagtcggggcccggaaccgagctgggaacgacgcccgtcgtatggcccggctgaaaactcgcggacctggcggttcgggtgaggagctccggtcctcctcactgtcgtagcgtcccccacgcctggggtggtagcctcggcgcaccttctcttcgaggcgggctcgacggtcgcggcagtggtgctcttcgccgaggcgatccggggctgcaggcgtcctgtcccgcgtgcgcccggtgtggaccgaggcctcccgcatgagtcgggaagtcattgtgcgatgctccgaggggcacccttgccttcgggaggcagagcttttggcccgtcggaccgcgacatcctccaagaggttcttgagttctccctggatacgccgcccctcggtggtggatggctccgacattgcttggagtagcattgctgctgcagctagattctggccgaacacgctggaggccaggggcagccttgccctggcatcgtcaacgatatggcgttagacgtcccaggcccgatgacgcgcttctccggtgagtgctcggcctaccctctcctgctcgatgttttgccggagctgcacaagttgccctgcttcctcgtcgagctgggcttgcatctcgcagatttg

SEQ ID NO: 10514 - protein, 130 aa, Zea mays
  misc_feature: Ceres CLONE 1219268
MSINSLALVGVLRPSLLTRSWQVVPARNAPMTSETVMLGSSVRCFENRRMYSRRDSPGCWRQLRRSHEFPGRTYVPWKFPAKALTRSSLLEICAGGRCSSQARAASERNMGRLRMMRLSSFVPPSWHASR

SEQ ID NO: 10515 - DNA, 862 bp, Zea mays
  misc_feature: Ceres CLONE 1219489-R
  misc_feature: Pfam Name: Auxin_inducible Pfam Description: Auxin responsive protein
  misc_feature (28)..(28): n is a, c, t, g, unknown, or other
cgattgggtaccgggccccccctcgagnttttttttttttttttttcttttttttttttttttttttttttttttttttttttttttttaaacaaaagatgttcgttgaattattcttcccatcagtatgtatataaaagtatagtatggacaaggggtattttcttctataaataagagaatggaaaaaagactttaattattggatgggattaacgaatctgaaaagggacagggaaaaaaaaagcttcgtcgcatggaaaactcaaaccaccggttggatgattaaaaccgaactcttcttctgctttcctaagcaaagcttggaaagatggcttgttcaagtaacaaaccggaacaagatatctcttcttcttcaaattttctccaacatacacagaaaagaaccctttaggggttgataatgattccgaaaaaaaagaccggcgaatgatatgcttggtagcgaaaaaactccttaagaaagccatttcgagtattaaaaagaaaaaaaaaactttgaattaagggctaaagttaagatatcttgatcttgtttgatgaaaaaaaaagctttgagtttggttttcgggggggggggggggactagggagctctttttctctttctctctctcctggggccgaattcctgcagcccgggggatccactatttctagagcggccgccaccgcgggggagctccagtttttgttccctttagggagggtaaatttcaagctgggggaaaacatgggcaaagctgttccctgggggaaattgttatccgctcccaatttcacacaaattacgagccggaagaataaagtgaaaagcctggggtgcccaaaggaaggaacta

SEQ ID NO: 10516 - DNA, 833 bp, Zea mays
  misc_feature: Ceres CLONE 1219591-R
  misc_feature: Encodes the peptide sequence at SEQ ID NO. 10517
tcgagttttttttttttttttttttctttttttttttttttttttttttttttttttttttttttttttttttttttttttttttttttttttttttggcccttaacatacccctcaaaaaaaaaaatttttcctttccccctaaattttggggcaaaccgggtaaaattccctttttaaataaaaaaaaacttttcaaaaggggaaaggggggaaaaaaacgcttaaaatcggaaggcctggttttttttcccccccctttggccaggttggtttttttttcccgtttttcccactcaaaaaaaaaaggggcgggggcccccgaaatatccttgggggcctttctctctatggggggggtttttttttcccaaaaggaagaatggaaaactccccccaaaaaggtttggttgggtcctaacccaaaaaagggaaaggattccccttggaaatctttctcggggggggaaaaaaaccccccccggattgtttccccaagggcaggaaagtttttcccaaccccttgggcaggggaaaaaaaaaaaacccccggagggtttggtttcaagggggttaaaaaaaaattgggggccttccccaaaagggatttatcctggggagaaccccggcgtttttggataaaacatttgggggaaggatgaaggggaatattaaaacgaggaaagggcctggtttccccctcgaaaaaaggggttccggcatcacccattaaacctccttttaacttgaaaccatagttttggcaggttgtggtcatcaacccttcaaagagggcttggatatttggaaaggggcacaatctttaagtaaaa

SEQ ID NO: 10517 - protein, 59 aa, Zea mays
  misc_feature: Ceres CLONE 1219591-R
SSFFFFFFSFFFFFFFFFFFFFFFFFFFFFFFWPLTYPSKKKIFPFPLNFGANRVKFPF

SEQ ID NO: 10518 - DNA, 640 bp, Zea mays
  misc_feature: Ceres CLONE 1220335-R
  misc_feature: Encodes the peptide sequence at SEQ ID NO. 10519
  misc_feature (640)..(640): n is a, c, t, g, unknown, or other
cgattgggtacgaggccccccctcgagctgtacacatctctcatgaacctcgcagaaacacgacactcaagtagacctccaaaaagtccgaagcgtaagcgttgttggaacctggctgtatacaggtgctatttggttcatatcattgtaacatcgtgggcaatagataatattaaaacatatttatttaagtccaacgtaatcagatatcataatagaaattataccgacatattcaaatttattattgttgtcattcgagtgtgaattattaatactatcatttacgttaccattcgtgaaccaaacaacatcacaccagtaggacgacatgccgcgcaacttgtggactgggtccttagactgtctccagcaacgtcctctatatacatcctctatatccgtcctttacagtcttctctaaaagattccatctcccatatctactttctctccaacaacgtcctctaaatcacgtcctctatatgtaaatacctatattaaagacatttttaattttttaatttttgtacatacgtatttgtcatactctcaaatgtattgtacatattttagttttattaaaccggttttttaaagtattcaaatagatagagaactgtttagagaaactctacan

SEQ ID NO: 10519 - protein, 88 aa, Zea mays
  misc_feature: Ceres CLONE 1220335-R
RLGTRPPLELYTSLMNLAETRHSSRPPKSPKRKRCWNLAVYRCYLVHIIVTSWAIDNIKTYLFKSNVIRYHNRNYTDIFKFIIVVIRV

SEQ ID NO: 10520 - DNA, 900 bp, Zea mays
  misc_feature: Ceres CLONE 1220335-R2
  misc_feature: Encodes the peptide sequence at SEQ ID NO. 10521
  misc_feature (900)..(900): n is a, c, t, g, unknown, or other
cccctcgagctgtacacatctctcatgaacctcgcagaaacacgacactcaagtagacctccaaaaagtccgaagcgtaagcgttgttggaacctggctgtatacaggtgctatttggttcatatcattgtaacatcgtgggcaatagataatattaaaacatatttatttaagtccaacgtaatcagatatcataatagaaattataccgacatattcaaatttattattgttgtcattcgagtgtgaattattaatactatcatttacgttaccattcgtgaaccaaacaacatcacaccagtaggacgacatgccgcgcaacttgtggactgggtccttagactgtctccagcaacgtcctctatatacatcctctatatccgtcctttacagtcttctctaaaagattccatctcccatatctactttctctccaacaacgtcctctaaatcacgtcctctatatgtaaatacctatattaaagacatttttaattttttaatttttgtacatacgtatttgtcatactctcaaatgtattgtacatattttagttttattaaaccggttttttaaagtatgcaaatagatagagaactgtttagagaaactctacatatagaggatccagcagcgttctctaaattagagaatcgtttagatgacgttgctggaaggaagtagaggacctccctcgtccttctaaatttagggaacagaacccctttaaagggtctttgttggaagccagccctaaattcccttgcccttcatttcccggccgaattagcccgggctttacaacaggtgcaaataaaggggggccaaggccttctaaggggtccaaaagaaggaaaaccccgaagaataattttggggggggcggtccctccggn

SEQ ID NO: 10521 - protein, 82 aa, Zea mays
  misc_feature: Ceres CLONE 1220335-R2
PLELYTSLMNLAETRHSSRPPKSPKRKRCWNLAVYRCYLVHIIVTSWAIDNIKTYLFKSNVIRYHNRNYTDIFKFIIVVIRV

SEQ ID NO: 10522 - DNA, 986 bp, Zea mays
  misc_feature: Ceres CLONE 1220361-R
  misc_feature (188)..(188): n is a, c, t, g, unknown, or other
ccccctcgagttttttttttttttttttttttttaaggaaacttggagctattatcagttcgtatttgacatcagtttgtttgaaggcagtaaattagccaaatgcttcacatttacgatgcacggttcgtcttgctgttgtgcgcaatcaaacaggcgagacatgatgttggggggggggggggcangaaggcaacaatttaccgcaaaagctatcctttgcacaccgcagctactttggagaagtgagtttgttagggtcgttatcgtgcttcaccgacgagtctccactcaccaattcttggaaggcttctactttgacaggtggcattctcatgccatatgcacccattgaaaaaacttttttgaaccaactctgccaatagggcgaccctaattcccgcccctgttcatctgcctaagaatgcccccgaaaaaagttccctgttaattctccagtagccctttaaaggtccccccccaaaaaaaaaaccgctccccacttccccccccgtaagaggaaaaaaaaaaagctgggagcaaagaaaaaaaccttcttcctgttgtttttgttaaccaaatcccaggaattgtttttttgccgcgcctctcctcctggtggagaagaacaaaatattacccccgaaaatacggggggggattcccccccctccccggaaaaacccgccctctctttaaataataccctggggagcctccctccccttctttaaacccccccgtagaaccttccccaagacacaaactttctcgccccccccctttgtggagaacacaaacaccctctctttttttgaagaaaaaaacctccctttggggcccccccctcttcgaaaacatccggtttctcccctcccctaccgaaaggccgactccttttttttcttaataaatgaaaaaaaagccctctggtgcccccaaaaaaattatcccctcaacaccccttcttttccaaaaacaataaa

SEQ ID NO: 10523 - DNA, 899 bp, Zea mays
  misc_feature: Ceres CLONE 1220361-R2
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (710)..(710): n is a, c, t, g, unknown, or other
nnnnccccgattgggtaccgggcttcccctcgagtttttttttttttttttttcttttaaggaaacttggagctattatcagttcgtatttgacatcagtttgtttgaaggcagtaaattagccaaatgcttcacatttacgatgcacggttcgtcttgctgttgtgcgcaatcaaacaggcgagacatgatgttggggggggggggggcaggaaggcaacaatattaccgcaaaagcaatcctttgcacaccgcacctactttggagaagtgagattgttagggcccttatcgggcttcagccattattctccactcacctattcttggaaggcttctacttagaaaggaggaatttgcatgcccccccccccctttgaaaacacttgtttgaacagctgtcctagttccccccccagatttcctgacatggtcatctgccgcaaaagatgctgaagaagttcctggttattttgctgatgctgttaaatgagctccccccagaataaccggctgccctccccgctgcagaagaagcaaaaggtggtgctgacacaacccctgcagctgttgtcccaaaagcagctgctgtatccgcccttgctaaaaaaaaaaaataacctaatgctggggatgctccctctagaaacatctttataaaaaacgggaagcccccccagctgaaccctgcagatagctgcaccacaaanttccttgcttgcttctttttgagaacccaactccctttttttccaaataaaaataactataaagggggaacccccccatatcacaatttctttgtattttccctgcccgttagaagaggggcatttcttctttgtttttttaccacaaaaaaaatccaaacaatgcccgactgactcctccccccaata

SEQ ID NO: 10524 - DNA, 748 bp, Zea mays
  misc_feature: Ceres CLONE 1220375-R
  misc_feature: SWISSPROT Homolog: EC 5.2.1.8 Peptidylprolyl isomerase
ggctctcccccacccacagagtaaaaaaaacaaatctctattctactctaaattttcaatagggtaacgggccccccctcgaggtcgacggtatcgataagcttttttttttttttttttagctcaacctttcaaaatcttttcaaatagtaagtcaacaagaaagtaactgtagcaaacagaacaaactggttcagtccattttcaggcactaataaaagttccagaacgacaaatgggcaccagcaacttctcaacatccttcccgatcgaacatcaattcagctcatcacatcggcaactcgccgctatctgctaagacaaccttgctctttgattgcccgctctgacaggcctcaacttccaccttggacacaacatccgttcccatacaacaccttgccaaacaccacatacttcccgtccaacctacttgttgccactctggtgattaaacactgagatccgctcgtatctctcccaacattggacataggacacaatgcctgatcctctatgcctgatcttcgaattcccatcaacaaacttcatgccatacataaattcacatcccctcccatccccaatagtgaaatctacctcctttgcaacccgcaacctcgagaaattaattctcatggaataacactttccccctgctaaaaggaaaaacctattccccccctccttcgacaattttccatttttctacctccatacacccaaataaagaacttacaaaaaagac

SEQ ID NO: 10525 - DNA, 728 bp, Zea mays
  misc_feature: Ceres CLONE 1220694-R
  misc_feature: Pfam Name: 2-Hacid_dh Pfam Description: D-isomer specific 2-hydroxyacid dehydrogenase, catalytic domain
actaaatgtcagtcagtgtgagtatctccatccattcctatatagatggaagatgggtgtacccttattaaccatggctgatctgagtaacagcagcctgacttacacaaaagataacaataatcagatcaccggagtgagcaatggctcatccgacgcgtgcgcctccaagtttgctagcactaggtcggccatcgccctgcacgtttcttcatatcgctgccacgtgaggcaccaagacgacgttgtcccagcccagagctgctcaggagcaaagggctcgtgctcatacacgtcaagccccgctcctcccagcgaccctcgaggagcgcggcgacgagctcgggttcatcacgtgtggctcggcggggcaacgtttacaagaacgccctttgaacccaaggggtcgatgaacctccggggtcccaaatgggggggtttccgcgggaaagcgaaaccccccccaatagaaaccgccccaaattggtttgccaagggcaaaaaggcctcccgggggaaatttttaaacctgggagaaaaaggtttttccctgactttttgggggggggggatttattaggaaaaaaccaaaaaggggcccggggcttttttttttttttagggggggccccaatttttgggggaaccccccccaaaaaaaaaaaattcttttttgtgccccccggggggggagaaaaaaaaaaaaaacccccccccccctcataata

SEQ ID NO: 10526 - DNA, 650 bp, Zea mays
  misc_feature: Ceres CLONE 1221226-R
  misc_feature: Encodes the peptide sequence at SEQ ID NO. 10527
cgattgagtacgggccccccctcgagcattccgcgagatgcaagccaagctcgacgaagaagcggggcggcttgtgcagctccgacaaaacatcgagcaggagtgggcagaccgagcacttgtcggaggagcgcctcatcgggcccaagacatccagcgtcgaatcgttgatgatgccagggcaaggctgcccccggccttcagcggggtcggccagaatctagctgcagcagcgatgctactccgagcgatgccggagccatccaccaccgaggggcggcgtatccagggcaaactcaagggtctcctagaaaacacagcggtccgatgagctgagagctctgcctcccgaaggcaagggtgcccctcggagcatcgcacaacgtcctcccgacttatgcgggaggcctcggtccgcaccgggcgcacgtgggacgggacgcctgctgccccggatcgcctcggcgaggagcaccaccgccgagaccatcgagcccgcctcgaagaaaaggtgcgccgaggctaccaccccaggcgcggaggacgctacgacagtgaggaggaccggagcccctcgttcgaactgccaggtccgagggtcttcagccgggccatacgacgggcgccgttcccagcccggttccgagccc

SEQ ID NO: 10527 - protein, 97 aa, Zea mays
  misc_feature: Ceres CLONE 1221226-R
MQAKLDEEAGRLVQLRQNIEQEWADRALVGGAPHRAQDIQRRIVDDARARLPPAFSGVGQNLAAAAMLLRAMPEPSTTEGRRIQGKLKGLLENTAVR

SEQ ID NO: 10528 - DNA, 1088 bp, Zea mays
  misc_feature: Ceres CLONE 1221330-R
  misc_feature: Translation starting site: 108
  misc_feature (1)..(1): n is a, c, t, g, unknown, or other
ncaattgggtaccgggccccccctcgagcccgtttaacttgtcttccaggcgccgaacctcatcgcagtaggcctccatcttcgggtcgcggcagtgggagttcttcatgacttggtcgatgacgagctgcgagtcaccgcgggcgtcgaggcgcctgacccctagctcgatggcgatccgcaacccgttgaccagagcttcatactcagccacattgttggacgccgggaaatggaggcgtagcacatagcgtaggtgtttcccgaggggcgagatgaagagtaggcctgcgccggctcctgtcttcatcagcgacccgtcgaaaaacatggtccagagctccggttggatcggagccctccgtagctggggatcgacccattcggccacgaagtccgccggggcccccccacctgaagggccttccgaggggtgaacgagattgtctcccccatgattttccccgcccacttttcaattcctgcccgaaggcctctcgggcactgggatggatccccccccagggggggaaggaattaccccccccctattacccgggaatgaaaacttctaaaataatgggtagcgaacttttccgccccgctttcagggatatatctgggtgaaccggcaattttttcttgaaacttttgtggggagaaggcggaaatcttgggggtttctagaagccggggccccttcccccggagacgcaaattgctaaattttgggctcttttttaaaatggggtggaaagtggtgtagacccttctccatttatggggcgctcttgaattcaacaaatatgatgggaggcgctgtgaaataaccgctgctagtggggccggcgttgccagatctatgagagccatatgagggggcctttttttgtccgcgatacttgtgagggtgcaccccatagaatatttggatcacatatgctgagagcatgtgttgcctcttccggttgtgctcccggatgtgtattgctctctagtggacttctggtggtggtgcatgattgataaagagacgaccggccgtcttctctgataatagtgtggtgcgatatatgcagtcgtcattt

SEQ ID NO: 10529 - DNA, 863 bp, Zea mays
  misc_feature: Ceres CLONE 1221624-R
  misc_feature (28)..(28): n is a, c, t, g, unknown, or other
  misc_feature (29)..(29): n is a, c, t, g, unknown, or other
  misc_feature (727)..(727): n is a, c, t, g, unknown, or other
  misc_feature (730)..(730): n is a, c, t, g, unknown, or other
  misc_feature (800)..(800): n is a, c, t, g, unknown, or other
  misc_feature (863)..(863): n is a, c, t, g, unknown, or other
cgattgggtaccgggccccccctcgagnnttttttttttttttttttcttttttttttttttttttttttttttttttgggccagcaccccacaaaagttaattccttgcattgaaatcactctttccaattacagattatagttcattttcatataaaattcacaccaagggcacattgaatggcatcggcaaaccgcagggaactcagtgaatgggtcatcagcaagccggggggagctcgcattgctctagcctcgagggccagcgagtacactagcgttaatcgctgcaaaaactcgcgaactggagggagtttcctcattccagatctggcagccaatattttttcgattttcttcaagcgtgcaatgatagtttaacagctccagagacaaccaccaaggagattcggatagcacaacatttcagttcaccaaaagactaatctgcctccccaaggccgtcgctgccatctcctctttttggtatcggagccataccaccacgtttcttgccatgggttgctacctctgcattttttctcaacacagcacccggtgagggatatggtctttgttggaacaaaggtccagctgcggtagtatctgctgctcgtggttgaacacccttcaaaccaacaacccagccaccgcgtggagcatctgagtaagaactcgggtccattgggtcaagttcatcatcctcggggcgatttcttttgcggnggncttttctgtttggtttccctaaaggtggctttgagcttgatctggtcttaactgaaacatttccctgagntttgggagcattgttaccactggcgtgcatcgtattatttgtggaaaatggggactgttgaan

SEQ ID NO: 10530 - DNA, 656 bp, Zea mays
  misc_feature: Ceres CLONE 1221802-R
  misc_feature: Encodes the peptide sequence at SEQ ID NO. 10531
  misc_feature (432)..(432): n is a, c, t, g, unknown, or other
  misc_feature (510)..(510): n is a, c, t, g, unknown, or other
cgattgggtaccgggccccccctcgaggagtgcgtcatgcttcggcgccactttcacaaggccagaccacctgcggaaggtggcagggcccacaacgacgacaagagggaggatcacaaggcagaggagttccccgaggtccacgactgcttcatgatctacggtgggcaagtggcgaacgccttggctcggcaccgcaagcaagagcgtcgggaggtctgctcggtaaaggtggcggcgccagtctacctagactggtccgacaagcccatcaccttcgaccagggcgaccacctcgaccgcgtgccgagcccggggaaatatccgctcgttgtcgaccccgtcatcggcaacgtcaggctcaccaaggtcctcatggacggaggcagcagcctcaacatcatctacgctgagaccctcgggctcctacgnatcgatctgtcctcggtccgggcgggtgcggcaccttttcacgggatcatcccccgggaacgcgtccagccccctggnacactcgatctgctcgtctgcttcgggactccctccaactttcgaagggaaccctcacgttcgaggtggtcgggtttcgaggacctaccaacggtgctggggaggccatgctacgccaagttcatggccgtcccaaataacctacc

SEQ ID NO: 10531 - protein, 218 aa, Zea mays
  misc_feature: Ceres CLONE 1221802-R
RLGTGPPLEECVMLRRHFHKARPPAEGGRAHNDDKREDHKAEEFPEVHDCFMIYGGQVANALARHRKQERREVCSVKVAAPVYLDWSDKPITFDQGDHLDRVPSPGKYPLVVDPVIGNVRLTKVLMDGGSSLNIIYAETLGLLRIDLSSVRAGAAPFHGIIPRERVQPPGTLDLLVCFGTPSNFRREPSRSRWSGFEDLPTVLGRPCYAKFMAVPNNL

SEQ ID NO: 10532 - DNA, 815 bp, Zea mays
  misc_feature: Ceres CLONE 1223191-R
  misc_feature: Encodes the peptide sequence at SEQ ID NO. 10533
  misc_feature (815)..(815): n is a, c, t, g, unknown, or other
ataacacccccccccctccaaccactctccccccaacccaacccctttgcccgaattgggtaccgggccccccctcgagttttttttccccttttttttcaactacaaagtgtcatggccctgcagaaagacccatttccttctctggacaagttacatggatcagggtctgtttatacaacatgggcacatatgatgaaatctaattcaaggcacagccggttcccttacgccaaatagggatacatcttcctgtctgtcttgtcccgctccaggaagccccgctcgatgagcgactcgatccgcttcttgatcaccacgctattccgaatgaaacccggctgcagctgttttgtcacctccgtcatgatgctgacgtggtcgaggaccctcctcgacttcctgatccgcaccatggacgcctcgatctgcggcttcctagtcctcatccacccgctgccgcgtctccagcttctcggggtcggcccccttctgcgccaccacgggtgccgatctttcaccttgaaaagctcgctggagaacttgtaccccacgcaaaaactgtcatccatccgcatagtccctgttcctccgcctctttccagcaggaacttgctctaccccttcacaagagatagagactgggcgtttcctgtcctcagggccaccgggttgtatattcgctgacacaacacttctacctccccggtaaaacccaacaacactcccgccagactcatacacaccccatgcacaaacccacccatcctggtcaatgctctcaaaaccccccccacatctactcgctttttccn

SEQ ID NO: 10533 - protein, 132 aa, Zea mays
  misc_feature: Ceres CLONE 1223191-R
MSDSIRFLITTLFRMKPGCSCFVTSVMMLTWSRTLLDFLIRTMDASICGFLVLIHPLPRLQLLGVGPLLRHHGCRSFTLKSSLENLYPTQKLSSIRIVPVPPPLSSRNLLYPFTRDRDWAFPVLRATGLYIR

SEQ ID NO: 10534 - DNA, 661 bp, Zea mays
  misc_feature: Ceres CLONE 1223229-R
  misc_feature: Encodes the peptide sequence at SEQ ID NO. 10535
  misc_feature (375)..(375): n is a, c, t, g, unknown, or other
ccgattgggtaccgggccccccctcgagttttttttttttttttttttctttttttttttttttttttttttttttttttttttttttttttttttttttttttttaacaaatccccatccaggaggatcacttcttttaagcatttaaagttcaaaaacaaaaataataccctccttatctttcaagaaaatacccagcccatctcaggaaaaaaaaggggggaaaaattaagcccacatggtcgtttccaaggaaaatacatggcccgggccattaaaagtacacttcacacaaaatcaacacaagatagtttcgagaaaatatatgacagtttataaaaatagagactgataccgataacagatgaactgcntcccttgggcccgcctccctcttcaatgggatttaagactaagaacgccgatctaattaacaagccatgccaatgcttctattcatcttggtgaacaggacttctctctggggacttaagcaccccccttttacctgctggtgggtttgaaagaatctgaaaaaccgagtcctcaattccggggcctttggggtgggaaggcccaaatgaagaggaggcccttccccccggggttggtcctgaaaaactcaataactggagggtaaagaagaacccccggcttctt

SEQ ID NO: 10535 - protein, 112 aa, Zea mays
  misc_feature: Ceres CLONE 1223229-R
RLGTGPPLEFFFFFFFFFFFFFFFFFFFFFFFFFFNKSPSRRITSFKHLKFKNKNNTLLIFQENTQPISGKKRGEKLSPHGRFQGKYMARAIKSTLHTKSTQDSFEKIYDSL

SEQ ID NO: 10536 - DNA, 770 bp, Zea mays
  misc_feature: Ceres CLONE 1223557-R
  misc_feature: Pfam Name: RHD3 Pfam Description: Root hair defective 3 GTP-binding protein (RHD3)
  misc_feature (28)..(28): n is a, c, t, g, unknown, or other
  misc_feature (29)..(29): n is a, c, t, g, unknown, or other
cgattgggtaccgggccccccctcgagnntttttttttttttttttttttttttttttttttttttttttttttttttttttaaaagccctatgataaaatactttaagggacaaaacaattattgttatgctatacttttgttagttacctacctaaaaatatagtacaatggctgggggttgcaattacacataaattcaataaaatgttaatgtacaacaactgtacaaaaaccgaatagcatacattattatagatcccaatttttcccatcctagttttatatcaaacccccatcttattattattttgttaggggaaaaacaaacatgttaaaaaaacgggggccaaaacctctataaaagcccatccagccttcttcatcaaaaaacagcctaggagttttcatgactgaaggcctatccttactatagttgcccataacctgaaaccacaaaaattgtttctgcaaaaatacataatccccccttcaaaaaaacaattaaatttacctgaagctgagtcttgatggtatctattggaaccttataccataaaaactatataccaagtgaaaatgcgaggcattaggcaaaaaacttccggtttggggaggctacaccctacttgaaacactccattctggaattctctgctgacatctagctgcatcgccaaagctttgaccatcaagtagcccacaaatagcaggaacaaataaatgggattcctgtgaggatactgcttgtgtaatcgcgacctcagttt

SEQ ID NO: 10537 - DNA, 674 bp, Zea mays
  misc_feature: Ceres CLONE 1223779-R
  misc_feature: SWISSPROT Homolog: EC 3.6.4.3 Microtubule-severing ATPase
  misc_feature (413)..(413): n is a, c, t, g, unknown, or other
cgattgggtaccgggccccccctcgagttttttttttttttttttttgagggcattttttttaaataacatccagagctgacggtaagaggattggtttaaaaagaatattcttaaaaagatctctctatctccatctgtgtgtcttggtggcaaggttgcaaatgtgtattgcgcctagtgtgcaacaaagaaatagaaaaagaacatatcaatgtttcctactcgatggatcatttatatctacctttgagtactcatcaactactgcttttgtaagagaggggcttaatgaacttcgtgcggcttggaagtgagcgtcatgtatcaaacttgctgagatatcttccctcaatgctgccattccagcttccctgcaaaggccttcaagatcagcaccggtgaatagctcgntacactctgcaacctttcaaagatctacatcctctcccaacttcattttccgtgtatggatgcgtagtatctcgtgtcgcccttccaaatctggtgggggggacatacagcaccttatcgaaacgccctggacgcaaaagagcaccatcaattggattttggcgaattcctaccacccaaaaagaataattccggaaaccaagttttaaaccatccttttcggccaaaaaaggccaaaaaaatcttttttccgaatggggg

SEQ ID NO: 10538 - DNA, 658 bp, Zea mays
  misc_feature: Ceres CLONE 1223891-R
ccgattgggtaccgggccccccctcgagttttttttttttttttttttcttttttttttttttttttttttttttttttttttttttttttttttttttttttttttttaacccagggatgaaaacaaatatgctgcccaataatacaataagggggctatttttcaacaaagcaaaatcctaaacccaaacaaaaagctttgtcttaaaataaaaatcatcatccgggctgccctttttaaagtacccaaaggaggcaaatcaaatcccccaaatcggatagttcaaaggtaaccatctccaaaagggtgctcactcccctatccccctctcttctcagttgtccttcccatttataatggcatgtaggtcaaggtgtcaatttgctcaggcagttcctttatgtctacctcaaacctttcttgcccctggttaaaaacatcaaaatccgaagcaaaagaaacaaaggtaattgcaagtcccttcgggccaaaaagtccagcccttccaaccctgggaaaataaatatcagctgagtctggcatgtcataatttatcacaatgttgacacgctcaatgtcaatgcccctgccaactaaatctgtagccacaaaaattctcttggggccttccttgaagttcttatatcttgttaccc

SEQ ID NO: 10539 - DNA, 1038 bp, Zea mays
  misc_feature: Ceres CLONE 1223972-R2
  misc_feature (893)..(893): n is a, c, t, g, unknown, or other
aaggacccccctcgaagctgttgccgaaagtggtcgtttgagttcaccggaggtggacgccaatgttgatcacttgttctcagatggtataaatcaagaacaaggcaacacaattgttaaatattaaggacatttgtcctccaaagcattatctcctttgggatatattgatcttcagacgaaggtcatgaagggcacaccttcatcatttatgagaataagaatccatagagataatatgtgtagtacattcattcattcacatatgtatttcataatatacacatgaatattaacagaatttatattacatcgatacctttggctcgtttgaaggtgttgatgcaagagcaattacaattcagcgtgaacagtacgctggtactgttcacctccttatgggcacgggacacagccccgggaaaaaatacatttaatgacccttaaatacttggttcctaaaccgtaaggtgtaaaatcacctgggggaattaactttagccctttttccttccctggggcccgggcgaataattgcctttgttccttccgcccattcccctttttaaacccagaaaaaaaaatttaactttttttcgcgaccaaaaaaacctatccgggagggttaccaattaattaattcccactccctcccggggcgcataataccacccctccaccacaatatcccactttttcgccttaaccgcgtaacatgggggtggggaatactccccccccttaaagaaaaaaactcttctctcttttcctagaggggtgggagaattccctgttttgtacaaccccttttatgtccacatccatttgtgccccttaaaagaaatctccgcctgtgtataagatgcctctccacagaaccccacctttttttnaaaggcgtttttctcgggaaaaaaagcccaggggcgctaaaaagtaaaattttctttatacgggagagggggcggccgctctctctgttcggaaaaaaaatttctcttccccccacgagttcttcccaccgccacaaatataaaa

SEQ ID NO: 10540 - DNA, 807 bp, Zea mays
  misc_feature: Ceres CLONE 1223972-R
  misc_feature (1)..(1): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (493)..(493): n is a, c, t, g, unknown, or other
  misc_feature (515)..(515): n is a, c, t, g, unknown, or other
  misc_feature (516)..(516): n is a, c, t, g, unknown, or other
nggggtgttgttcctccccccccaccccccccacacccaccaaccacaaaannnnnnccaattgggtacgaggccccccctcgagctgttgcctaaagtggtcgtttgacttcaccggaggtggacgccaatgttgatcacttgttctcacatggtataaatcaagaacaaggcaacacaattgttaaatattaaggacatttgtcctccaaagcattatctcctttgggatatattgatcttcacacgaaggtcatgaagggcacaccttcatcatttatgacaataagaatccatacagataatatgtgtagtacattcattcattcacatatgtatttcataatatacacatgaatattaacagaatttatattacatcgatacctttggctcgtttgaaagtgttaaagcaagagcaatttcaatccagtgtgaatgccccccctaacacagatactcttattttatgagtttgtgtcccacctgttgnaaaaaaaaaaataaagaaaaannaaatacactgatacaaaaaatgaaaatgtagaattttctaagcgcataccatagccctttcaccttctctggtcatcgacaacaaatgctttggcattttcgataaacaagaattattactatggagaaattaatatgttaccacccatagtctgatcgtgtggttaataacaattaatccattcgtttcatgtattatttttccatcattctatgttataaatctaacacaattgtatcgactgggaattatgtttaatatttggactataatttcctcctaacatcatg

SEQ ID NO: 10541 - DNA, 708 bp, Zea mays
  misc_feature: Ceres CLONE 1224381-R
  misc_feature: Encodes the peptide sequence at SEQ ID NO. 10542
  misc_feature (681)..(681): n is a, c, t, g, unknown, or other
cgattgggtaccgggccccccctcgaggagtgcgttatgcttcggcgtcacttccacagggccgggccacccgccgagggtggcagggcccgcgacgacgacaagaacgaagatcaccaagcaggagagttccccgaggtccacgactgcttcatgatctatggagggcatgcggcgaatgcctcggctcggcatcgcaagcaagagcgccgggaggtctgctcggtgaaggtggcggcgctagtctacctagactggtccaacaagcccatcaccttcgaccaggccgaccaccccgaccatgtgccgagcccggggaaatacccgctcgtcgtcgaccccgttgtcggcaatgtcgggctcaccaaggtcctgatggatgggggtagctgcctcaacatcatctacgccgagaccctcaagctcctgcgcgtcgatctgtcctccgttcgagcaggcgctgcgcccttccacgggatcatccctgggaagcgcgtccagcccctcgggcgactcgacctccccgtctgcttcgggacgccctccaacttccgaagggagaccctgacgttcgaggtggtcgggttccgaggaacctaccacgccgtactagggaggccatgctacgagaagttcatggccgtccccaactacacctacctgaaagctcagatgccgggnccccacggggtcatcaccgtcggcccc

SEQ ID NO: 10542 - protein, 236 aa, Zea mays
  misc_feature: Ceres CLONE 1224381-R
RLGTGPPLEECVMLRRHFHRAGPPAEGGRARDDDKNEDHQAGEFPEVHDCFMIYGGHAANASARHRKQERREVCSVKVAALVYLDWSNKPITFDQADHPDHVPSPGKYPLVVDPVVGNVGLTKVLMDGGSCLNIIYAETLKLLRVDLSSVRAGAAPFHGIIPGKRVQPLGRLDLPVCFGTPSNFRRETLTFEVVGFRGTYHAVLGRPCYEKFMAVPNYTYLKAQMPGPHGVITVGP

SEQ ID NO: 10543 - DNA, 848 bp, Zea mays
  misc_feature: Ceres CLONE 1224381-R2
  misc_feature: Encodes the peptide sequence at SEQ ID NO. 10544
  misc_feature (712)..(712): n is a, c, t, g, unknown, or other
  misc_feature (783)..(783): n is a, c, t, g, unknown, or other
  misc_feature (804)..(804): n is a, c, t, g, unknown, or other
  misc_feature (832)..(832): n is a, c, t, g, unknown, or other
ggggaccgggccccccctcgaggagtgcgttatgcttcggcgtcacttccacagggccgggccacccgccgagggtggcagggcccgcgacgacgacaagaacgaagatcaccaagcaggagagttccccgaggtccacgactgcttcatgatctatggagggcatgcggcgaatgcctcggctcggcatcgcaagcaagagcgccgggaggtctgctcggtgaaggtggcggcgctagtctacctagactggtccaacaagcccatcaccttcgaccaggccgaccaccccgaccatgtgccgagcccggggaaatacccgctcgtcgtcgaccccgttgtcggcaatgtcgggctcaccaaggtcctgatggatgggggtagctgcctcaacatcatctacgccgagaccctcaagctcctgcgcgtcgatctgtcctccgttcgagcaggcgctgcgcccttccacgggatcatccctgggaagcgcgtccagcccctcgggcgactcgacctccccgtctgcttcgggacgccctccaacttccgaagggagaccctgacgttcgaggtggtcgggttccgaggaacctaccacgccgtactagggaggccatgctacgagaagttcatggccgtccccaactacacctacctgaagctcaagatgccgggcccccaacgggtcatcaccgtcggccccacgtacaancacgcgttcgaatgcgacgtggagtgcgtggagtacgccgaggccctcgccgagtccgaggccctcatcgncgacttggagaacctctccangaaggtgcagacgtgaaagcgcatgccngcaacttcgagccagg

SEQ ID NO: 10544 - protein, 272 aa, Zea mays
  misc_feature: Ceres CLONE 1224381-R2
  misc_feature (237)..(237): Xaa is any aa, unknown, or other
  misc_feature (261)..(261): Xaa is any aa, unknown, or other
  misc_feature (268)..(268): Xaa is any aa, unknown, or other
GTGPPLEECVMLRRHFHRAGPPAEGGRARDDDKNEDHQAGEFPEVHDCFMIYGGHAANASARHRKQERREVCSVKVAALVYLDWSNKPITFDQADHPDHVPSPGKYPLVVDPVVGNVGLTKVLMDGGSCLNIIYAETLKLLRVDLSSVRAGAAPFHGIIPGKRVQPLGRLDLPVCFGTPSNFRRETLTFEVVGFRGTYHAVLGRPCYEKFMAVPNYTYLKLKMPGPQRVITVGPTYXHAFECDVECVEYAEALAESEALIXDLENLSXKVQT

SEQ ID NO: 10545 - DNA, 879 bp, Zea mays
  misc_feature: Ceres CLONE 1224787-R
  misc_feature (620)..(620): n is a, c, t, g, unknown, or other
  misc_feature (710)..(710): n is a, c, t, g, unknown, or other
  misc_feature (713)..(713): n is a, c, t, g, unknown, or other
cgattgggtaccgggccccccctcgaggaaacccgtcagtgtgcgcgattctcggtaagatgctccttcgtcgattcgcagtgaatactgcttcgtttggagtatatcgcattagggaattagacccagattggggcagattggagcgccggcgaggagcgccgcggtgcggtgtctctgtgccgtcggtcggtgagacgaaggtagcggataggttattgaccgtcgatccgtgaatgtgcggttcagatctgttgtagcataccgctcagattggattggcgtagccgtccgatcgtgatccgatgactgtgattcaatctcggagactaggatcgggaaccgaagatagctgatcggagggtgttggtccaagtcgctcaagatccactttggaccgtgggatcgggatctagtggccccgattacgtaccgattcacaaccatgccggtttaatccggtgcgctcacatctaatccaacgaccgagatctgacgataccccttcgccttgccattttgctaaagagtccataaactttctagaaaataacccgccgtcctcattgacagtaatctgagtctagggtttacttgcgccgagccccctgtattttccnagtattgaggcccagtccagagcacgtttaaaatgtataaatgaattagaaaatgtgtttttaatacaaaaatatttcctagaacttagntanttcatagaaaattcattttagctcccaatttagccattccaatttctaaaatttggtataatattcactaccatttagtgtctctgttttggcatgaaaacgtaagacatccattttacatttaatcctattttatccactttaatccttaaaaattcataactgg

SEQ ID NO: 10546 - DNA, 907 bp, Zea mays
  misc_feature: Ceres CLONE 1226089-R
ccccccctcgaggttttttttttttttttttcggttgacgaaacgtataaccgaaattaatacatgtttgatcgactccctgacgcagtaatgggagtgtgaatagtacaaatgagggggaattgtagttcaggatgaatacaaaatgttcttttttcctctgttaccgcggagtcaggcacactgtccaaaagtacatggaaacagaacaggtccaaccagagttattaccagactaagacgcacggaagctgattacgtacgatttacagaagcaaagggcatctggcgcaaaactactaaattctcgactgatttcccccactggtcaggcttgacaatcctcctcactaaaattgtgaatatcgggaaaaagtggagctgcctggagcctcaacatgaatagctggtttctttcccttttgcatctcacctgacagagctccctgattatacacgccttatgcatatgttcggcattcttcattacttctttgcccaaatcttcgccagtaacccgccctttgattccagcctttttcgcaatcatttagcttcccgcccacccctttcaaaaaaaccctcgggggaaaaaaaaaaacctttattctggcccaaatttgcagcccataccaagcttttaagggggcaccttttccgagaaaaattctccccttgaaaacccttcgggtaagttttacccaccgggggaaaaaaccaaaaaacccccttcctttggcaaaaaccaaatcttcaaggaatttttaaaaaatttccctccctcccataagtccccggggaagggaaaaattccatcttcccaggcttaaaaccccccggaaccaggggacccccggggcccccaaaaaaaaagggggatttgtggccaagaacaacttttaggggg

SEQ ID NO: 10547 - DNA, 844 bp, Zea mays
  misc_feature: Ceres CLONE 1226681-R
  misc_feature (28)..(28): n is a, c, t, g, unknown, or other
cgattgggtaccgggccccccctcgagnttttttttttttttttttcttttttttttttttttttttttttttttttttttttttccccaaaacaaaagaattgatttcatcccgtttcagtatttcactgcaacggaaggggaaaaagaaaataaacctcttacccctcattagaaggttttgatctagctcttcctttggaacttaacctaactgtagcaaaaggtttgaagtctttactgcagtatgccgcacgacaagcatatgttatgtagcgcacgggagcatcttccttttgaatctttttcaacaacttcttagccgccttacgtcccccaaatgaaaaaaaagcttgatacatcctcaaggaactcagcacgttggggggaaaaccagcaaattcgtattctgtccaaatctgttgggcacgtcgaaaatcctttgtttttacacatgcgctgaaaaaaaagccaaggcttgtccgaaaaacattaagtccaagttctttgacagcatcaagaaacaccattccaaaatccaaattgggggtctccatgccccatatttggcaaaaaacctgatcaacaaccatatatgaactcatttcatctttcccccggatctgcttaagaaaatcaattgcagcatcaggatagttgtgctggacacagaataaaagtactctgccacagccattaaaccagttgtttgagtcattccacccatcgaagaagtgatgcattctatccagttcaccttctggtcaaatatgctcaatcaaggaatgggcattttttggttccaggaagccgccgaattgcattatctcatcatgcaggggaa

SEQ ID NO: 10548 - DNA, 868 bp, Zea mays
  misc_feature: Ceres CLONE 1226759-R
  misc_feature (792)..(792): n is a, c, t, g, unknown, or other
  misc_feature (805)..(805): n is a, c, t, g, unknown, or other
  misc_feature (868)..(868): n is a, c, t, g, unknown, or other
cgattgggtaccgggccccccctcgagtttttttttttttttttttgtcatcaaatatgatttccatccggagagttgatctacaattctatctacaataagttgcaactgaacagaacagccaaagagggcagctaaggcagccacatgttcgtcagacaagggttgatggaaaagtttagcatactcttcttctaaggcatggcaactgatgccttcatcatcttcaataaccctcagggtcttttggctgcagttcgtttttgtttctttttctaactatttgttgcttgcagccacaccgatcattctatctaacgaatgatttcacacaccatacagtcacgcctaaatggcagcaagtgcatatagtacgaaactctcaaacaagacacaacagatactaaatccagaaggcgaccagccaagtgtcaattgtatgcctataacaaatgaggtcagatctgatcatcactcttcatcccacatcactcttcatccctaatgcctgatgatcagttactccgccagtggatgcctgatgatcccacgcccctcatccagaacgaagccgttgtccctgaagcacgcgctggagaagaagggcttcagatcgtagatctcgtattcttgggccttgttcctcaggtcctccaatttgacctcgacgtgagtaaggcgtgaggctgatcctgccatgatttcttcgaagtgcacggcgtcccttgacagtgtgcgcaggagcagcaggagcagctcgttgtagtccctctttgatgtcatgtacttccngaaattcttttgnagtgctttctgcacaccgaaattctgagtcgaaataaagagtcaagcaagacacggatggccn

SEQ ID NO: 10549 - DNA, 860 bp, Zea mays
  misc_feature: Ceres CLONE 1226759-R2
gatttcatccggagagtgatctatattctatctacataagttgcaagtgaacagaacagccaaagagggcagctaaggcagccacgtgttcgtcagacaaggggtgatggaaaagtttagcatactcttcttctaaggcatggaaactgatgccttcatcatcttcaataaccctcagggtcttttgggtgcagctcgtttttgtttctttttctaactatttggtgcttgcagccacaccgatcattctatctaacgaatgatttcacacaccatacagtcacgcctaaatggcagcaagtgcatatagtacgaaactctcaaacaagacacaacagatactaaatccagaaggcgaccacccaagtgtcaattgtatgcctataacaaatgaggtcagatctgatcatcactcttcatcccacatcactcttcatccctaatgcctgatgatcagatactccgccagtggatgcctgatgatcccacgcccctcatccagaacgaacccggtgtccctgaagcacgcgctggagaagaagggcttcagatcgtagatctcgtattcttgggccttgttcctcaggtcctccaatttgatctccacgagagtaaggcgagaggctgatcctgccatgatctcttcaaagtgcacggcgttcttgcacagtgtgcgcaagagcagcaagagcatctcgttgtaccccctcgtagatgtcgtgcactcccggaactcttttggagtgctctctgcacacagaatttctgagtcaaaataaagagtcaagcaaaacaccgatggccctgtcaacatctttctgagaaacgtagcttctcagatgcatccttgcatgcgcccg

SEQ ID NO: 10550 - DNA, 749 bp, Zea mays
  misc_feature: Ceres CLONE 1227594-R
  misc_feature: Encodes the peptide sequence at SEQ ID NO. 10551
  misc_feature (21)..(21): n is a, c, t, g, unknown, or other
  misc_feature (62)..(62): n is a, c, t, g, unknown, or other
tctttgggtttgtgtgtggtntttatacccaccacaaaaaataaatacaggctcctccgccnccgcactgtcccaatggacaagacctgctggctgtaagttctacaacagtgtctacttttgtcatagtagtaattacaagttactacaattgtaatggcaacaaaaatggctggtgaatatgctgtacaggctctgttttcacactccacaaaatatggcgcttgcagcgttttcaccctatccctccgaacattttgacaacttgatgtacctcgcaaaataaggcttggatgcctacaaacacccgacatacagttcacctttgtacacaaaggctaaccatggaaggaataaaaaaaaacttctgccagccttcagtattaccagtccaatcgcccacacctggcgcgggaagggaagagccaaaattaccgttgttctggactagcgcccgtcacgagtcactttcggctgccgttgctgtagctgctttcagcttctggcttacaaactgccccttaactcttggactctgctccgcgagcttcttcctgctatgatacctgaactttttatcgaagcatcttgactttccttttcctgccggaactttcctcaaagcaagctttctccggtgagaacctggtcaccaatatttggaatggccatctcctccgttgaccacctcctcttaaggggcaacccgcgccggtaattcccccaatttggcgtaatgcgggcttttc

SEQ ID NO: 10551 - protein, 32 aa, Zea mays
  misc_feature: Ceres CLONE 1227594-R
  misc_feature (21)..(21): Xaa is any aa, unknown, or other
SLGLCVVFIPTTKNKYRLLRXRTVPMDKTCWL

SEQ ID NO: 10552 - DNA, 865 bp, Zea mays
  misc_feature: Ceres CLONE 1227594-R3
gagaaagatggtactgtcccaaatgggaaagacctgctggctgtaagttctacaacagtggctacttttgtcatagcagtaattacaagttactacgattgtaatggcgacaaaaatggatggtgaatatgctgtacaggctctgttttcacactccacaaaatatggcgcttgcagcgttttcaccctatccctccgaacattttgtcaacttgatgtacctcgcaaaataaggcttggatgccaacaaacacccgacatataggtcacctttgtacagaaaggctaaccatggaaggaagaaaaagaaacttctgccaaccttcagtattaccagtccaatcggccacacctggcgcggaaagggaagagccaaaattacagttgatctggactaacgcccgtcacgagtcagtttcggctgccgttgctgtagctgctttcagcttctggcttacaaactgccccttaactcttggcctctgctccgcaaggttcttcctgctatgatacctgacctttttatcgaagcatctgtctttccttttcatgcggaacttcatcaaaggagcttctcggtgagacctgtcactatattggatgccactctcgttgacactctctagggcaaccgtcgtattcgcattggtatcggcttcaccgctacccgtgcatctgcttccattacagatatcccgggtgcagcttgcgctctggttagcatgatccatgagagctctaacatgtcgactggatgccctgattcccgatgagttgacttgaatgatgcaactggtgggtatgctctgactgattgagctcatcagcctgagatggactaccactaccacgatcgtcacgttag

SEQ ID NO: 10553 - DNA, 865 bp, Zea mays
  misc_feature: Ceres CLONE 1227594-R4
  misc_feature: Pfam Name: CCT Pfam Description: CCT motif
  misc_feature (28)..(28): n is a, c, t, g, unknown, or other
  misc_feature (804)..(804): n is a, c, t, g, unknown, or other
  misc_feature (813)..(813): n is a, c, t, g, unknown, or other
  misc_feature (854)..(854): n is a, c, t, g, unknown, or other
cgattgggtaccgggccccccctcgagntttttttttttttttttttctttttttaataaataaaatggtactgtcccaaatggaaaagacctgctggctgtaagttctacaacagtgtctacttttgtcatagtagtaattacaagttactacaattgtaatggcaacaaaaatgggtggtgaatatgctgtacaggctctgttttcacactccacaaaatatggcgcttgcagcgttttcaccctatccctccgaacattttgtcaacttgatgtacctcgcaaaataaggcttggatgccaacaaacacccgacatagagttcacctttgtacagaaaggctaaccatggaaggaagaaaaaaaaacttctgccagccttcagtattaccagtccaatcgcccacacctggcgcgggaagggaagagccaaaattacagttgttctggactagcgcccgtcacgagtcagtttcggctgccgttgctgtagctgctttcagcttctggcttacaaactgccccttaactcttggcctctgctccgcaagcttcttcctgctatgatacctgacctttttatcgaagcatctgtctttccttttcatgcggaacttcatcaaagcagcttctcggtgagacctgtcactatattggatgccactctcgttgccactctctagggcaaccgtcgtattcgcattggtatcggcttcaccgctacccgtgcatccgcttcctttacagatatccccgctgcagcttgcgctctgggtagcatgatccatgtgagctctaacatngtcactggntgtccttgatcccgatgaatttgtcttgatgatgcactggnggttttctctg

SEQ ID NO: 10554 - DNA, 749 bp, Zea mays; identical to SEQ ID NO: 10550
  misc_feature: Ceres CLONE 1227594-R2
  misc_feature (21)..(21): n is a, c, t, g, unknown, or other
  misc_feature (62)..(62): n is a, c, t, g, unknown, or other

SEQ ID NO: 10555 - DNA, 661 bp, Zea mays
  misc_feature: Ceres CLONE 1229298-R
cgaattgggtaccgggccccccctcgagttttttttttttttttttttgaacacaaatatacatactatgcaattcaagcagaatgccagacacaatatacaaggaatgaggctgaaagcagcttaggccctctaaaacagagttacattcgatgatgaagcccttggaaacaagttgtacaacatatcacacccgacagaatacaccacctggttgtatgaaacacattctctcgggggcttcgatggatgtctgtcccgctgagtgctgcagacccttagtctagagatgaaagagcaggtattcccacacttcttttacccgaatggattactacccccaacggagccgtatgaaggtggggtgtttggctggaggtatcccaaaccttgttgcgttacaagcatgctattaggttgttgctcgggcatgggcatgctgttcggaacttgctgcatcatgaaatggcttggatgtgcggctgattgatagagctggtgaggctgctgtggaggaacaccaaaactagagttgctaattaaggtttggggagctgggcctgctaatactcctggtggtccagatgggggcatgtgagcttgagttggagctggcccattcccaagatcaaaagggtttgaagctttcacaggttggggg

SEQ ID NO: 10556 - DNA, 723 bp, Zea mays
  misc_feature: Ceres CLONE 1229341-R
  misc_feature (21)..(21): n is a, c, t, g, unknown, or other
  misc_feature (25)..(25): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
gggtggtgggtgtttcttttntttnttccgaccaaacacgccaccccccaacccccacacaccacannnnaccaaccgaactgaaaatatattttatcataaatcacttacagaactggctgtaaaacaccagaacacaacaatgtcattaagtttaacaacatgacatgacatgcatcaacagttttggttcatcgatggcagaggcatcagtatcacatgttctacgagatatttaatggcacacaaatgcatttccgtattcaggacttgcagatgggaatgactgcattttgcataacagataagtcttggttatcacagaagatgcaggccactctccgtcagttattaccattctgcacagctgcatttgcacgcggatcatcctcaccaatctctccatcctcgtctatgataccttcctcatcatcatctctgcctttgctgcggcgcactggagatgcaggctcacccttcccagaaggttcaacaaatttggcacctgcctctggctgaccgttggggctcattgagccactggctttgccattgtacacaggactatatggagcagacttgccatcgtgtgagctgggcgagcgatcaagatcaaccctttccatcttcccatcttccatgtgcccatccttgaggccagaagggattccacatggggcatccccaagagagagaatcttgggaggggctctttgcggctct

SEQ ID NO: 10557 - DNA, 870 bp, Zea mays
  misc_feature: Ceres CLONE 1230147-R
  misc_feature: Pfam Name: HSP90 Pfam Description: Hsp90 protein
  misc_feature (870)..(870): n is a, c, t, g, unknown, or other
cgattgggtaccgggccccccctcgaggtttttttttttttttttttctttttttttttttttttttttttttttttttttttttttttttttttttttttttttttttttttttttgggaaaaccggaaaaaccggtaagttttaaagcccaacaaaaataaagcctacaaaaaaacgaattgggtttaaaattaatactggcccccagggcgcagaaaaaactaaccctggggccctaacccccctggggggtcaggaaccagttcaaggagccccgctacccaattattcccaaacatctaatttctaaacaaaaagttttaaattaccaggaaaaggttttggaacaaaaaaagggcggcaaaaaatatactccaaattttccgccatggtggggacaaaggttcaaaaatactccggaaaaaaattttggaagaaaagggcctcacttttggtgaacaacctcaaaggggtttggccccaccacttgaggtttaagggggtcgtttgaacccaaaggggggtccgggtgggggattgggtccgcaagttgcccccgggcctgggggtgtgaggaacatttgccagggatgggaaagggcatcatctccgaaatcttcccactggactccgccggggtggccggggaaaagccccttgtaatcatagaaggttcaaagagaacatccagagccttttagggtttaggatcatcaggggtatttctggatggccattcaaggccttgattatcccagggctcggggttaattacaaaactttcctccgacgcctggaatccaagaggttgtttcccccataaaagggggctctcccccccttttcatatggggtggaacaaccaaan

SEQ ID NO: 10558 - DNA, 834 bp, Zea mays
  misc_feature: Ceres CLONE 1230256-R
  misc_feature: Pfam Name: RVT_2 Pfam Description: Reverse transcriptase (RNA-dependent DNA polymerase)
  misc_feature: SWISSPROT Homolog: EC 2.7.7.49 RNA-directed DNA polymerase
cgattgggtaccgggccccccctcgagttgctcacttctgtgaaattattcttttgttacctctattgagccatacaagatagatgatgcactaagagatccggactaggtggtggcaatgtaagaggagctcaacaaattcacaagtaatgaggtatggcatttagttccacgtactaatcaaaatgttgtaggtaccaaatgggtatttcgcaacaagcaagatgagcatggtatggtgacaatgaacaaagcccgacttgtggccaaaggttaattacaaattgaaggtttggattcgatgaaacttatgtacccatagctatgattgattcaattcgtatattacttgcctatgctacttgccatggcttcaagctttatcaaatggacgtgaagagtgccttcctcaatggacccatcaaggaagaggtctatgttgagcaacctcccggctttgaagatagtgagtaccctaaccatgtttacaaactctcaaaggcgctttatgggctcaagcaagccccaagagcatggtatgcatgcttgagagattttcttatcactaattgagagcacctagagggggggtgaataggtgatcctataaaaacttaaaacttaaagccacaaaacttgattaagtgttagcacattgaaatcaagtggctaaggaccgagctcttgtgaaacacaatagtcacagtgagaacaagcacaagagacacgatgatttatcccgtggttcggccaagtataacacttgcctactccatgttgtggcgtcccaatggacgagagttgcactcaactcctctcaagtgatccaatgat

SEQ ID NO: 10559 - DNA, 636 bp, Zea mays
  misc_feature: Ceres CLONE 1230394-R
  misc_feature: Encodes the peptide sequence at SEQ ID NO. 10560
ccgattgggtaccgggccccccctcgagagtgcagtggaaaagcttcggctattgtcaaattttttaacagcacaacagtgcaatgacaataaatgctgttataacttcacacctacccgtctgtttatatagtgctgcaggtggaaaggtgaatcgtcaagtcactcacacccaccgaacagttgcccgcacccgctgagtggtgggccacccaccgcttgaaatattttaatcgtttcttggcaacgagctcagggaaggtgattttcggaccttcggcattttgaagcctttgaaatttttgcgcggatcgagctcgtcacgaaaaatgatctagcaccatgaaggggctactgttgggggcatgcttcgtcgccgaatgacctccaagcgaaaacacctttggcaagttgacacataagcaaacagagcacaaagatacaagtcgaagctatgatccaagtagcttcggcctagcgatatgccttgagacgaagagctgcaccgacttaaagaggaaaagaccgattagtccatgatagttcgtctcatgtttatagttatttatcgagggcatgaatgtaattttgaccggactgcgtcccgagcctataaatagatgagcagtaacctcg

SEQ ID NO: 10560 - protein, 38 aa, Zea mays
  misc_feature: Ceres CLONE 1230394-R
MTINAVITSHLPVCLYSAAGGKVNRQVTHTHRTVARTR

SEQ ID NO: 10561 - DNA, 862 bp, Zea mays
  misc_feature: Ceres CLONE 1230783-R
  misc_feature: Pfam Name: EMP70 Pfam Description: Endomembrane protein 70
ctataagctaggagcagtgtcctatccttgctacaactctgaaccacagtgaggataaatggtttataagctaacaccaaaaggacagctgcactgaagattcatgaaaaaagcgcaatgggcatactcgctgcaggcccatggaacatgcctagtcgatcttcacagaagaataaatcaatcttgtgaagcagaagcaagcgcaaaagccgatcggaccggtgagcacacagaaagcgaacgaggcaagaagcatgtagccaaagtacagcatgcccgacaccaccttagtgatctgcagcttaatgaagaagcagaacccggcatacaggaaaaggtagattgctgatgatcctgaggtcagaaaggacctccaccaccacaggtagtcctcactgcacagttggaaatagcacaggacgattgtgatctccgcacaggtgacgatgaggataatgaacaccaggaacaggaagccaaagatgtatgataactgatgaacccagatcgacggcaggatgaataagagctcgatgaacactgctccgaacggaagtatgccaccaatcagaatggagaaggcatggatcatgtaccaagcctgatcggtgacctgactccgggatcttgttcgccttcaccggagcctcagtggcaggttgcttgaatcccacatagctcccgacagatgcacgaggatccgagataccagaccagaggaggaccaacgtcaacattgtggagaaaggaacagcgcctgaccacttctccccccatattaaagcattaaggacagaacaaataccgaaagcaatcccagaaaaccgaacgccggcctcaaggcgatgctcctccatcctga

SEQ ID NO: 10562 - DNA, 859 bp, Zea mays
  misc_feature: Ceres CLONE 1230911-R
cgattgggtaccgggccccccctcgaggtggaggaaaaggagcgggcgctggaggagcgggtccgccaattttgggcggcgcaagcggcacaggcagcaccgggcccccaggcggtggaggcgatgaagaagacactcaaagatctccaggcggagcagcgcgccggggcccagcgcatcgccgcatgggccggcgaggcgagcacggcacttgtcggggaccataattagggtaccctcaaggctcctaattctcagctagtaacccccatcagcataaagctgcaaaggcctgatgggtgcgactaagtcagggatcggtccattcgagggactcgatcacgcctcgcccgagcctagcctcgggcaagggcagccgaccccggaggatctccgtctcgcccaaggcccccctccagcgacgaacatacttccggctcgcccgaggcccagtcttcgccaagaagcaaccctggccaaatcgccacgccaaccgaccaaatcgcaggggcatttaatgcaaaggtggcctgacacctttatcctgacgcgcgtcctccagtcgacagagccgaagtgaccgcagtcacttcgccgctccactgaccggcctgacagaaggacagcgccgcctgcgccgctccgactgctgtgccgctcgacagagtgaggctgacaggcagtcaggcccagcctcaggcaccataggaaactccgcttcgcccgacccagggctcggactcgggctcggccccggaagacggcgaactccgctccgcccgacccagggctcggactcggactcagccccagaagacgggaactcccgctcgcccgacccagggctcagactcgggct

SEQ ID NO: 10563 - DNA, 844 bp, Zea mays
  misc_feature: Ceres CLONE 1231144-R
  misc_feature: Pfam Name: Upf2 Pfam Description: Up-frameshift suppressor 2
  misc_feature (789)..(789): n is a, c, t, g, unknown, or other
tcgttgccaattatgttattattatatgtacatgagcaaccggagtatctatgctctccaggtacagccataagcccataactaccaagcaactcaagccattcgggccaccagaaaaatagctccttcaaggcattgctatctcccatcagtggtagaattatcttatctttcagattagggtggtggaagcaattgtccatcaagctgtgttaacctccccgaaatttcttccctgttaatctgatcgttaggcggttaaatagagagaagcatggccctgccaaaaaaagctcaggacaaaatagctcacacagctaactgttctcctgcaacaactgatagaaaccacaagaacccacagtgtggcgcctctgccaaccacctcccatcaggacaaactcatcttctcctgccataactgtgatagaaaccaccagaaccggcgatgtggtgtcgttgtcgaccacctccccgtgctgaaccatcccagctgccccggccacctgatctgatactgctggtgttggtagctccttgaccccagttccccatttgtgatgctccattcagttcttcctcctccctttcattgtattcaaggatcctccgcttaatgctctgcttctcctcaagctcggcagcttcttgctgcttcgtgcttcgaacgattgaactatcagcgggaattaacatttgcctcgtctggtgtttgtgccctttcttcattagcaccttaacacgcaccttgctgctaccccagcattgccacccttctcatctactggnttctctccactctcagattctgtggccctcgagtcttttgatgaaccttcaggga

SEQ ID NO: 10564 - DNA, 853 bp, Zea mays
  misc_feature: Ceres CLONE 1231144-R2
  misc_feature (799)..(799): n is a, c, t, g, unknown, or other
  misc_feature (853)..(853): n is a, c, t, g, unknown, or other
caattgggtaccgggccccccctcgagttttttttttttttttttttctcaaacgactcacactcgttgccaaattatgttattattatatgtacatgagcaaccggagtatctatgctctccaggtacagccataagcccataactaccaagcaactcaagccattcgggccaccagaaaaatagctccttcaaggcattgctatctcccatcagtggtagaattatcttatctttcagattagggtggtggaagcaattgtccatcaagctgtgttaacctccccgaaatttcttccctgttaatctgatcgttaggcggttaaatagagagaagcatggccctgccaaaaaaagctcaggacaaaatagctcacacagctaactgttctcctgcaacaactgatagaaaccacaagaacccacagtgtggcgcctctgccaaccacctcccatcaggacaaactcatcttctcctgccataactgtgatagaaaccaccagaaccggcgatgtggtgtcgttgtcgaccacctccccgtgctgaaccatcccagctgccccggccacctgatctgatactgctggtgttggtagctccttgaccccagttccccatttgtgatgctccattcagttcttcctcctccctttcattgtattcaaggatcctccgcttaatgctctgcttctcctcaagctcggcagcttcttgctgcttcgtgcttcgaacgattgaactatcagcgggaataacatttgcctcgtctgttgtttgtgccctttcttcatagcaccntacacgcaccttgctgctacccccagcattgcacccctctcatctactgtttcn

SEQ ID NO: 10565 - DNA, 1020 bp, Zea mays
  misc_feature: Ceres CLONE 1231456-R
cttacaacacaacacaaaacctaaagacacaaaaaaaacaccccaccccaaccacactacggtctataggttcattagtgtttccgtgattggagtttgaaatgataaaatgacgttattgcagtggaaataactaccggagaaaaccgagtagaatggcgtgtttataaccacgtgactcctcctggtcctctcctgagaaagaaataacccactcgacagtgtatcccggtggaagggaggaaggccatgtcacaccatcaacaaatcaacctaaggagtacgtggaaaaaattatgccacgagcaagggtgagaatactaatactcaggtagacttacccggtgtgaggagtatactactctacctctagacatgcagctgtctagatgaggagttaggtcttgcacaaagtactattttgagtctcaatacacgtcttatgctttgcaagttttagtagagtcccttagagtagaggtgtacctacgctaatcttacatggaaatcaaaaatttgctacctctccagacctcttttagtcaggacaacctcagttctcccacattagtaactcaatgccaaaacaatgagatcaagtcagacctccactaacctcgtgaggaagtgcagaagaatcagaaatgggaggcttttaatccctcggaagggtagaacactacaccgcagaaagatgtaaggggaagacttcgctcccccactacaatatcaagcgtggccccccaccgaatatcgcaccgtgggaaaaatccaggtcatcaccgcccttggtcataacaatggccttcacttgacgcacgactggccgatccaaggaatagctctggcactctgaaccccacctataaccccgaaataacataatcaccctgtctatgccatggtgagtgcaatttggtcttcctgcccaccgtctcctcaatgtaacgaaggcttaccggattactacgaattttcccgaccatccattcaatacgattgacaagcttcgaacaaggt

SEQ ID NO: 10566 - DNA, 969 bp, Zea mays
  misc_feature: Ceres CLONE 1231456-R2
  misc_feature (792)..(792): n is a, c, t, g, unknown, or other
tacatcaccacccaaactcttctcctgcctcccatccccccccctcaccccgaattgggtaccgggccccccctcgagttttttttttttttttttaaccataataccactaatttaataagtatcattagtgattacattatcggagtttcaaaatgataaacataaatttattgcagcggaaataactaacggagaaaaccgagtaacatggcgaatcctagccacgctactcctcctggtcctctcctgcggaagcagtaacccactcgaccgtctatcccggtggcagggacgaaggccaagtctcaccatcaacaaatcaacctaaggagcacctgcaaaaaattatgccacaagcaaggctgagaatactaatactcagttagacttacccggtgtgaggagtctactactctacctctagacatgcagctgtttggatgaggcctttggtttgccaaaagcactagctgagcctaaaaacaagttttagctttttccagttttaagaaaatcctttagactagatgtgtacctagctacccataccatggcatcaaaacattttcacctatcccaccctcttattgccagtcaacttcatttcccacttataacctcaatgcaataccaatgaatcaaagcagccctcattagttgccgagaaagcagaccgattccaaatcgcagttttctatccttgccgaaggtacaccccaaacacgcgaacattgctggagggattccgctccccacacccattcaaccggtccccatcggatatcccgnccagaagaataaggggctacccgcctttggcgataacatggcctcactgacccccgactgccgacccgaaatgacccgtatttgtacccctcattaaccgtaatgccaaaccctttcccatgtcgagggagggaataagtcctctgccaagggccaccaagaactagccttaccttt

SEQ ID NO: 10567 - DNA, 880 bp, Zea mays
  misc_feature: Ceres CLONE 1231533-R2
  misc_feature (28)..(28): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (831)..(831): n is a, c, t, g, unknown, or other
  misc_feature (832)..(832): n is a, c, t, g, unknown, or other
cgattgggtaccgggccccccctcgagntttttttttttttttttttcttttttttttttttttttttttttttttttttttttttttttttttttttaaagggagcccatgaattcatcaattcaaccttttcttttggacaacagcactaataaagggcatcaaagggaccccttttctaaaccccgaacatccagggaaaaaacttagctccttcctttcattccttcatctaaagattgattgacatccacatttggcctcttcacttcatcgggaaaggggcatgtatatttgcccataccacatctttgatgaaaaaggtcgagcatgggtaccctcaggaggccctgacaatggggggggaaaataccatgcctcgacgctgccaaggagcccaaaaactatgttcagggttagttgccttgaaaacttattccattgcattacatgctacgggcaacaactactgcacggtgtggaaatgaaaaaggagcatgctttccggggtcaacattggcaacccgctgacaaacacctcggggcccttcgtcgttcgacgatctgcgcgtacccaaacagcacacaaaacctggggtcattggcataaaattctctccacaatccataaaaaaacaaaacaacgtctctcgataaacagttaaacactgaccttgatcatcgaacccatccccagcgatggcgcattctttttttcttgaaacagaatagactaacatttaaacaacaaactatacttgctatttgcaatagccaaaaggggaaatagacaatatgcttatgaccaaaagtgacttatctccccnnnnnataatttggggggggggggaaaaataaccgtcaccccgggggaaccat

SEQ ID NO: 10568 - DNA, 869 bp, Zea mays
  misc_feature: Ceres CLONE 1231533-R
  misc_feature (770)..(770): n is a, c, t, g, unknown, or other
  misc_feature (772)..(772): n is a, c, t, g, unknown, or other
  misc_feature (869)..(869): n is a, c, t, g, unknown, or other
gaattctcaattcaccttttcttttgtacaacagcactaataaatggcatcaaagtgacaccttttctagaccccgtacatccagtgcaataacttagctccttcctttcattccttcatctagagattgattgacatccacatttggtctcttcacttcatctggaaagtggcatgtatatttgtccataccacatctttgatgaagtaggtcgagcatgggtaccctcaggaggccctgacaatggcgtgggcagataccatgcctcgacgctgccaaggagcccaagaactatgttcagtgttagttgccttgataacttattccattgcattacatgctacgggcagcagctactgcacggtgtggagatgagagaggagcatgctttccgtggtcgacattggcaacccgctgacgaacacctcggtgcccttcgtcgttcgacgatctgcgcgtagccaaacagcacacaaaacctggggtcattggcataaaattctctccacaatccataaaaaaacaaaacaacgtctctcgataaacagttaaacactgaccttgatcatcgtacccatccccagcgatggcgcattctttttttcttgaaacagaatagactaacatttaaacaacaaactatacttgctatttgcaatagccaaaaggggaaatagacaatatgcttatgacacaaaagctggacttttataacccaaggggaattggggggggtggggtactagcctgcagcccgactgatcataantnctaaaatcgccgccaccgcggagtagctcagcttttgttccctttatgagggttaatttcgagcttggcgaatcatgcccatagctggttcctgtgn

SEQ ID NO: 10569 - DNA, 451 bp, Zea mays
  misc_feature: Ceres CLONE 1231712
  misc_feature: Encodes the peptide sequence at SEQ ID NO. 10570
gatcagctagatgcctgcggcgtggcaggccaaaagctcgctcactggtgaggcgaccgtaccaaagaacacgacgccgacgacgacgaagactaaagagtggtagcagttcgctgtatacttgcccccccaatgcaaggtgtaaagcccagtggaggacgaagagatcgacctcgctgtacgagtacgacgaacggaagggatgcttctcggtcggcggcggcggcgatctcgctgtacaaggcgattagtagacgtacaaaatgtaaacggaaatcgattgatgggcggaagacatgtacgtatcttgttttgatacccgcggccggggccctcctagaggcgtactgtatgatggttatgcgggccgtctacaactactactggtgttgggctatatgtatatttatataaaatgtaatcacctgtaaaaaaaaaaaaaaaaaaaaaa

SEQ ID NO: 10570 - protein, 93 aa, Zea mays
  misc_feature: Ceres CLONE 1231712
MQGVKPSGGRRDRPRCTSTTNGRDASRSAAAAISLYKAISRRTKCKRKSIDGRKTCTYLVLIPAAGALLEAYCMMVMRAVYNYYWCWAICIFI

SEQ ID NO: 10571 - DNA, 670 bp, Zea mays
  misc_feature: Ceres CLONE 1231729-R
ctggtggctacaactgtctgcttgcacctgcaaatacaccaacagtctctttccgactgcgcaaactacacacaggacctaaccaaatcctgacaccgaaacccaaatcaagcatctactactggtcctgaacgaccaactctaaccagtaagcgtggtcactgtaaggcctacgactactacgataatacatggatacaggttgatgcacactacgcatctcgtacgtggaaacggccagtcattgctatagctctagttaacctagctagggatcatgtgttgccccctttaattcgctataacacaatatcccctacgtcgctcttccttctctcgttgcgcttcgcagcacccttctctgtcctcgtcgaacgttggtcgctcttcgcttcgccggttgttctggtgtcgtacctggtcctttctcgaccgaatcaacgtctacagcagcggcagcagactcgactggttgggtgcttgcgggtggcactggcacagcactgctcgagttggtgtagctagggttatcgtttcctgacaattctagcccggagttggcatttgattggtccacaacaccgtttactaatgttttcttggtcgtcgacccattcttttttgtctgggttgggggacccgcatcatttggtatggattctggaaaagt

SEQ ID NO: 10572 - DNA, 876 bp, Zea mays
  misc_feature: Ceres CLONE 1231777-R
  misc_feature (793)..(793): n is a, c, t, g, unknown, or other
  misc_feature (836)..(836): n is a, c, t, g, unknown, or other
  misc_feature (847)..(847): n is a, c, t, g, unknown, or other
  misc_feature (876)..(876): n is a, c, t, g, unknown, or other
tgggaccgggccccccctcgagtgttggatcaagaaatgcatggtcgtgctagggttaagagttaaccattgaaaggattccaattcacagtatcgagaaagagaggtcagcttagagccagaccaaatatcgtgagacaaagggaacatcatgtacgtaatgtcgcaatggttcgtctgatatatctttacgtacacataggagttgacatgtcttgctagaggccgctgtcaattattgggccaagtaagagtactcgggctatgtctatttgtacgtgaacctatagggtcacacacttaaggggaaggaagcctaattcggattagatccgaaattagactgggctttagggttaatgatgggcctcgacgtcagaagcccaccataacgcctatataatgaggggcgggggcgcggttaagtgataacctaattcgccacctgcaaaccagcagccgccgctcgcctctcgccctcgccaagccgccgtcgcgaacctagcagttcggtacgcggcgcttcctccctgtacgtgtggatacctcggaggtgctgcatctggagcacttggacgaaccgtgcgaggacgtgaaggacgccggcgactgcacggcactgctcgacgcgttcgtctacatcgagacgtcttccgctgctctgcgcgtctagtggtaattccatgacctataaccgcagtcgttcttggtattatggggttgaaaattttgttttgcgctagtgtagcctccccgtaaatctacagtacctgcttgtaaggatggtatagangtggtttaatccatagtaagtcaaaatccattccatccatgtncatacactccnaatcacatagaattgaaataacccgacan

SEQ ID NO: 10573 - DNA, 889 bp, Zea mays
  misc_feature: Ceres CLONE 1231868-R
  misc_feature: Encodes the peptide sequence at SEQ ID NO. 10574
  misc_feature (815)..(815): n is a, c, t, g, unknown, or other
  misc_feature (858)..(858): n is a, c, t, g, unknown, or other
  misc_feature (859)..(859): n is a, c, t, g, unknown, or other
  misc_feature (872)..(872): n is a, c, t, g, unknown, or other
cgattgggtaccgggccccccctcgagactagttctctctggcaatttttgctactgctcaacttgataaatatgatgtcactcttttaatgatactatgttttggaaatgaagttttattatgttgttaacccgatggttaaacaagaacattttgtgttaaatggaacatggattgaccacccaggataaaagtgcaaccacgagtgctatcatggctctggctttggtaattagctatatagacttagtgcttagcaaccctacctgaaagatgggcaagaggggacgacagtggtttggtggtagctcatgttaacatggggtggtagtcttggctaagttacctcacccagagggccatcaatactgacgtggaaaccttagcgggtggctttgtactaatgatattttgtgatagcctcatagtggatccctagccattcacctcagcagtgtttacgggtccgatcaacccaggctagatgggatacatggcttgtgggtgaagttgtaccacctctgcagagtgtaaaactgatatgtcagtcgtgctcacggttaagagcaacctggaccctcacaagacaattgaacttaaagatggaaaataaatcatgatctgatgatctatcagtggttttcttaagttatttcacttaagtgcttttgatataatcttatacctttgattaattgggatatttggggtacacacttattagtaagacatgtgttgctaataaaatattgaccgactaaatttcttactgcttatccatagcctacctcgttaacttgtattaatttccccnacctgctgagcccccgacataagtgagctcaccctttgctatnnttttgatagaggntgatgacgaagacttcc

SEQ ID NO: 10574 - protein, 29 aa, Zea mays
  misc_feature: Ceres CLONE 1231868-R
RLGTGPPLETSSLWQFLLLLNLINMMSLF

SEQ ID NO: 10575 - DNA, 880 bp, Zea mays
  misc_feature: Ceres CLONE 1231931-R
  misc_feature: Pfam Name: FKBP_C Pfam Description: FKBP-type peptidyl-prolyl cis-trans isomerase
  misc_feature: SWISSPROT Homolog: EC 5.2.1.8 Peptidylprolyl isomerase
  misc_feature (715)..(715): n is a, c, t, g, unknown, or other
  misc_feature (862)..(862): n is a, c, t, g, unknown, or other
agcatgctatggtcttatcacttgaaaccaaatccatttttcgaaaagattgaagtgttagaaaggaaagaaactatcttttgcagctacaacaccattcagaaacccctcatcagagattctatgaattcagggcagttttattgaacattaatcagttcgacatcaaaagtcagccaagcattaagaggaatctggacaccagtacccttcgcaccataccccattgatggaggaattgtaagcttccttttgtcaccaacgggcatgacattaactccaacatcccatcccttaatgactgatccaatacctagacgaaactgaaatggtgattttgcaatgatggaatcgaaaatcttcccattcttctgaagctttccaatatagcgcacagaaaccgtttttccaggatcagctctcttgccgttgggttttgccatgctcaactcttcaacaatgagcccatttgggtatgtccgtacttgacaagacttgcagtccgctggggtttgcttctcaacagtaccagaaatttctgcagcttcctcacttggtctcttctttatcttatgtttagttctcatcacagcagatttatctggtgtcttggagctttcactcatggcattgattgcagttccatcttgagctgttgtgttagagagatttggataatatcctgcttcatcagaacatgtcccgactgacttgnccagcttcctcatataagacactttcccctttcttcttcccgatctgacttttcttcattctacgtctgattgcactgtcttgcccatcatcttgctcagcagccctggccttccgtttcttgatactagcttgttcgacattatcnacaaccatcttctgactg

SEQ ID NO: 10576 - DNA, 764 bp, Zea mays
  misc_feature: Ceres CLONE 1233747-R
  misc_feature (51)..(51): n is a, c, t, g, unknown, or other
  misc_feature (764)..(764): n is a, c, t, g, unknown, or other
gggacggacgggaggggggggggacaaacccccaccaaaacatataatatntatttatctattgggtaccgggccccccctcgagttttttttttttttttttttggaggatcctttcttcttttttatcttttttgtcggaaaaaacaaatggtccattaaatccctttggggtcaagtcaagtatcccactccatttgttctcttttaaaaaaaatagacatcactttgacaaccctttaacaatttacagcgagaaaacccttttgatgccattgtaccagccagaatagtctgtaaatcctttccagctgaaagtaactttacttcgggaaaattgctcttttagaattgaaaaaatttccaggagagaaaaatctaccattcctctcaggaatagttcggctgcaccatggaggagtgttaaaagttaccgggagcaccctttcaaccttttctcttttttaaaccaggaacgggtgcccggacccaggtggggctgtcccttccggagttgttaaaaacccaatcgaaaaaacccctgttcagttgacctttggaagtataataaaaaaattaggcccctcctttgggaaatggaaaaataaaataggttggtctggggggtataatctcgcaacacacccccataaaagtttccccagagggatgactttgggtatatttggccgagggaaagcccccctctttttttaagaaatattaaatacgcgcccaaaagatataatatgtttttttctcan

SEQ ID NO: 10577 - DNA, 661 bp, Zea mays
  misc_feature: Ceres CLONE 1234121-R
  misc_feature: SWISSPROT Homolog: EC 4.1.1.36 Phosphopantothenoylcysteine decarboxylase
  misc_feature (661)..(661): n is a, c, t, g, unknown, or other
cgattgggtaccgggccccccctcgagttttttttttttttttttttgacaactacaaactgaataatcactaccattactgggcagggagaaagctatctctgtggcagcagcacccaccaactcccacacacacacacaaacaatattgtagcagacaatacagctgcataattgtactcccaccggcaattacaaactgaatagagtcataattactgagcagggaggaagttattgttatcctgtgacaacagcctctcccccccaatttcaatacacacaaacactagatggaaaaaaaatttggtacaacactccacatgcacactgcagataaaacaaattcctaagcttgacaatcaagtggccaaccgctgcatcagctagatggccggttattactgacaggacccgcgagtgaactgctcgcatcgtgcggttgcgtcttgcacgcgagcctcacggcagtatggatctgcgaggtttcggccattgcgccgttcccgtaatcgccacaggccagccttttggtaactggggggatcaaggctatgcccagttggttgattgtgtgaagatgccgctccgtgaatgggttgttccacattaacgtgttcatggctggggcaacaaagagcggtttgctgtagtcccaccn

SEQ ID NO: 10578 - DNA, 854 bp, Zea mays
  misc_feature: Ceres CLONE 1234168-R
  misc_feature (740)..(740): n is a, c, t, g, unknown, or other
  misc_feature (772)..(772): n is a, c, t, g, unknown, or other
cgattgggtaccgggccccccctcgagagacttccgtctcgcccgaggcccccctttttacggcggacacatcaccggctcgcccgaggccttggcttcgctcagaagcaaccctgactaaatcaccacaccgactgaccaagttgcaggagcatttaacgcaaaggtggcctgacacctttatcctgacacgcgcccccccggcagagccgaagtgaccgctgtcactccaccgctccactgaccagtctgacagaaggacagcgccgcctgcgccaccccgactgcggtgccactcgacagagtgagtctgacaggcagtcaggccttgccagaggcgccacggcgaactccgctccgcccgaccccagggctcggactcgggctaagacccggaagacggcgaactccgctccgcccgaccccagggctcggactcgggctaagacccggaagacggcgaactccgctccgcccgaccccagggctcggactcgggctaagacccggaagacggcgaactccgctccgcccgaccccagggctcggactcgggctaagacccggaagacggcgaactccgctccgcccgaccccagggctcggactcgggctaagacccggaagacggcgaactccgctccgcccgaccccagggctcggactcgggctaagacccggaagacgacgaaactccgcctcgcccgaccccagggctcggactccgccctggcctcggncgaacgacctccgcctcgcccgaccccacggntcgggctcggcctcggcaacagaggacagactcaacctcggcttcggaggagcccccacgtcaccctgcctagggcacagac

SEQ ID NO: 10579 - DNA, 859 bp, Zea mays
  misc_feature: Ceres CLONE 1234367-R
  misc_feature: Encodes the peptide sequence at SEQ ID NO. 10580
cgattgggtaccgggccccccctcgagactagttctccttcggcagttgttgggcctgcttcagcagcaggcatttcttctgtagtcagtagaccggaacgctgcattgcttcggagatgggcacagtgtctgaaccttcggcttcgtctccctcacgcacaactttggcagtagatcgtattctcgccatttgattctaagtttgggaagtcaaaaactttttccttttttcttttctccgaagctcttctttctgacgaagcggacgttgagaagcaccttcgttcgattctgagacttaagcttcggctatggtgaaaaattttggcagcgaaacagtgcaaatagcaatgaatgctgtggtaacttcacacccacctgtttgtttatatagtgctgcaggtaggaaggcgaagcggtaactgttacaccaggcgcgcagtaactcatacccgctgtgcagtggaccgcaaagaccaaacagtaactctacaaagtgggcttggcacgcgctcggaagtcggatcgtttctccgcaacgagctcagggaaggtgttttttggaccttcggcttcccgaagctgaagaggttttttttcacgggccaagctcgttacgaagaacgatctagcaccgcgaaaggggctactgttggggtcgtgcttcggtacgccgaaggtctcacacgaagaagcagcttcggccaaagtcgtttctaagagatggccgaaggtcccttttcatggagcttcggcgttttaaaccgacatagaggcagaatgacctttttatacatgtatgtccgagtcaatgttgttaacttccgcaaggggcataatttgtaatcgtcacaggct

SEQ ID NO: 10580 - protein, 36 aa, Zea mays
  misc_feature: Ceres CLONE 1234367-R
MVKNFGSETVQIAMNAVVTSHPPVCLYSAAGRKAKR

SEQ ID NO: 10581 - DNA, 831 bp, Zea mays
  misc_feature: Ceres CLONE 1234391-R
  misc_feature (758)..(758): n is a, c, t, g, unknown, or other
  misc_feature (831)..(831): n is a, c, t, g, unknown, or other
cgagcagcgcggagggatcgcggcgaggcaggcagggtgggctcaggcagcgcggattgggggaactcgtcggaggagaagacggaaatgcgttgggagcgggtgactacgtggcgtgcgttttttattccagtaacatatcacttcggtgaaacctcacggcagtcctaggaaacggtgccttagggcatgtacagtggtgtttaatgtggaggctcttaaggtgttttaacgggtatttgcaaaaaaatcttagagcagtctctccgtgaagagacgcctctggctcgtaaaccaagtagcaacagacgcatcacttcccactgtacaaatttgtcgtctgttctatcgatttgatgctgtacaaatgcatttaattctgtatttattaacagactacatttatagacactccattatataatagagtctcttaggtgtctcttgtacttggagaaccgttttgatgtctctccactatacatgcccttaggagttaggacggagagaccgagagagtactccatacgtcttaaaagaaagttctttcgaatgattgataatatatatgagacatacatacaaactataaataaaactatatttataggttattaataaatgtatattttgtctaagacgaattatattttgacactgaggaagtataattttagaccgaatcaaaattaaattatcttaagtttaattaagatttaaaacaacatcaacccatgacttccggtagatatactatnaaatgtagatttcgtaactaatcttatgatattgattccagaccccgccatctcaattttatagatattctan

SEQ ID NO: 10582 - DNA, 633 bp, Zea mays
  misc_feature: Ceres CLONE 1234536-R
  misc_feature: Encodes the peptide sequence at SEQ ID NO. 10583
cgattgggtacgggccccccctcgaggaagacaacgagcttgatgatccatctacatccgaagctcaacctgtcgcattcaaggcgacggaggaaaagaaggaggaggctacaccaagtcgacaaccaatagacgcctccaagctcgacaatgaggaaatggcgctcgtcatcaagagcttccgccaaatcctcaagcaaaggagggggaaagactacaagtcccgctccaagaaggtttgctacaaatgtggtaagcccggtcactttattgctaaatgtcccatatctagtgacagtgaccgaggcgacgacaagaaggggagaagaaaggagaagaagaagtactacaagaagaagggcggcgatgcccatgtttgtcgggagtgggactccgacgaaagctcaagcgactcctccgacgacgaggacgccgccaacatcgccgtcaccaagggacttctcttccccaacgtcggccacaagtgtctcatggccaaggacggcaaaaagaaggttaaatctaaatcctccactaaatatgaatcctctagtgatgataatgttagtgatgaggaagataatttatgtaccctttttgccaacctcaacatgcaacaaaaggaaaaactta

SEQ ID NO: 10583 - protein, 210 aa, Zea mays
  misc_feature: Ceres CLONE 1234536-R
  misc_feature (78)..(95): Pfam Name: zf-CCHC Pfam Description: Zinc knuckle
IGYGPPLEEDNELDDPSTSEAQPVAFKATEEKKEEATPSRQPIDASKLDNEEMALVIKSFRQILKQRRGKDYKSRSKKVCYKCGKPGHFIAKCPISSDSDRGDDKKGRRKEKKKYYKKKGGDAHVCREWDSDESSSDSSDDEDAANIAVTKGLLFPNVGHKCLMAKDGKKKVKSKSSTKYESSSDDNVSDEEDNLCTLFANLNMQQKEKL

SEQ ID NO: 10584 - DNA, 860 bp, Zea mays
  misc_feature: Ceres CLONE 1234588-R
  misc_feature (28)..(28): n is a, c, t, g, unknown, or other
  misc_feature (831)..(831): n is a, c, t, g, unknown, or other
  misc_feature (839)..(839): n is a, c, t, g, unknown, or other
cgattgggtaccgggccccccctcgagntttttttttttttttttttctttttttttttttttttttttttttttttttttttttttttttttaacgggagcaaaatattctatactctgaaccccctatgtatacaagtataatatcctagtagtttgttgcatacttacactgcttcatcagggattaaaaaattggggattacccataaatataaccctgacaaaatttgggaggcccccaggggatgataatactgacaatatcttcattggcaggatctcattgggtcctttcattttgaacagggagggggcatgcaaaattggggatttcctccaaatcagcaattgacatagcatttgggctaacaaatgcagttgccaaataaccatttctctacccatgtcatgggctcacaaccaaattctccatcagttctgagttaaataccaattattttttgaactcatcaaatgctgaagcaaatgcttccagcaaggaaaaaagtgatgggcgcaaaaaaaaatacagggagggccccacaaaaggtatcagtgcaagcggcaaaagccatgaaccatttttccatcgccttgctgtcatggcgttataaacccaaaatggtgagaaggctgatagcaaagtaaaatcaaggcagggggcatggataaacttgctctccctgaagtatcgaatgaattccttccaatcgtcgccaccagttttgccagcatatatgatcagtccaatgcccagggcaaacactagtcctgcagttaactttgactcgagaaattttaatggccattgtccaatttcatcttcgngcaatggnaggtggaggaggcttacataa

SEQ ID NO: 10585 - DNA, 893 bp, Zea mays
  misc_feature: Ceres CLONE 1234697-R2
gattgggtaccgggccccccctcgagtccgagccctgggtcgggcagagcggagttcaccgtcttcaggggcttagcccgagtctgagccctgggtcgggcggagcggagttcgccgtcttccggggcttagcccgagcccgagccctgggtcgggcggagtggagttcgtcgtcttccggggcttagcccgagtccgagccctgggtcgggcggagcggagttcgccgtcttccggggcttagcccgagtccgtgccctaggtcgggcggagcggagttcgccgtcttccggggcttagcccgagcccgagccctgggtcgggcggagcggagcttcctatggtgcctgcggccgggcctgactgcctgtcagcctcactctgtcaagtggcaccgcagtcggagcggcgcaggcggcgctgtctttctgtcaggccggtcagtggagcggcgaagtgacggcggtcactttggctctgtcggctgggggcgtgcgtcaagataaaggtgccaggccacctttgctttaaatgctcctgtgatttggtcggtcggtgcggcgatttggtcagggttgcttcttgggcaagacagggcctcgggcgagccggaaatatgttcgcccctgggaggggggcctccggcgaaaccgatatccctccggggtccggtgccctttggtccaaggctttgctcggggccaaggcgtggttcgaattcccctcgaatgggaaccgattccccgtgactttaaccggcccccccttttggggccttttggcagctttttttggctggattgggggggtgttcccccggccttgagaaattttaggagggcccttctggagggtgggggcccccttaatttttttggtgttcccccccaaaa

SEQ ID NO: 10586 - DNA, 833 bp, Zea mays
  misc_feature: Ceres CLONE 1234697-R
gggtaccgggccccccctcgagtccgagccctgggtcgggcagagcggagttcaccgtcttcaggggcttagcccgagtctgagccctgggtcgggcggagcggagttcgccgtcttccggggcttagcccgagcccgagccctgggtcgggcggagtggagttcgtcgtcttccggggcttagcccgagtccgagccctgggtcgggcggagcggagttcgccgtcttccggggcttagcccgagtccgtgccctaggtcgggcggagcggagttcgccgtcttccggggcttagcccgagcccgagccctgggtcgggcggagcggagcttcctatggtgcctgcggccgggcctgactgcctgtcagcctcactctgtcaagtggcaccgcagtcggagcggcgcaggcggcgctgtctttctgtcaggccggtcagtggagcggcgaagtgacggcggtcactttggctctgtcggctgggggcgtgcgtcaggataaaggtgccaggccacctttgctttaaatgctcctgtgatttggtcggtcggtgcggcgatttggtcagggttgcttcttggcgaagacaggccctcgggcgagccgggaatatgttcgccgctggaggggggcctcgggcgagacggagatcctccggggtcggctgcccttgtccgaggctaggctcgggcgaggcgtgatcgagtccctcgaatggaccgatccctgacttaaccgcacccatcagggctttgcaggtttatgctgatgggggttaccggctgaggaatatgagccttgaggtaccccctattatgctcccccacaagta

SEQ ID NO: 10587 - DNA, 842 bp, Zea mays
  misc_feature: Ceres CLONE 1234830-R
  misc_feature (842)..(842): n is a, c, t, g, unknown, or other
cgggcccccccgccgtgctcgcggttatgagcggccaagggagctccattgattagagatacttgatcagagatgttcggattacaggtggcgatgagaattatggttttggtattgactatggtaatggtaagtggtattctttccgtttggaaagggtacttttgggttaacaatttgggttaatactaaaatctggctctctctactagtaataataatctgaccaactaaaagcaactgcttgacttacccccacataaagctagtccaccacagccaaacaggacatttgctgagtatgttgatgtgtactcacccttgctctacacaccaaaccccccttccccaggttgtccgtgttgcaaccactgatcaggagaagatgaagccgtggaggaagatttccaggagttccaagattacgatgagttttaggcgtgggtttgcggcaacccccagtcggctgcctgtgaaggccgcgtgtatctacgtttcattttcgcacttttattattgttaaagactatgtggatgtctcacacattatgatgtaattgactattattcccccttttatattattatttgagcactatgtgatgatgtccagttatgtaactgttgtgtatgtgaattgctgatcctagcatgtacatggttcacatttgggtttaccttataaacagggtgtgacataggtggtatccaagccgtgctgactgtaagatcgctaacctagagtaaaatggtcgttctagagatcatagacccctattctcaccttgacttttgtatcccttcaaaagttggtcatatcaaccaaaattatgtttcactan

SEQ ID NO: 10588 - DNA, 841 bp, Zea mays
  misc_feature: Ceres CLONE 1234876-R2
  misc_feature (819)..(819): n is a, c, t, g, unknown, or other
  misc_feature (841)..(841): n is a, c, t, g, unknown, or other
ttgggtaccgggccccccctcgagttagatagggctaagtcttgcttatacgagacttttgggtggtatacttggtaaattgtatcaaccttagctaagttaagtggtaggtttatttttggggttccactaaattctttttaaggtctttagtaagaattgccaagaattcaagttggatttattggagtgaggtttatttttcctttctttttctttattctctttaagtttttggagtgggtttgaactacaagttgccttaataaatttctaaaaattctgtaaaaattacagtggcttattactggtgtataattctttgtctccaaatctggggttcaaaaagtgaatatttttccctagacaaaattaccaaattttagggcagaaggggtgatttgaactacaactaccatttaatagtaggaaattctctataacttatttttgctggcatttagatgctataacatgacttggtacaaatttctagccattaatactcattagttactttactaggattttctaaagtttctagccaaaggggtgctttctactaccactatatttgaaaaatatcaaacaacagatttctgatttttcctagcttcttctttgcgcaagagcaatcattctaaagtttggcatctttttgcttaagggaaggggtggtatgtattaattggattaaatggccattcttataaatattggcaataggtattattttgcacctttccaatgtgtttgtatttttctctggtggcctatctcattattgacctagcaaattttatttgcccattattgcanttatgtgggtactcatgatatn

SEQ ID NO: 10589 - DNA, 686 bp, Zea mays
  misc_feature: Ceres CLONE 1234876-R
tcgagttagatagggctaagtcttgcttatacgagacttttgggtggtatacttggtaaattgtatcaaccttagctaagttaagtggtaggtttatttttggggttccactaaattctttttaaggtctttagtaagaattgccaagaattcaagttggatttattggagtgaggtttatttttcctttctttttctttattctctttaagtttttggagtgggtttgaactacaagttgccttaataaatttctaaaaattctgtaaaaattacagtggcttattactggtgtataattctttgtctccaaatctggggttcaaaaagtgaatatttttccctagacaaaattaccaaattttagggcagaaggggtgatttgaactacaactaccatttaatagtaggaaattctctataacttatttttgctggcatttagatgctataacatgacttggtacaaatttctagccattaatactcattagttactttactaggattttctaaagtttctagccaaaggggtgctttctactaccactatatttgaaaaatatcacacaacagatttctgatttttcctagcttcttctttgcgcaagagcaatcattctaaagtttggcatctttttgcttaagggaaggggtgggatgtattaattggattaaatggccat

SEQ ID NO: 10590 - DNA, 1103 bp, Zea mays
  misc_feature: Ceres CLONE 1234940-R
ttcatatgtgtaccgggccccccctcgagtttttttttttttttttttcttttttttttttttttaacaaccattgatgcattggaagttggggcaaaataccacgaggtggttcaatacattactaacaaacaatgtttcggtcaaaaatactttgccatgtctagtttctagaggtagggaaaaaacacagttgataatctctggctgccacattcatgaacttgaaatgctttatttcttcttgagagggggcgtaccaacctatctccatatccataccaaaatttattttaaaaaatattccttctttttttccgttgatggggaggcgcttttctttgttattaatattaatatcgctcttcccaattatgttttttgaaacaattccgaaaatattgttcaattttataaccccataaccccctctccccttaattaaattatatacatattgggtgccccgtgctcgcgtttaaattcatccctaccttgggccttagattttttaaaatgttcctggcgccctggtcttgctattcttgctgtaccctagacacaatactttccggttatatgactttaccccctcccctatctcatcctactaaaaactaattcccacgtccgattacattcccatacgactctatactataaaaaattcacactctcgcccccctattgtatagagaatgctacatattcggagggctacaattttcttgttgtacgggtcgcatattactctttttgttgtcgtggttcatgtccaactacttactatatactaatacacaaacaccacatctataatacaagagggtaaattatccactctcgcatttttcgcatttatttttgctgcgcccatcttatctttttgtttctctccaactctgcttcttctttttctgggtgtgcgccggcggagcggctgagacctcagccaatcatattatgtgacactcatgtattgaactacctcaccgtactgtgtataccacgtagacgacgtattttgattaatagtctctttatttaatccccaacaccaccacaatggttttcaagtagttttaccacccaccgccacccag

SEQ ID NO: 10591 - DNA, 532 bp, Zea mays
  misc_feature: Ceres CLONE 1234992-R
  misc_feature (204)..(204): n is a, c, t, g, unknown, or other
  misc_feature (303)..(303): n is a, c, t, g, unknown, or other
  misc_feature (310)..(310): n is a, c, t, g, unknown, or other
ccgattgggtaccgggccccccctcgagttttttttttttttttttttagcaaatctctgcttcatttggctgctgttctgtctcagtttacatcacaaatttgggatgcagatcctcaacttattttcgcctttcggtcgtctaaaaagctacctcgacccgactcctcgcctaccaaaaaattaatatggtgatcaccttcngtcccatggggcatggccatagcatctcatcagtatccatagccagagttgtccatcgggtttgcgacaggtgcagcctccggctccttgatatcgacngaccacnacatctgatgtcaggaagggtctgggccacgaacgcggcgttgctccaagcaacatcctcaccccctggttggggttcaaggaaacccggggggcccttccggggcccccccaaaatggggcccccaaaaaaaaaaccccattttttgtaaacccacccaacccctttggggaaggagtttttttttctttttttaaaaaaaaaaaggggaaacccccctcc

SEQ ID NO: 10592 - DNA, 630 bp, Zea mays
  misc_feature: Ceres CLONE 1235087-R
cgattgggtaccgggccccccctcgagttttttttttttttttttttttttttttttttttttttttttttttttttttttttttttttttttgccccacagtaaggatattctctttaaccgaacgaaatggtttctgatcgtgtcgtcatcaaagtctacgtcttcacaggtgttatttctaacttccgagcctgtcccactcagggtgtttcttaaccaatcgtaatgacgtctgatcatgtcgtcacaaacgtctacgtgcaaacaaatgctagtcgttgacaaaattaatacaaaactataccgatacaatgggataccccctggcatcctctcttggcttcgcgggggacaaccctaattgtagctcgacgttttgctcacccaaatgtagcccccaggaactccttggaaatgcccatgaacttggccaccaaagcttccaaaaaaaaaataacctttgatccaaggcgcatcttgggctcctaatgcgcggcccaacgacaaatttcatatttcaaaacagcatctaacttcctcagtaactctgccagcaacttcttcaaaatactttcgggggggatacaattgacgaataattcataaaatttctggcgtacatcaaaa

SEQ ID NO: 10593 - DNA, 662 bp, Zea mays
  misc_feature: Ceres CLONE 1235148-R
  misc_feature: Encodes the peptide sequence at SEQ ID NO. 10594
  misc_feature (38)..(38): n is a, c, t, g, unknown, or other
cgattgggtaccgggccccccctcgagcagaccatggnggagagggagttggaagctgcgcgacggcggctggccgaacggctccgaatcctttggcgaaagcttccagcgctgatgctcatccgtttgtctcctccccttatcggctccataaaaggcatgggcggtaaatcctctggagctttaccctggaaacgtgagtttctttgttctctctttcttccaccatttcagtcgcgattttggatcgattcgatcgttcctggtgttgtgttgagcaagccactggtgattggaagtgggagaaagtggagctgcgctcgtggatttcttgcgccctgttactgtatttcagcgcctgtgcggtgccgttctgctctgattgttgtccaccgtggcctggtgcttgggctccctgctgcgcgatgttcctcttctcgggctggtgcagtggacgtctctcacagcctcagcagcggctctagtatctccgtcaacctcccgccgtgcaagtccggacgtgggcggcggaattggttttctaggacagaaacttgtgttcgctgaactggtcttcccacgtaggcaatctacgtgctgtgagttacccgttgcctctctatatttattttgtgcaatctgctagtattatttacttgggt

SEQ ID NO: 10594 - protein, 135 aa, Zea mays
  misc_feature: Ceres CLONE 1235148-R
MGGKSSGALPWKREFLCSLFLPPFQSRFWIDSIVPGVVLSKPLVIGSGRKWSCARGFLAPCYCISAPVRCRSALIVVHRGLVLGLPAARCSSSRAGAVDVSHSLSSGSSISVNLPPCKSGRGRRNWFSRTETCVR

SEQ ID NO: 10595 - DNA, 732 bp, Zea mays
  misc_feature: Ceres CLONE 1272060-R
  misc_feature: Encodes the peptide sequence at SEQ ID NO. 10596
  misc_feature (460)..(460): n is a, c, t, g, unknown, or other
  misc_feature (466)..(466): n is a, c, t, g, unknown, or other
  misc_feature (467)..(467): n is a, c, t, g, unknown, or other
cgaattgggtaccgggccccccctcgaggtcgacggtatcgataagcttttttttttttttttttcaccaatgcttatttccataacagtcaacgagcaaaccgctgatgcacaagccacaatagcaatagcaaagctgaaacttaaccttcacatcacttattcacatctccgaacgcgacggagcggcgatgaacagataccggtacacagccgaccccaggccccagcctagggcagcaccacacacgacgaacaccaggatatttatcacgcactcggggaagacgaccaaaagacggttacccacgtacagagaagagcattccacgacgaccctgctgacattgacacgcacgcatccgtggatgatttgcttatttacgaggaagtcctgcccgcgccagctgcagtggcagctaccgggctcctgcgacttgctctggaatgccgtgcccgncctgcnncgtcttgtggcccagggtgcgccgcggcttcggccatcctgcgggcgcgctctcgacgtaatccggggggccctggaaacctgcccggccctgtggcctaggcacctaaacaaggaaggtccccaagcctcagcgggccggagggaggaaccccgaaaggccgtccaataaaaagcggggcggacaaaacagggcctaaaaacagaaaccggcggggccggccacccaacccgggaggcccctgcccgggcaaaaggccaagaac

SEQ ID NO: 10596 - protein, 148 aa, Zea mays
  misc_feature: Ceres CLONE 1272060-R
  misc_feature (90)..(90): Xaa is any aa, unknown, or other
  misc_feature (92)..(92): Xaa is any aa, unknown, or other
MNRYRYTADPRPQPRAAPHTTNTRIFITHSGKTTKRRLPTYREEHSTTTLLTLTRTHPWMICLFTRKSCPRQLQWQLPGSCDLLWNAVPXLXRLVAQGAPRLRPSCGRALDVIRGALETCPALWPRHLNKEGPQASAGRREEPRKAVQ

SEQ ID NO: 10597 - DNA, 625 bp, Zea mays
  misc_feature: Ceres CLONE 1272346-R
  misc_feature: Pfam Name: Ribosomal_S25 Pfam Description: S25 ribosomal protein
ccccctcgaggtcgacggtatcgataagcttttttttttttttttttggccaaataccttataattgggaaaccatagtaccctctagttaaaatactctgaatctctcaaatgttgacgtcacctggaactggtccttcgtcagataatgttggcaactcttgtagaaaatggtaactgttatgaagacgacttcctcctgcacagagggcagacaatgcattttacacctcttccccatccttatggattggttgccctggtatacatgtggtggcttgagtggacccagaccatgcgaatgatgccacgcaccatctagtccatgatgggcatcatagccatggagccggtgatcctcataagctcgaagaagatgaaaggagtgtatttgcttgaacttgggcacctcccagagcagcttgtcccacgtatcctggtccaacaggacccttttgtttaccttctcctgtagctttccattgctccacttcgtcttctttagattgcgaccaccggaattggggggcttcgaacaccggcgctgggccttgtccttcttctgcggcatctcgtctgatgaccgtctgcgctgacgacgaaccgaacgcgacgggtctgcgga

SEQ ID NO: 10598 - DNA, 750 bp, Zea mays
  misc_feature: Ceres CLONE 1272765
  misc_feature: Encodes the peptide sequence at SEQ ID NO. 10599
acacatctctcccaggcaaaggcaaaggcaattaataagcaaccattacgcagccacaacagcaacgcagcaagctaagctagagggagtgagtgggagagagagagagagacacatgaggccggaaagagttggaggtgtggcgccgacgacgacggtgctattggctggcggcggcgggcggccgagcctgtggaggacgccgacgccatatctcttcctggggttcgcgacgatgatggtcctcatcgcggtggcgctgctcgcgctcatgtgcgcgcgccgcaaggcctcttcgtcgtcgtcgtcggccaacggcggcgacgagaagccggcgtcggtgcgggtcctggtgccgctcgaccgggagccccccaaggtcgtggtcgtcatggccggcgacgccctgccgtccttcatcgcggtcgccagcgcgaggaagccgctcgccttcgccgccacaccggccgcggccgaggccgaggacttgtaggcgcatatgcaggggcgggcgagaagagaacccgcgcatcgcgagttcgcgacgcgcgcgggggccaattttgtcgagaggtttttgtttgttcttttgctttggagctcggtggcgtagcgtaggtgaacggtgaactgtgagctagggcgcccacgcgccgccaccggccggcagctggttttggtctgtttcgggaaaagcttgcagcttgaataaaacgcgcacggctttcttttaaaaaaaaaaaaaaaaaa

SEQ ID NO: 10599 - protein, 125 aa, Zea mays
  misc_feature: Ceres CLONE 1272765
MRPERVGGVAPTTTVLLAGGGGRPSLWRTPTPYLFLGFATMMVLIAVALLALMCARRKASSSSSSANGGDEKPASVRVLVPLDREPPKVVVVMAGDALPSFIAVASARKPLAFAATPAAAEAEDL

SEQ ID NO: 10600 - DNA, 672 bp, Zea mays
  misc_feature: Ceres CLONE 1273085
  misc_feature: Encodes the peptide sequence at SEQ ID NO. 10601
atcccatcgactacaactcaacgacccgagaactttccagagcactcgccactcgcacatcgagtacaactcaacgatccgagccaagggacgcgtgtgttctcttcctctacgaggccatcatccttcgcgcgaattagccgctcagcgaccgggattcaagattactggctgcagggttgcgatcagatgaggggcgcagcaaggtttctggtgcagcgcgcaacccaaaacaggcaaatcgaacctgtcaatggactagcaaggatgccggcgatcactactcctcagaggcatgggaacgagaatacttccagtgaatctgtcgtcacgaaagacgaaaacgttgagccccttgtcgccttcagcaggccacctcctttgcctccagttctgggtccgctcgttgtgctctcggttttcgagatgtcgtccggcggcggtgatgaagacaccaagtgaggcagcaaatgggcacccatggaaattagctttgtgttgtctgttaagtttgcaccgtcctacccctgtggacataaggttcgcgcgagggggttgatcttccctgagcagctccgaattaggccttgtacagaactacagactacagactaagatgtactgttagctatatcaactaggtggcgtttggataaaaaaaaaaaaaaaaaa

SEQ ID NO: 10601 - protein, 90 aa, Zea mays
  misc_feature: Ceres CLONE 1273085
MRGAARFLVQRATQNRQIEPVNGLARMPAITTPQRHGNENTSSESVVTKDENVEPLVAFSRPPPLPPVLGPLVVLSVFEMSSGGGDEDTK

SEQ ID NO: 10602 - DNA, 824 bp, Zea mays
  misc_feature: Ceres CLONE 1273633-R
aaggcggaacatacttaaaaatccaccccaacacacactctaactcaatacacatggttacgggcccccccctcgaggtcgacggtatcgataagcttttttttttttttttttcccgtttttccggcaggaaatttcatataagataagatgttgccacagcgctatagacccctacgtttgtattcccgatacagcaccggatggtaaaatgttcatagagaagcattcgtcttgacactgggccaacgaaagcagcaacagctgagttcggctttgccattttctttttttgctatgaaatggacggacgcggggcgcagtgagcagctgcgcatcacagcgcgacgcaacacagggcatcatcagtccgccgtccagctctgctccatcgacctcccgaaactttgcggttgtactctcgcttgttctcgctgaaaatgcagccggcttcagagttacccccccccattctggtttgaatcgcaccacactgaccgcattcgaaccaagtatcgcacctacatcaatatatcggactcccactggattctgcaggatatctaaccatatgctttcccctcaccctaatatgttcggcacggacacccccctagaaccaacaaccgcacacagtgcatgcccctgcaatgagatactcctccctaacacccggtaaaccccagccttaaacactaaccttcccatccccaagggggacgatcacttcgggtctccaaaatactgaccagtccattccccacacctcatctcttggtcgcacttatccacttacgaaaggcccacaccacttttatggatcg

SEQ ID NO: 10603 - DNA, 1487 bp, Zea mays
  misc_feature: Ceres CLONE 1274157
  misc_feature: Encodes the peptide sequence at SEQ ID NO. 10604
gacttcgaccacgggccctaccagtttcggagtgccccagtctcccacccccagctccaccaagtcaccgcaccgccgcatctaggtcaccgcctcgccggcgtttcgccatggccggggactggcaggacctgggccaagcggcggccataggcctcctcttcgccttcctgctcgccaagctcatctccaccgtgatcgccttcaaggaggacaacctccgcatcacgcgctcccctccgtcctcgcccacagccgccgccgccgccccagctcccgcgacgcctcccctcccctctcaacacgacgccggaatcggaagcggcagtgacagcgattgggagggcgtggagagcaccgagctggacgaggagttcagcgccgcctccgccttcgtcgcggcctccgccgcctccggcaccagcgtccccgaggaggcgcagctgcgcctctacggcctctacaagatcgccaccgagggaccatgcaccgcgccgcagccgtccgcgctcaagctcaaggcccgtgccaaatggaatgcttggcataagctgggtgctatgcctacggaagaagctatgcaagaatacatcacaattgttcaggagctattccctaactgggatgcaggtacaagtgcgaaaaggaaagatgaagatagcattacttctgcatccgcttcgaaggggcccatgggacctgtgtttagcagtttgatgtatgaggaagacgaaggaaatgattcagaacttggtgacatccatgttttagcgagggaaggagcgactgaggatattgtgaagtttctggcagcgggtgtggaagtcaacatgagagatactgaaggtagaactccgctgcactgggctgttgaccgtggccatcttagtgctgttgaggttcttgcaaaagcaaatgcggacctgaatgccaaggacaacgaagggcaaacggcactccactatgctgctgtttgtgaaagagaagacatcgcagaattgctcgtgaagcatcatgccgaccttcagatcaaggatgaggatgggaacacggcacaggacctgtgccctccgagctggtcttttatgaaccgggcgaactgacaaccaacatgctaccttacattagctgtactctaagctggtaccgcacttggtcaatgtgttttttatttatgggggacatatggtgtgccctgtgtgaagtgccgtgcgtggcgcccgctatgacgattgggaaatcagatgagctgttttattttatccacctcatctaactagttgtcaaaactcaaaagtcgagtggttgaagtgttagtgctgggagatacatgtgttgctttacgtcaatggtctgttactgatagtgaaaaggaactacaatcatacatgttccttgttgtaccttgtttcctttgtatttattggcccgccgtttgtgtgacctaaatgttagatggggttggaggcaaaaaaaaaaaaaaaaaa

SEQ ID NO: 10604 - protein, 330 aa, Zea mays
  misc_feature: Ceres CLONE 1274157
  misc_feature (245)..(277): Pfam Name: Ank Pfam Description: Ankyrin repeat
  misc_feature (278)..(310): Pfam Name: Ank Pfam Description: Ankyrin repeat
  misc_feature (85)..(172): Pfam Name: ACBP Pfam Description: Acyl CoA binding protein
  misc_feature (109)..(178): SWISSPROT Homolog: EC 5.3.3.8 Dodecenoyl-CoA isomerase
  misc_feature (217)..(322): SWISSPROT Homolog: EC 2.4.2.30 NAD(+) ADP-ribosyltransferase
  misc_feature: The sequence is a functional homolog of SEQ ID NO 1840 in the 10/374,780 US patent application
  misc_feature: The sequence is a functional homolog of SEQ ID NO 1846 in the 10/374,780 US patent application
MAGDWQDLGQAAAIGLLFAFLLAKLISTVIAFKEDNLRITRSPPSSPTAAAAAPAPATPPLPSQHDAGIGSGSDSDWEGVESTELDEEFSAASAFVAASAASGTSVPEEAQLRLYGLYKIATEGPCTAPQPSALKLKARAKWNAWHKLGAMPTEEAMQEYITIVQELFPNWDAGTSAKRKDEDSITSASASKGPMGPVFSSLMYEEDEGNDSELGDIHVLAREGATEDIVKFLAAGVEVNMRDTEGRTPLHWAVDRGHLSAVEVLAKANADLNAKDNEGQTALHYAAVCEREDIAELLVKHHADLQIKDEDGNTAQDLCPPSWSFMNRAN

SEQ ID NO: 10605 - DNA, 1071 bp, Zea mays
  misc_feature: Ceres CLONE 1274411-R
  misc_feature (38)..(38): n is a, c, t, g, unknown, or other
  misc_feature (51)..(51): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (1071)..(1071): n is a, c, t, g, unknown, or other
cactattagcattgtatttttactcccctcccacccanaaaacaacgacanccnnnncccttatgtttactcgtattcccctcgaggactttcccatcgataagctttttttttttttttttcccacgcatcgaaatgggtaaggatacatttcaaaggaaaaatgcaaagaatagataggcccagcgggcaacaaccaaaccataccatcacgggtgcaaacgaaacgagaagctgggtacagagacgacttatgatgagggttcaggcacacgattacccctgaaatctaggcgcagcttaccgccccacgcgggacgggaggtttgggtacacatgaaatgacaacggatgttcacgattcaaaaaaagtatgcggcgacagtgcggggtgatcgcttggtgagcggcatcagttgccaccaaacaggcatcccagggaagagccaccgccaagcaacaacgtggaccttgggtcgaaggacgatcccgacaggaaatttcccgaagaatccgaccgttcggccctgtggcaaaaaattggttttggctgggtaaaccccacgcagcaatcctggacctgggcgcccatcaaggctttggcaaccaacactggcctcccccacccaacgtgggagacactctgaccagctaatcagggatgcgaaccaacattaaccagctcgaggtggcccacctgccttggtgttctgcgaggagtggtttaccccgttgtttctctaaaggaaggggttaaccccaacaaccaacctttatgaaccacacccaccccgagcgattattctgcccacacggccccacattatttcgaatgcgtctgcgcaaaccagataatacccaaaggcacgcgcgacctgaggaacactaatgaaagggcccaacccggtgaagcacgtgaaatacccacgggaaattgcacggccagcaactcggacccttctccactttcctgccgcctccacaaatatcaaaatagcctccccgcatatagcacatgtttcaaggaaaagtgacctcccgtgcagaaatccccggaaaccctgggtggan

SEQ ID NO: 10606 - DNA, 934 bp, Zea mays
  misc_feature: Ceres CLONE 1274781-R
accccaaactcctcccctcctttccacatacgccaccccctctccaccaatcaacgaaatgggtaccgggccccccctcgaggtcgactccatcgataagcttttttttttttttttttggctggttcagtttaccactactatcatcgccattctgagatccatccatgaaattacagagcacagcatacaaaatgatgcatgaagatagacagacacacacacagttttcttcttcttcttctggattactactacttcttggagcagctgactactaaggaggggtattatttatactactactatcatatactgactgactgactgacttaattaaggctggctagagctaaaacaaccctagatttttctttcctttcttctgatgctgttgttgttggtgtccctgctcctctctcgggatcacttctattatttgttagagccttttaccttccattcactcacttcatggggtgctcatggcttcgtctgcttaagaggaaaggagacccctgttttctgcttaatattcacagcccgatggcaccatggccaggagagaacctgggcacttgtaagaagcaggatttgtaaggcggcagctcaagggcagttggtgtaaacagagaccaggccacccgatgagggctgcccgttgctgttcaatgaatgctgccaccgagggctggttctgcagaagcaaaagaaaccccagcctcctttgtcattgtgggaaatgcaaaggggctattcagcaggttgtgctcctccaaccccgctttcttggaaaccattaacactggccccctattgctccaggaagaccaggttccctcttttcatcttcccccggagttgaaccccctggtttggtacttgcggtagaccctccctcctccctgctttgccttcagcggcaaatgggagg

SEQ ID NO: 10607 - DNA, 844 bp, Zea mays
  misc_feature: Ceres CLONE 1274924-R
cgattggtgactggtattcccctcgaggtcgacggtatcgataagcttttttttttttttttttgaccagaaaatacacctccattaaaatatacatttttacataatacattattaggacctagttaatttaatctcacagggaacgtaccacttctgcagataagtgaaaacaagtaaacatctagtacatacaggcatgcgcctggacaaatccaaatgtttacaaaatgtatctaggaattcagcatcaatcagcaaacatgaccagtaagcaactgccaaattccaaaagcagcaacgtacatacaagcatggagaaccttgccttgcaaattatccattgcataaagcttatttgttattctccttgatctcttgcgcgaccatgtaatccttcttcatatcttcaattattgcatcatccgtactgtatggtccaccttgccgcgcttcggcaaactcatccatggaggacagccgctcatggttcagccgctggtggcttctgagaaaacctaagccggcgtccccgcacagagggtgccctcgccgccgcggcccagctgggtatcggcgatgctcatgaaatcccgcgactccacggggaatgcatcagggatcggctctaacgtccgaaacatggatcctgcaaaaaggttcgtggtgaggcaaatggactcaaatccaaagaataagatgcgaacctaaacacgaccatgacctccggggcataagaagaagagatgcacccggtggcatctcaagatcaaaggagcacatctcctcggagagcaaaccctggcgccgtcaaggttggggaaaaaagaccccaccgaagagc

SEQ ID NO: 10608 - DNA, 1010 bp, Zea mays
  misc_feature: Ceres CLONE 1275117-R
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (35)..(35): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (42)..(42): n is a, c, t, g, unknown, or other
  misc_feature (43)..(43): n is a, c, t, g, unknown, or other
cggggnnnnnnnnnnnnnnnnnnnnnnaannnnanaannnannaaaacattccttgcgattataaattacggttatcgatctcctgaagttcctcaaccatgatatggatagaagcagagaagaacctgacggggtggtatataaggagcgcagcacaatagcgagatggtcattacatgaggtttgaggagagtttgaggcactcgctctggcacctcttgaggcagacgtcgttccaattgggcacctggtgctggttgacgcagacggtgcgcgcgcaagcgtcggcgcaggcgtcgagttcagagacgccgcagacggtgacgcaggtctccggtatggggtccttggagaaggcccctaccttcttgagcatacgcttggaggtgcacacgcgctcgcagacgaatacctcgtcggagctcttctcccgcccgcgcgccgccttgaggcgctgctcctcgtcgcggcggcgcttgatgcggacaaactgacccgccaccagcgccgggatcgccgcgcccagcagaggccaccacgcgtccaccatcgcctcgcgagtctgcgggaaaatcggtgctgcacgatcagatttgatcgaaattcccaggggccacagggaaattgtgaggcaaggcgaagaaagaggcggagaattacctttcgattaggatgttccagggtaatggtctcgcgcgaattcctgcagccccggggatcccactacttctagagccggccgccaccgcggagggagctccagccttttgctcccttaatgaagaggtaatagcccgcttgcgcgaccccatggccataaactgtttccctgtgcgaaaattgttaatccgctcccaaattccactaaacataacgaacccggaaacaataaagtgtacaggcctggggtgccctaatgcgtggagcctaactcccatatatttggggttgccgctcactgccccgcttttccagttcggagaaaactgttccttgcccaacttgtatt

SEQ ID NO: 10609 - DNA, 1096 bp, Zea mays
  misc_feature: Ceres CLONE 1275120-R
aaatcatcacaacatacactcctcccctataataagtaaattgcagattcaattgagtaccgggcccccctcgaggtcgatttctccataagcttttttttttttttttttgcccaacgaaatcaacgtcttcgatgaacactaaccaaagagcgccgacccgaaggtcggccagcacaggtgcatataggcgaagcatgtccaaccacctcactatggcgaatggcaacgatggtacgacgacgatatacatacactacaatacaatacgatgatcctagatggatcagggatacacacgacgaccaacaacatatccaagggaacaatggtgcccaggaacgcctttcttgagacgccagtcgggtgtatcaaaaggaaagcgttcgtaaagccattgcgcacttctgcgtccatctgccgaccgtagaactcgtactttctgccgggcccgtcttgtacatgaggcgctatctcccggcacaaatacggtcagtcctggtttgaatacgcgccctctcgccactatatgctagagaacgtaccttagaaaaattgtcaaaacacagggctcccactggactctttatcacaaatggtacaaggcactatacccttaacatttggcttgttgacttttacggatggtaatcaaccttttatgtttttgcaaaataaaaccctttcgcaagggcctccatatggggtttaatctttgtccacgcccacaatgatattcgtggccaccttataaaaaaacctaccctcccccgcatcacgcgagacttgttcttgcggtgcgttcccccctaacatatgttctgctatggctcaacagtaaaaattattttcttttttcctcataatgatatccgtccaatggcacccaatcgttatggagtggtcaccctactcttgacgggttcttttactctttctctctacatgatcgcttctttattaccgcctcttaagtatatatcctcttttaatacaggtcaggtccgcgaactcataggtctaattgtaacatcatcgatttattcccctcattaagaacttccctagtcaaatgctctcctcagtctaatttccc

SEQ ID NO: 10610 - DNA, 745 bp, Zea mays
  misc_feature: Ceres CLONE 1275802-R
  misc_feature (1)..(1): n is a, c, t, g, unknown, or other
  misc_feature (374)..(374): n is a, c, t, g, unknown, or other
  misc_feature (533)..(533): n is a, c, t, g, unknown, or other
  misc_feature (610)..(610): n is a, c, t, g, unknown, or other
  misc_feature (633)..(633): n is a, c, t, g, unknown, or other
  misc_feature (663)..(663): n is a, c, t, g, unknown, or other
  misc_feature (669)..(669): n is a, c, t, g, unknown, or other
ncgattgggtaccgggccccccctcgaggtcgacggtatcgataagcttttttttttttttttttcgagataatctcaacataaatattgattatttctgggacacacatgccgggatgatggcaccattatcgaggacgtctcacatgtcatctaaaagatggcacctcctacgatgggtagctgcctcaacgagacgggattcatcacagagaaccggttgtatcggcaggaattgttgctgttgtagaatggcagcgagcaatgcgtgagccactgccaatggattaagtgactgttgtcgctgctgtaggcacccatcagagttctacatattaagatggttgaatggaatcctctgttcgacctaggcnacaggatttgccacatctatttcagttatagctggtacaatctggtgcaacgattcttgttgtgggcatgtacgtgcatatgtcacagggagcgtctaaatgaaatcagttgttgctcgtgtatgtagggaccccggttaccaatgcctagttgactangcgctgctagacactggtggccgtggtacgtgttgctggattgcacctacccttgctagaccagggggctgaatgcnaaccactgctgttgcaggaggcnaaatggtttcacatggtaggttgggtaaangatggnggaaactgtgattgatgtagctttccaagggttggaattgttccaatggccagggtttgtgtttcgatttgggcaa

SEQ ID NO: 10611 - DNA, 1063 bp, Zea mays
  misc_feature: Ceres CLONE 1275892-R
  misc_feature: Pfam Name: Na_sulph_symp Pfam Description: Sodium:sulfate symporter transmembrane region
aacgctctacaccccctcctattccttcgcatccccacccccaacattcattcaattgtgtacccggccccccctcgagggcgacgttaccgataagcttttttttttttttttttatcgccacccactaaaaacgaatgggttgcattgcgatcatgtcgacgacaaaactgtggacagcggcatctgtagcaccgcaaattcaggaaatagttttcctccccccactcgacaaaaaaacaacagaaaaacaaaagggatgtcccagttaatgtgctgctctctgctcaccacagcccgattatcttccaccataagccgcccaccccgagccagatgatgatgtttacaacggagatgacaaacccataccccccccactgagccaatgggacatacccggcgccgtacaagacgggagcacagcccatgccgcagtgtgcgcccccgcccatgagggtcgagaggaatgaaaacaccatggcagtgaaaagcgaccgggtgtcccagggccattccccaccgacagcgcacgcggtgaaacattgcctccaatgtgctgcggctcccactggcctaaaaaattgtcgccgcatagaaagtactagcatataccactcacacccgtattgcacagttgcccttgatattgttccaaggacctttcaaacgaattttgcgcaaacaaagtcttcaattgaatccacaacacaaatcagcaccccgaattatgtatgcaaggaccgaccccctcattcggccaatacaagagactggtgaacatcatggtaaacggatgattccctcaccatcactaaaactcctggccaaaagcaatccttcttcaccagtggtacaacccctcctacactatctaccataggccctgcgttacgcctcacaaaaatcgctctgtccgaaaacctcctatcctccactccatttagttcctcccaaaaggatccctaaggtccaaaccgttctattcatcacgggtcgaccgacacaggaaatgcccactcctccctgcatcaggagcatccaccctcggtgcccgacctcc

SEQ ID NO: 10612 - DNA, 808 bp, Zea mays
  misc_feature: Ceres CLONE 1275964-R
ttttttttaatataattattaaggaatatgcgaaacgagagatgttaaaaaatgtgtccgggccccccctcgaggtcgacggtatcgataagcttttttttttttttttttgatccttaaatcttatagtgtaaaatttagagcccgatgtcacccctccaataaacaaagccaagttagagcccattgtcacccctccaataaacaaagccaagtttgattttcctaggggcgtcctttcttaggtccaaaagaccagtgaagagaaagggctccgatgcagtagatatgtctagttgaattcattggttgccaacattacggccaccataccctctgcctcgcctctgctgctgctgaacacgtcgatgctggttgaaatgactccagggggaagaatttgcctgctgttgtggtaccgtcctcaagcgttgcgccttcatctgtgcaaagagtgcatccatcgtccttggtgctgcctggttggactccttgaccttgggattctgaaaagcaccacctacaggcctcctctgcactaaagtacttccactttggcttgttccaacggatagcccccttgcgcatttgggataacagcagccttctttcaacacctgctttgtatcagggtacctgattttcacccaagattttgacctttctctgtggaaaaaacaaccctggcctaaaggggtggatcccagaacccccataaaaattttaaaacctttgcccattcccccttttatttagaaaatggcgcctttcacggaaaatggggaaagccttttatttaatactgccg

SEQ ID NO: 10613 - DNA, 765 bp, Zea mays
  misc_feature: Ceres CLONE 1276229-R
  misc_feature: Encodes the peptide sequence at SEQ ID NO. 10614
ttttttttttttttttatcataaacgcaccagccgggggggtaccacaccggccgcttcaatattcaatatccaaaaacacaccatcgtcgtaacttaaaccttccgtctaccctagcacctggctaaaatagacgcgatgctttacggcatttccacgagcacctgacgaacgtaccttccccaagacgaagctcgattcgccagctccccacagcgaaatcccgcctcgctatttccctccctcttctgtgccttcctcgtcgccgtcgccgtcaccgtcgctgtcgccgaacaagttgtcagatgacaagtccagcatgaacccctccacctcggtctcgctgccctccgagttgtcgccctccgcgccctcgccgacaggctccgtgatctccccggcctcgcccgcgtccggatcctctgcctcgccgtcggagctggagtacccgtcgggcctcgcgattgggatgcgccgcgcccatgcgagtgtagctgtagccccgcgcgccacacaaagtgcgggagcggcggcacccacacgacgcgtggtggtcggaagttgggcctgcaaatggtgggcgcccgagatgagcgggccggaaacctccatcgggcctaacgggtcggagggtggacggaaaccaacgccggacggggcgggcccattggaacgttaaccccgcaagtgggccgggggcgcgccgcgaaacaattggccccccccgcgccacgaacttgcggcggggcaaaaaacaccctgaat

SEQ ID NO: 10614 - protein, 119 aa, Zea mays
  misc_feature: Ceres CLONE 1276229-R
MNPSTSVSLPSELSPSAPSPTGSVISPASPASGSSASPSELEYPSGLAIGMRRAHASVAVAPRATQSAGAAAPTRRVVVGSWACKWWAPEMSGPETSIGPNGSEGGRKPTPDGAGPLER

SEQ ID NO: 10615 - DNA, 556 bp, Zea mays
  misc_feature: Ceres CLONE 1276281-R
  misc_feature: Pfam Name: Extensin_2 Pfam Description: Extensin-like region
  misc_feature (153)..(153): n is a, c, t, g, unknown, or other
  misc_feature (154)..(154): n is a, c, t, g, unknown, or other
  misc_feature (346)..(346): n is a, c, t, g, unknown, or other
  misc_feature (487)..(487): n is a, c, t, g, unknown, or other
  misc_feature (520)..(520): n is a, c, t, g, unknown, or other
  misc_feature (521)..(521): n is a, c, t, g, unknown, or other
  misc_feature (526)..(526): n is a, c, t, g, unknown, or other
ctctcattttgtttttctggaaacctgtcggtatgagggcaccattgtcgagtactctcatatgtaatctaagagatggcacctccaacgatgggttgctgcaaggcagggttcattctcagaagggaaccccttttgggggggggggttttnntttgtatggcagcaattgcttgttggctttggcttggccaggggaaaaagggttttaggcggggaaccccaaatttgggggggttttggcccccccttttttgccccaaatgtggggggtttttttaaggtttaaacctttgggttgtgtggccccccctctgttttttttttaagggtttttccccccccnaccaaaagattttttttttttaccccccccggggggcccccccatttttttgtgggggggtttttttcccaatttgggggggggaccccccccccctgtgggggggtgtggacaaatgtgtgggggggggccgcgctcctnacggggggtttttttttttccccccccaccacnnccccncattcaccccctttttgggaaaaaaaaaaa

SEQ ID NO: 10616 - DNA, 640 bp, Zea mays
  misc_feature: Ceres CLONE 1277298-R
  misc_feature (640)..(640): n is a, c, t, g, unknown, or other
ttgttttgaactatactctaagattctaaaagagggcacgaccaatgatgggttgttggaagaatgctgctgggtttgtccattgagctgcttgacatgtcccaattgttgcaattgtaataggtcgccatcgataagcgcatcgtgctggtaaaacgccaaccactgtgggtgtgtcactaaggtaccacggatcgctccacctagctggctgaatgttactagttgttgctgctgtctataaacaggagagatcaatgctgacagtgtggtgaatggaacacattgctggtggtacggagcttgatagcctgggtgaatgccagttgctcgtctgatggcttaataatcaccaccccctgcttctagttggttgaatgaaagacactgctgtcgctgacagtacccagcaacttttgctagcacaagatgttgcaactgttgtgccctgatgctttgtgccaataaatgctccacaggtaactgctcgcatatggctgatgattgctggacctacttcgctgataagggaaacatgcccgctgccactgcctgatgtatcctgaaccattcaagaattgtcttctcgcataccgaagacaccgatggagaaacctacgcgggaatatgggaacctctn

SEQ ID NO: 10617 - DNA, 677 bp, Zea mays
  misc_feature: Ceres CLONE 1277852-R
  misc_feature (258)..(258): n is a, c, t, g, unknown, or other
caattgggtaccgggccccccctcgaggtcgacggtatcgataagcttttttttttttttttttgaaagcagtgaaagcactacccctgtggccctgtataacacaaggtcacaaaggtaatcaaatatagccatctagtacgtgttttatctaaatttgctgtcctatagctacagtatacaaagagatatcagtataccgtgattcgtgtgcccatatatattgatctatacatttcccctaggaacaacccagcnactagccctggagctcgttccatcctatgaacaaacagctcaagcttcagcagtttgcatttcaaaaattggagcccaggcgcaaccgaaagttgaggcaataggcccaatgccaggggaaatttgtctttcccgtttcaaaagttcccccccggggtttataaaatttttgcctaaaaaaaacatgcccgtggaaaaccccttttcaaaaaaacaaaatggggggccggggggggggaacacccttgtcggggaagggtcccccccttgggttaatttttgggggaaaaacccccccccaaagtgtgaccccctcgggcccaaaaatatttcccccccgttggggaacttttttccccccaccccccccccaaataaaaccccttttttaccccccccgggggggagggggggggggg

SEQ ID NO: 10618 - DNA, 977 bp, Zea mays
  misc_feature: Ceres CLONE 1278266
  misc_feature: Encodes the peptide sequence at SEQ ID NO. 10619
atcacaaggcgtgtcatctcatcccaagttcgggacaccaccggcagcaaaccaatcaagaaggcagaagcctagctgtgccgcgtgcccccacgtccagcggtcgagcaccaaccaccaccaccacctccgacgacgacgacgacgacatcgtcatgggcaacagcttgcggtgctgcctggcctgcatggtcccgtgcggcgccctcgacgtggtccgcatcgtgcacctcagcgggcacgtcgaggagttcagctgcccggtggccgcggccgccgtgctcgccgcgaaccccaaccacacgctcaccacggcgtggtccccctccggcgcgccggggtgcggctccaggaagctcgtcatcgtgtcgcgcgactccgacctcaggcgcggccgcatctacttcctcatcccgtccgcgacgctgccggccgaccggaggggcaagaagcagagcagcagcagcaagcggccggcccgccgccacctgcgcggcaggaagagcgccggcgaagacacggcggagcaggacgcctacctgggggacctgctgctctccgagaaggccgcgtcgagcggcggcggccaccggcggcgccggagcggcgcccgcgtcggcgtgtggcggccccagctcgacagcatcgtggaggaggcctcggactagatccaccgctccaattaatacctccatctctcctctttgggctccgcttacttattatattctttggttttctttctcatctgccgatgcgaataccgcgatcgaccgaggacgaggcgccggccggctctcgcctctcgatccccctcgacgctgtattgcgtgatgtccagggttgagcggcgttttagttcgggagatgaggggggaaattgtgacaaaataactgcacgcgatgtagcagccccaacctgtacagaaacatttggttgagttcatctagctaaaattccaaaaaaaaaaaaaaaa

SEQ ID NO: 10619 - protein, 170 aa, Zea mays
  misc_feature: Ceres CLONE 1278266
MGNSLRCCLACMVPCGALDVVRIVHLSGHVEEFSCPVAAAAVLAANPNHTLTTAWSPSGAPGCGSRKLVIVSRDSDLRRGRIYFLIPSATLPADRRGKKQSSSSKRPARRHLRGRKSAGEDTAEQDAYLGDLLLSEKAASSGGGHRRRRSGARVGVWRPQLDSIVEEASD

SEQ ID NO: 10620 - DNA, 700 bp, Zea mays
  misc_feature: Ceres CLONE 1278423-R
cgggccccccctcgaggtcgacggtatcgataagcttttttttttttttttttaaagcacggactgcactcacatgttatttcctgtcagagaagaagttcttgaacaagtaaagtcctttgcggaactccaaagccgcggtacaagtagaatctactgaacaacaatcctgcaagggatgtgttgttcttcagaacggaaatcatacacacactgggtcatcgtttattccattattcttatagtcacttgctagaccggcaagaacacgatgcaatgcaaacccaatccccagctatttctagatttaaggtttaggagtcgcagccgcagcatcacatgtgagtgaataatagcgtgacgatcaagcgtcagctttgcctggggtgatctctggcgccgccggaacagcaacaggaagcgcttcttgccgcggtgccgggagctgcttcgggttcagaagcgccccaaccttccggggccctggcttcccccttccagaaggagggcctcttccccgacttgaaaaccgtcggaaaaaatccttcgggttgaaaattccctttaatggcacccttggcccctgaaggctttttcaaagggttcaaccccctcccccttgggaaaaaacttttttaaacccccccgggaaaccttttatgtaaaaaaaaccctttgggaaaaaattttacagggggcc

SEQ ID NO: 10621 - DNA, 826 bp, Zea mays
  misc_feature: Ceres CLONE 1278663-R
  misc_feature (1)..(1): n is a, c, t, g, unknown, or other
  misc_feature (495)..(495): n is a, c, t, g, unknown, or other
nttcgttttgacgaggaatatatacacccttcttattcgacccgcacggtacgaggagcagtatcattaccctgcgtcacctcatcactcgtcgtcgagcgcgttgcagaagcgcctgccgtgggcggtgagcaggccgcactcggccgcggcgacgagggcgggggcgaagcgggcctgcgcgacccggcacctctgctgggcccccggctccgcgcccacgacgaggggcgtctccatcatcacccgcagcgcccggcaccggcactccgccgggatgtcccgcagctggctgcagcacgtctccttgaggacggcccggttcgggagcatggcctcgatcacgtcgcagctccggctcgcaacgtaccaggtgcagccggacagcgggcggtacgggatggcctgccccggcgcgcagtagctcggggcttccgcggcgccgcaggccacggcgagcagggcggccgccgccgagaggacgagacggctggntggtggtgcagcacgccattctttcttggcgttactgctagtgtctagtgtgctactggatttcttcttggtccagcccagccgtctgatgggatttttccattaggaagttctaaggaaaggtctcgtgcaaattccctgcagcccgggggatccccttgtttctagaacgggccccccccgccggtggaagctccacctttttggtcccctttaggggggggtaaattgcgccgccttgggggtaatcagggggccaagccgggtttccccgggggggaaaattgtttttcccgctctacaaatttcccacacaaacattcgaaaaccg

SEQ ID NO: 10622 - DNA, 915 bp, Zea mays
  misc_feature: Ceres CLONE 1278663-R2
  misc_feature (446)..(446): n is a, c, t, g, unknown, or other
taccgggcccgccctcgaggtcgagggtatcgataagcttttttttgtgttttttgtggaatcgtaatagatcagtatagacagaggaataatatacacccttcttattcgaccacgcacggtacgaggagcagtatcattaccctgcgtcacctcatcactcgtcgtcgagcgcgttgcagaagcgcctgccgtgggcggtgagcaggccgcactcggccgcggcgacgagggcgggggcgaagcgggcctgcgcgacccggcacctctgctgggcccccggctccgcgcccacgacgaggggcgtctccatcatcacccgcagcgcccggcaccggcactccgccgggatgtcccgcagctggctgcagcacgtctccttgaggacggcccggttcccgagcatggcctcgatcacgtcgcagctccggctcgcaacgtaccangtgcagccggacagcgggcggtacgggatggcctgccccggcgcgcagtagctcggggctttcgcggcgccgcaggccacggcgagcagggcggccgccgcccagaagacgagacggctggtggtgggtgcacacgccattctttcttggggttactgctagtggccagtgggctactggattttcttcttgggccaagcccagccgtctgaggggatttttccgattaggaatgtctagggtaatgggcttctgggaaattcctgcagccccgggggaacccactaagttcttgaaggggccgccccccgccgggggggacttccaacctttttgttccccttctagggaggagggtaatttgccccgcctttgggggtgaaatacggggcccaaaggcgtgttttcccggtggggaaaaatattgtttcacgcgtctccaaatttccccccgcagcattatctgggt

SEQ ID NO: 10623 - DNA, 1251 bp, Zea mays
  misc_feature: Ceres CLONE 1278726
  misc_feature: Encodes the peptide sequence at SEQ ID NO. 10624
atttcgctctcctccctaggcaactaaacgccgcgctcccgcagacggtaccagccgccgcgatggggtcctcgtcctcgccaccgccaccaccgccgctgccactgcccatgattgggcgggccgggaacctcaccatcttcatcacgccgccatcccccgctagcacgccccggggcgctgggcgcacgccgccgctcgagtccccgcgctcggatatctccacacccatcccgcagagggcagccccgtcgccctccctttctccctctccgcggaaccacgagagccgggccgtggcgcctgcggtggtgttcaccccgcccccgccgcctgcttctgtgaatgtcgcgctgccgccggtgcaggtgccgccgccgcagtacgagaaggcgtccgcggggggcaagcatgacgtatcggcgttcggcttcttctgggacgccgtcgcgcgcgtccaggaagcgcacgcgagcctcgacgagtacgtgtctacctggttcgggttggatcagtccaagtaccagtgggcgcttaacgactactacgagaccataggcaaggtcagcaaggaagtggattgtataaaaggtggtatgcccaaggagcctactactaaagtgcagaaactctaaaaaaacaacttcgttttgtgttgtaagatgagtagctagcagcgtatgtatggagaagtatgttacatttttgtggagccttgaattgaaaggtggtcatctctgctttgtcggcggcccaagtgtaagccctgcaccgagcgccattcatctgggacttctggaggccgggccgcgaacggtcgctgttttgttccgccgttcaggatctactgtaatcctctaaggttatgtcaaagcacagaatcagtctaatctgcatgttgggcgttgtttactatcacgcccttgtgttttcatggctacattagctacgaccataacgtgatgtgcagacgatgttacgaacggcgtaaaaatctcaatcatcaactatccgccggacctggcccagggttgtaaatcggaggcgttccctttgaggtcgtaaaagccgaagcgttcatgaattacgattgtacactgcgttccgaccggccttagcatatgctgaattgcgtggactaaaacagcagaaatccagcgtcggtgttagtgcattgcatgtagccacgtactagtctgcatctaggtctattcatgtttggttgtcccagaactaaaaaaaaaaaaaaaa

SEQ ID NO: 10624 - protein, 190 aa, Zea mays
  misc_feature: Ceres CLONE 1278726
MGSSSSPPPPPPLPLPMIGRAGNLTIFITPPSPASTPRGAGRTPPLESPRSDISTPIPQRAAPSPSLSPSPRNHESRAVAPAVVFTPPPPPASVNVALPPVQVPPPQYEKASAGGKHDVSAFGFFWDAVARVQEAHASLDEYVSTWFGLDQSKYQWALNDYYETIGKVSKEVDCIKGGMPKEPTTKVQKL

SEQ ID NO: 10625 - DNA, 832 bp, Zea mays
  misc_feature: Ceres CLONE 1278936
  misc_feature: Encodes the peptide sequence at SEQ ID NO. 10626
gactagggttctgtcgaacttccacgcattcctactactcctggctcccgcgacctgacgccgccactcctgacttcgccatccggcgatcaccagagacctagctccggcgtctctagcgatccccaaaacccactccgccgcatttctgccgacttggccggattggtcgcttattgagatgactacgccacttatagcaggacttgcagttgcagcaactgctcttgctggtcgatatggcgtccaagcttggcaagcttataaggcaaggcctatagttccaaggatgcgcaaattctatgaaggtggctttcaacctacaatgaaccgaagggaagctgcattaatccttggtgtcagggaaactgccaacgcagagaaggtaaaagaagcgcacaagagggttatgatcgccaaccatccagatgctggtggaagtcattaccttgcgtcaaagattaatgaggcgaaggatgtgttgtcagggaaaacaaaaggaggtgggtcggccttctgattgtagaattaagcatgcactctctgctagaaggataattttgtgcctctaaatttagcattagaagatactgtagaccgcagtttagtcttggtattgcgaaaatttctggacaaagcatattgggccttctgtgaagtagttatccagtgcttattaatactctcagctgtgcctgcttctataaagatatactccctccgtttatttttagttgtcgctggatagttcaattttgcactatccagcgacaactaaaacgaaacggagggagtacatgatgaaggttacatcaaaaaaaaaaaaaaaaaa

SEQ ID NO: 10626 - protein, 112 aa, Zea mays
  misc_feature: Ceres CLONE 1278936
  misc_feature (53)..(113): Pfam Name: DnaJ Pfam Description: DnaJ domain
MTTPLIAGLAVAATALAGRYGVQAWQAYKARPIVPRMRKFYEGGFQPTMNRREAALILGVRETANAEKVKEAHKRVMIANHPDAGGSHYLASKINEAKDVLSGKTKGGGSAF

SEQ ID NO: 10627 - DNA, 726 bp, Zea mays
  misc_feature: Ceres CLONE 1279191-R
  misc_feature: Encodes the peptide sequence at SEQ ID NO. 10628
  misc_feature (726)..(726): n is a, c, t, g, unknown, or other
caattgggtaccgggccccccctcgaggtcgacggtatcgataagcttttttttttttttttttcaactcctcatcagctgcattggccttttccttatctgtcaactgtcgagacatttcgtgaggtgtacgatgttctctacctgggcatcattgacatatttgcaatagtacaatatgacaaagaaaatcgatcgtgaattccatgcaatatgactcggactcgatctctgttgtggacccccagttctactcggagcgtttcttgaagttcattcgggccgtcttccctgagaattcatagctcatcaaccaatacttgcttcaaagatgcccacctgctgccgttttgttacccacgctggccaagcaggtgaaacctcatccacacgacagttcatgtcttcaaaactttttggtcgagaagatccgactttccccctgtcaaactcagtcacactcaaaataaacaagcttgcattccgatgtcccccacacccatattcctgaaaaatacagggttgggtccttcttgtttataaatttcttagaacttacttttcagaattctgggccttattccacctcaagaaactttgtataaaaacaccccccaaaaccctctaaaataaaaaccaccggtcttggctaactaattaaattccccaattccccttcccaaatttgaaaaaagctcctccttcaaagggccgacaaaatcccan

SEQ ID NO: 10628 - protein, 32 aa, Zea mays
  misc_feature: Ceres CLONE 1279191-R
  misc_feature: SWISSPROT Homolog: EC 2.7.1.68 1-phosphatidylinositol-4-phosphate 5-kinase
MQYDSDSISVVDPQFYSERFLKFIRAVFPENS

SEQ ID NO: 10629 - DNA, 611 bp, Zea mays
  misc_feature: Ceres CLONE 1279273-R
  misc_feature (112)..(112): n is a, c, t, g, unknown, or other
caattgggtaccgggccccccctcgaggtcgacggtatcgataagcttttttttttttttttttaataaaaggacgaaatcaaataattaatacacgtcatgggtacaactngagttgaagtttctggacagccatctggcgaaagcaaataatttattcccccggcccacaagagaatgagaattgacaacgagacatgaacaaaattaaaagaacccagttaacggcggccggcgcacccagagatgaaatttgagtagcacgcaacaatacgtagggggcaggacagggagggcacttgtttggtcacaaactcacacctcgacgctgcatcctgtgggctgggcgaacttgagcgacgtcacggtgttgttgacgccggggtagcccgcggagagcacgggcggggcacctgaccaaaaaggtgggaactgccggaaaacccaactgccgaaccttcactttgacgcggccgtccactttgacctggaagggcacgagacccccggggaaattcctgctttatggcttcgggaacttggggggaaccgggacggaactcggccaaaaaccggggggaccaaaaagggaaaaaccggggggccctggg

SEQ ID NO: 10630 - DNA, 716 bp, Zea mays
  misc_feature: Ceres CLONE 1279379-R
cgtttggtgactggtattccccctcgagttttttttttttttttttttctttttttttttttttttttttttttttttttttttttttttttttttttttttttttttttttttttttttgccccttaacatacccctcaatataaaaatctttccatatccccctacatatcggggcaaaccgggtaaatatccctttctaactacaatacaactctacgagaggggaaacgggggaaaacaacgctaaaaatcggaagccatgttttcttttccccctccttcgtccaggtcgttattttcatccagtttttcccactcaaaaaaaaaagggccgttgccccctgaattatccttgggggcattcatctctatgagggggatcatcttctcccaaatcgacgactgaacaactcccccaaaaacgttttgttcggatcctaccccaaaaagcgcaaaggattccccttggaactcttcatcgggggatgacaaaatcacccccgcgattgattccccaagggcaggaacgttttcacgaaccctctgggcatgggaactaaaaaaatcccctggatgatctgctttcaagggagttaaagcaaacttgagggccttcctcaaaagggatctatcctggggagaaccctgccgtttttggataacacattcgggggaaggttgaatgggaatatcaatacgagcaaatggcttgt

SEQ ID NO: 10631 - DNA, 768 bp, Zea mays
  misc_feature: Ceres CLONE 1279407
  misc_feature: Encodes the peptide sequence at SEQ ID NO. 10632
atctaccggagatagaaagttagatccgtgttccgtgtccgcgtccagtgtgtccgctccccctcagtcctagcggtagcgtgcgcgcgggagacgtagatggcggcttcggcggcggcggcggcggcggcggcgacaccggtggcgccgacagaggggacggtgatcgcgatccacagcctggaggagtggagcatccagatcgaggaggccaacagcgccaagaagctggtggtgattgacttcactgcaacatggtgtcctccgtgccgcgccatggctccaatttttgctgatatggccaagaagtccccaaatgttgttttcctgaaagttgatgtcgatgaaatgaagaccattgctgagcaattcagcgtagaggccatgccaacattcctgttcatgagggagggcgacgtcaaggacagggtcgttggcgcagcaaaggaagagctagcaaggaagcttgaactacacatggcctcgtagatcagtgatgccgtaatgtagtattcgcctaaataagaggacgcctcgcctcaactctgagaaaactagtgcttctgtgatggtaattcgtatgagagagtgccccctttggtggtacttcttcgtatgtagtattaactcctgtcttaatatgttgccctgcttgtgcttttcataccatgtttgctctttcagctgaggtgttatacggtaaatcggagtcaatatctttgaaattgattaactgtagtctagttttttaaaaaaaaaaaaaaaaaa

SEQ ID NO: 10632 - protein, 129 aa, Zea mays
  misc_feature: Ceres CLONE 1279407
  misc_feature (22)..(126): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
MAASAAAAAAAATPVAPTEGTVIAIHSLEEWSIQIEEANSAKKLVVIDFTATWCPPCRAMAPIFADMAKKSPNVVFLKVDVDEMKTIAEQFSVEAMPTFLFMREGDVKDRVVGAAKEELARKLELHMAS

SEQ ID NO: 10633 - DNA, 920 bp, Zea mays
  misc_feature: Ceres CLONE 1279735-R
  misc_feature (8)..(8): n is a, c, t, g, unknown, or other
  misc_feature (9)..(9): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (29)..(29): n is a, c, t, g, unknown, or other
  misc_feature (30)..(30): n is a, c, t, g, unknown, or other
  misc_feature (37)..(37): n is a, c, t, g, unknown, or other
  misc_feature (886)..(886): n is a, c, t, g, unknown, or other
aacaattnngaatnnnnnnnnnaccaacnncccactnatacccacaccccccaccctatctgtacttctttttgctgacttccaacatttcattcacacactttattattgaactataactcttaataaatctaaaagggggctccaccaatgtatgggttgttggtagaacattgctgggtttgtcaaaaaaagctgattaaatgccacaaattgttgcagctgtaatagggtgccagcgttagcgtcccaacgatgctgatagaacgttaacaactgtggttgagtcataaaggtaacacgcctcacaccatatagctgtctgaatgcaactatttgttgctgctgcaaataatgaggagagttcaatgctgctacttgcctcaatggaagaaattgctgcttgtaggcagcaggtagctggcatgaatgttagttgtctgttcttgcaaataagaagcagagttcaatgaacctagttgcttgaatgcaagaaactgctgttgctgatagaaggcagaaaggtttgcataaataagttcgtgtgtagatcttgagccctgatgttttgtgcctaatagaatgcacccaaggtaactgttgtaataggtctgatgattgttgcaggaacaagggtgataaagctaagatgacatcttgcgatttgcctgttggattctgcacgcttgaagaattgtctctttcccatacggaaagaaccccctgcttgaaaggtactggaagatacaacggcaatcttatagggaactttcttacccatttgctgtcaaaatcggtcctccggaacacatccactttgtcaaaaaagtatccaacgcacctataacagcacgccacaaaatatttttggtccttgcccaattgntcgtgcaatcacttattggctgcacctcttctta

SEQ ID NO: 10634 - DNA, 747 bp, Zea mays
  misc_feature: Ceres CLONE 1279800
  misc_feature: Encodes the peptide sequence at SEQ ID NO. 10635
aagaacagctgtcgatccaattgtcacttgctctccctccaacaagctaattaaggccggtcatccctcttctagctcgtttcattatccatggcggaggagaagcaccaccaccaccacctgttccaccacaagaaggacgaggagcagctcgccgccggcgggtacggcgagtccgccgagtacacggaggccacggtgacggaggtggtgtccacgggcgagaacgagtacgacgagtacaagaaggaggagaaggagcacaagcacaagcagcacctcggcgaggccggcgccatcgccgccggcgccttcgcactctacgagaagcacgaggcgaagaaggacccggagcacgcgcaccgccacaagatcgaggaggaggtcgcggcggcggcggccgtcggctccggcggcttcgccttccacgagcaccacgagaagaagaaggaccacaaggaggccgaggaggccggcggcgagaagaagcaccacttcttcggctgattgatcctcccgtatcgtcgtccctccccgtgtgctacgcgtgcgtgtgagagtgatatcgagcgcccgccgtgttgtgcgcgcgtacgtatgtatgcgctcgtgtgatgcacgaataagcgtggctacgtaatctatcgtatgtatacgtgtgtgtatgcatgtgcttgtgtatgatcgtggtacgaggaccgaaaaaatgtatgcaactctgatttacctaaaaaaaaaaaaaaaaaa

SEQ ID NO: 10635 - protein, 138 aa, Zea mays
  misc_feature: Ceres CLONE 1279800
  misc_feature (49)..(128): Pfam Name: ABA_WDS Pfam Description: ABA/WDS induced protein
MAEEKHHHHHLFHHKKDEEQLAAGGYGESAEYTEATVTEVVSTGENEYDEYKKEEKEHKHKQHLGEAGAIAAGAFALYEKHEAKKDPEHAHRHKIEEEVAAAAAVGSGGFAFHEHHEKKKDHKEAEEAGGEKKHHFFG

SEQ ID NO: 10636 - DNA, 656 bp, Zea mays
  misc_feature: Ceres CLONE 1279827-R
  misc_feature: SWISSPROT Homolog: EC 1.14.13.88 Flavonoid 3',5'-hydroxylase
caattgggtaccgggccccccctcgaggtcgacggtatcgataagcttttttttttttttttttatcgtggtgaaaaaggaaattttcactctagagatacaattccttcgacctgtctcgaatgcacataatgtgaatccattacaactcaacaaacgtgcttattattttactacaccccacgcaattattactgccacacgtctaagactcatgcattcttggataggaggcggcggcggcggcacagtaactagctagctgcctagctagacggccctaggaacaaggtagagcggctcgttcctgcgaagcatcagcccgaacgtctcgtccatgctcaccttcccgccaccgtcttccttctcattggggacctcccagtcgaaatggtacatgaggttggcgagcatgatctccatggtcgcgagcgcgaagttggccccggggcagatccggcgcccagacccgaacggcaggtacctgaagtcctggccgctgtagctgttggacttgtcccagccgtcccgcatgaacctctccggcatgaactcctcgggcttctcccagaccgccgggtctctgccgatggcccagccgttcacgaggacgcgcgtgttggcggggatgtggtacccgtcgatctggcagtcgg

SEQ ID NO: 10637 - DNA, 1175 bp, Zea mays
  misc_feature: Ceres CLONE 1279873
  misc_feature: Encodes the peptide sequence at SEQ ID NO. 10638
atcttcgtgtgtggtagtaataagcaagcaccgatggctgttgaatcatggacggtgccgactccagtgaaagatctggccgccctcgtggacgagccgccgagccggttcgtgcagcgggaggagcaccgccctggcagcctgatgctcgcggctgacatgccggatcccctccctatcgtcgacctcaacaagctgtcgaccgccgacgaggcagccaagctccgctcggcgctacagacctgggggctttttctggctaccaaccacggcatagacgcgtctctaatggaggatctgatggaggcgtcacgggagttcttccaccagccgctccaggagaggcagaagtacagcaacctgagggaaggcacgcgcttccagctcgaagggtacggcagtgacccagtggtggcgcaggatcatatccttgactggaacgaccgtctgcagctgaaggtggagcctgaagacgaaagaagccttgctcagtggcccaaataccctgaatccttcagggatcttctgcacgagtacgcatcaaaaaccaagagtatgagggacagaatcttgcgagcgatggccaagatcttggagcttgatgaggaagagttcatcaagcagcttggtgctagccctcaagcctatgccagattcaactactaccctccttgtccgaggccggagctcgtcttgggcatcaaggctcactctgacggccccgttctcacggttcttctggtcgatcgtgaggtcggtggactgcaggttcagagagagaacacgtggttcaatgttccgttcgttcctcacactctggtcatcaacctgggagactccttggagataatgagcaacgggatattcaagagcccagtgcacagggttgtgacgaatgcagagaaggagaggatctcgttggccatgctctatgcggtggaacgcgacaatgtgcttcagccggcggccggtttactggatgagaagcgtccggcaaggtacaggaggattacagaggcggacttcttggagggggtcaaagaacacttctctaaaggaataagaatgattgagaccttgaagatctaaaccttgtaccttttgttatcaagttaagcaatttcagcagcaatttaatccaaaaggagatgatcaacaaaaaaaaaaaaaaaaaa

SEQ ID NO: 10638 - protein, 351 aa, Zea mays
  misc_feature: Ceres CLONE 1279873
  misc_feature (202)..(302): Pfam Name: 2OG-FeII_Oxy Pfam Description: 2OG-Fe(II) oxygenase superfamily
  misc_feature: SWISSPROT Homolog: EC 1.14.11.19 Leucocyanidin oxygenase
MAVESWTVPTPVKDLAALVDEPPSRFVQREEHRPGSLMLAADMPDPLPIVDLNKLSTADEAAKLRSALQTWGLFLATNHGIDASLMEDLMEASREFFHQPLQERQKYSNLREGTRFQLEGYGSDPVVAQDHILDWNDRLQLKVEPEDERSLAQWPKYPESFRDLLHEYASKTKSMRDRILRAMAKILELDEEEFIKQLGASPQAYARFNYYPPCPRPELVLGIKAHSDGPVLTVLLVDREVGGLQVQRENTWFNVPFVPHTLVINLGDSLEIMSNGIFKSPVHRVVTNAEKERISLAMLYAVERDNVLQPAAGLLDEKRPARYRRITEADFLEGVKEHFSKGIRMIETLKI

SEQ ID NO: 10639 - DNA, 940 bp, Zea mays
  misc_feature: Ceres CLONE 1279919
  misc_feature: Encodes the peptide sequence at SEQ ID NO. 10640
ctcttcctcctccgcctcctcttcctctcttttgcttttgtgttgctgttaggttcttggatagtgtgcatcggcaccagcagcagcagtagtaattcatactagtgggcggtgtgatagcagcagtgagatcgaggagaggatggaggtgttcatccacgaggactacgtgaacaagcgcaacgagctgaggagggagcagaggcgccgggaactgcagaggctgcaggtggagagcaaccccgacgcgtcccgggaggcgctggcaagccgggagagcccgaggacgccggctcagtgcctgacgcccaccggcgcgtcgccgtccagcttcagatccccgacttcgaggagcacgctgcagtcgccggccgcagcggcggggcaggctgctggttggccgtcggagcatcgccgcctctacgactgcctcaagccgtactagtaggtaggcgacgtggagtggcctcaatcctgctgcgtacacggccagacgtggcatgtcgtccaacagaataagcgcggagacactcctgtggtcaaagcagtccttctgttgctctgctcgtaccgcggttcagatctgtgccatggcatggtcaagtgaatgaggctgttctgctctgttccactgtcatggtcacagcaatctttgattcagtttcaaggatgacgtccagaactgcccagtactgtttggcctattgtggtgcatcagaaattcagaagagtgaaagagttccaataatgcaatagccatttttagttagccccatagaaaacctacctgcttcgatgctgctgctcgttagatagatagatagggggtcttacttgtatttttctctttataagcggttttgaactcctgtatttgtatatgtatttgggctagttgcctaataaataataagtcctattcataaaaaaaaaaaaaaaa

SEQ ID NO: 10640 - protein, 100 aa, Zea mays
  misc_feature: Ceres CLONE 1279919
MEVFIHEDYVNKRNELRREQRRRELQRLQVESNPDASREALASRESPRTPAQCLTPTGASPSSFRSPTSRSTLQSPAAAAGQAAGWPSEHRRLYDCLKPY

SEQ ID NO: 10641 - DNA, 1046 bp, Zea mays
  misc_feature: Ceres CLONE 1279968
  misc_feature: Encodes the peptide sequence at SEQ ID NO. 10642
aacccgtcgcttgcttcacgtaatcacgtctcctccgccgcccttgctaagcaaacgcaacctgcaactgcaaacccctcctccgattcctcccccgcacgcggaagccccccgcagctcttcgtccccgtaagaccaagcccaccaccggagatgtcgtacgcctacctcttcaagtacatcatcatcggcgacacaggcgtcggcaagtcgtgcctgctgctgcagttcaccgacaagcgcttccagcccgttcatgacctcaccatcggcgtcgagttcggggcccggatgatcaccatcgacaacaagcccatcaagctccagatttgggatacggctggtcaagagtcattcagatccataactagatcatactacagaggcgctgctggtgctcttctggtctatgatatcactaggagggagactttcaatcaccttgcaagctggctggaggatgcaaggcagcacgcgaatgctaacatgacgataatgcttgttgggaacaagtgtgatctgtctcacaggcgtgcagtgagctatgaggaaggcgagcagttcgcaaaggaacatggtcttatcttcatggaggcctctgcaaagaccgcgcagaatgtcgaggaggcatttgttaagactgctggagcaatctacaagaaaatccaagatggcgttttcgatgtatctaatgagtcttatgggatcaaagttggatatgtagtccctgggcaatctggaggtgctggtagctcttctcaaggtggtggctgctgcagctaatctgctaacgcccttatgtacaaaggcatatctgcggtgtagctgcgttatctctatgttgctgagcgtaaaatagttactgctccagggtgctttgttatttgatgcaccaactggtggcagtgcctgaacgatttgagacattcagttttatttatgtcaggtattcataaacattatgtaaatcactagggtgctgtttggttcaagaaatataacgcaaagggtaatggtaatggtttacgaaaaaaaaaaaaaaaaaa

SEQ ID NO: 10642 - protein, 209 aa, Zea mays
  misc_feature: Ceres CLONE 1279968
  misc_feature (8)..(169): Pfam Name: Ras Pfam Description: Ras family
  misc_feature (8)..(122): Pfam Name: Miro Pfam Description: Miro-like protein
  misc_feature: SWISSPROT Homolog: EC 2.7.11.1 Non-specific serine/threonine protein kinase
MSYAYLFKYIIIGDTGVGKSCLLLQFTDKRFQPVHDLTIGVEFGARMITIDNKPIKLQIWDTAGQESFRSITRSYYRGAAGALLVYDITRRETFNHLASWLEDARQHANANMTIMLVGNKCDLSHRRAVSYEEGEQFAKEHGLIFMEASAKTAQNVEEAFVKTAGAIYKKIQDGVFDVSNESYGIKVGYVVPGQSGGAGSSSQGGGCCS

SEQ ID NO: 10643 - DNA, 739 bp, Zea mays
  misc_feature: Ceres CLONE 1280068
  misc_feature: Encodes the peptide sequence at SEQ ID NO. 10644
atatccactattctctaggaagcaagggaatcacatcgccatggcagccaagatgtttgcattgtttgcgctcctagctctttgtgcaaccgccactagtgctacccatatcccagggcacttgtcaccactactgatgccattggctaccatgaacccatggatgcagtactgcatgaagcaacagggggttgccaacttgctagcgtggccgaccctgatgctgcagcaactgttggcctcaccgcttcagccgtgccagatgccaatgatgatgccaggtatgatgccaccgatgacaatgatgccgatgccgaatatgatgccatcgatgatggtgccgactatgatgtcaccaataatgatgatgccgagtatgatgccttcgacgatgacgccgagtatgatgccaccgataatgatgccaagtatgataccaccgatgatgatgccgagcatggtgtcatcaatgataatgccaaacatgatgacagtgccacaatgttactctgattccatctcgcacattatacaacaacaacaattaccattcatgttcagccccacagccgtggcgatctcacccatgtttttacagcagccctttgttggtgctgcattctagatataagcatttgtgttgtacccaataatgaagtcggcatgccatcgcatgcgactcattgtttaggaataaaacaagctaataatgacttttctcccaaaaaaaaaaaaaaaa

SEQ ID NO: 10644 - protein, 194 aa, Zea mays
  misc_feature: Ceres CLONE 1280068
MAAKMFALFALLALCATATSATHIPGHLSPLLMPLATMNPWMQYCMKQQGVANLLAWPTLMLQQLLASPLQPCQMPMMMPGMMPPMTMMPMPNMMPSMMVPTMMSPIMMMPSMMPSTMTPSMMPPIMMPSMIPPMMMPSMVSSMIMPNMMTVPQCYSDSISHIIQQQQLPFMFSPTAVAISPMFLQQPFVGAAF

SEQ ID NO: 10645 - DNA, 769 bp, Zea mays
  misc_feature: Ceres CLONE 1280378-R
  misc_feature (57)..(57): n is a, c, t, g, unknown, or other
  misc_feature (58)..(58): n is a, c, t, g, unknown, or other
  misc_feature (60)..(60): n is a, c, t, g, unknown, or other
aaattaataatattacctacatcctctccctcattctccctctatcccccccaaaanncnaaacaaatgcggtacggtgccgccctcgaggtcgagggtatcgataagcttttttttttttttttttcgccaagctacaagccaagtttattccaaaccaacaacaaaaacacctgacagtcagcaattcaaacaaaatgggacctcaagataccatggactacctaaggaaccaaatgcagataatgcactgctgaaccaccaacagggatagaactttcttagatcttataatatttggcaagaagacttcaatcacaatgaaacgttcgctactggtacccaactcaaaagtacaagaacacagacaaaacagcttcctacgaactccaaaactataaactgagaataccatctcgtggggcttggtcccttcgctgatagagaaccccccccccacataggtttttagctccaggacccccctcgataaccttgatcagagaaaaatccacagccttccggtcatccttcccgggagcccgccgtcgacttgcaggcttccttttctggataaaaaaaattcgaccctaaggtcatcctacaaccacatcacgtaattatctcttgggatagcatttttaataccgcccctctgggcacaccacccgcaccttattaaaaatgcccaactctccggatcgaaaggtccccgaatcagcccctaatcgtaccgggcgatataaaacgtaataagagaccccgcaca

SEQ ID NO: 10646 - DNA, 1047 bp, Zea mays
  misc_feature: Ceres CLONE 1280387
  misc_feature: Encodes the peptide sequence at SEQ ID NO. 10647
acggtttcgaggcccaaaccctctctgggtcgctgtctgctcccgtactcccccgtatctgccgtctgccgagcgagcggccgacgccgcacctgcccagctccgtcgctccgtgccccagccctgtccgcggccgccgagttgccggagcgtctggagaacgcccagccaagctctgtccccgccgctaccagcccaacgccctgttccacgtctgccccgccgccgaggacgaggcggccaactcgtccgccctccggatccggtcctgcgctcagccgccgaggcaggccgagctcttcctcgccccgccctatcgagctccgcctacaccagaatccagattccaggttccagatgatcatgaatacaactcagaaagctaattcggtggaacaagatgctaaggtttttgtgaaacaagccccacagttcaaaaggtgggggcgaaaacatccattttttcggtatgggttaccactcatttccttgacagtgtttggtgcagtgggacttgctcatcttatacagggcagcaaagaagtgaccaaggaaaaggaggatatggaatgggaggttgtagagacaacaaaagctctaagtcgaacagggccagtggaaggagcctataagcctaagaaactctctctagaggacgaactgaaggctttgcagcagaaggttgacataaacagctacgactacaagcccatcccaagacccagtgagaaataagtgaagatgaagaccgtttgctagtgcgtcgagtggatgtttgtttcttgatactttcgtcgtctcatcttgccacaagttttgtatgaatgtacggagctgattcaagtttgaaattagaataggaataggaataagtgaagctgtagagaactggtacgaggatccttgaaccgtttgcatatgtttgtttttcccccttttttgggttagtaaattctgatgtgtctaatcagttttctagtgtttatttacagaggaaaaaaatataaaggtacagtgcatcgtgttgatctaaaaaaaaaaaaaaaa

SEQ ID NO: 10647 - protein, 125 aa, Zea mays
  misc_feature: Ceres CLONE 1280387
MIMNTTQKANSVEQDAKVFVKQAPQFKRWGRKHPFFRYGLPLISLTVFGAVGLAHLIQGSKEVTKEKEDMEWEVVETTKALSRTGPVEGAYKPKKLSLEDELKALQQKVDINSYDYKPIPRPSEK

SEQ ID NO: 10648 - DNA, 738 bp, Zea mays
  misc_feature: Ceres CLONE 1280450
  misc_feature: Encodes the peptide sequence at SEQ ID NO. 10649
ctaactccaacctacccagcctcggccagccacctccccgtcgctctcacgctcttcgtgcccgccgcctcccctcttcccctccacctcactcctcccgtctgacgcacatggcatccatcgccggatcttccgctctctccttcgccatgcctgtcaaggcaatcaactcaaattctctagccttctccccggtgaggaagggtaacacattcctccgcctgcaaccagtgcctatgagatctgtttcctgcgctgccaagaaggatacggtggacaaggtttgtgaaattgtgaagaagcagcttgctcttcctgaccacactgaagtttgtggtgaatcgaaattctctgaacttggtgcggattcgctggacacggttgagattgtgatgggccttgaggagcacttcgacattagcgtggaggagtccagcgcgcagacaattgccaccgttgaagacgccgctgacctcattgacaagcttgttgctgtgaaggcataggccgcatctcttctatcattgtcttaccactctaggtttctatggtctgaagacttgtgattttctccgcactgctgttgctattcccgtgtcgtaataatacgagatgttttaagcggctgaacacacggtggtgtaatctgttactggtaaggtgcattgttgtatgaattgtttctcacccagaagaaccagaccatcggggattctagcatcaaaacaaaaaaaaaaa

SEQ ID NO: 10649 - protein, 131 aa, Zea mays
  misc_feature: Ceres CLONE 1280450
  misc_feature (56)..(123): Pfam Name: PP-binding Pfam Description: Phosphopantetheine attachment site
  misc_feature: SWISSPROT Homolog: EC 6.1.1.13 D-alanine--poly(phosphoribitol) ligase
MASIAGSSALSFAMPVKAINSNSLAFSPVRKGNTFLRLQPVPMRSVSCAAKKDTVDKVCEIVKKQLALPDHTEVCGESKFSELGADSLDTVEIVMGLEEHFDISVEESSAQTIATVEDAADLIDKLVAVKA

SEQ ID NO: 10650 - DNA, 531 bp, Zea mays
  misc_feature: Ceres CLONE 1281416-R
ccccccctcgaggtcgacggtatcgataagcttttttttgttcttttttctttttttttttttttggcggtaagcaacggacagcatccagattagaaccattgcaaataagacccattctgtgttttgacataaccttaggattacagcagatcctaaacaccggaacgaaacaacggccgctcctttgattcaaccgcggcctccagttgtccaactgccctggcgaaagcaaaaatgggccctttttcagaggcccccaccaaatggaccaatggaacaggcttctcccgaatacgctaaaggtacccttcttaaaaaaaaaaaaaatggtttttttttcaaaactttccgcccttttagaaaaaaggccccttacgttttaaaccctttttaaaaaattcccccgtttcttgtgccgggggggccccccaaaaaaaatctcttttgagccccccccccggggggtactttgggggagggggttccccccccccccaaaaaaaaggggggggccccccttttgttttc

SEQ ID NO: 10651 - DNA, 881 bp, Zea mays
  misc_feature: Ceres CLONE 1281429-R
  misc_feature: Encodes the peptide sequence at SEQ ID NO. 10652
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (76)..(76): n is a, c, t, g, unknown, or other
  misc_feature (79)..(79): n is a, c, t, g, unknown, or other
  misc_feature (128)..(128): n is a, c, t, g, unknown, or other
gttcataaccatcgcccccccctcttcccccctccctccctccgcccgcacnnnaaagacaaatacaataaagagntgntattgtcctcaccaaaggacatcgacaacatttcccacataaagaaggnccaaatgttgggtaaacaaacacggttcaacaaccacacagcactacagcccaacattgtccatgaaactgactacgagcagcacctcagctcttgatcttcttcttggccctcacctggttgctgtgaccacacttcttcttgtggcagttgacagccctagggtgcaaccgtgcatagaatttgcggcagataatcttgtcctggttgtacttgcgagcgagcgactgcagcgaaggctcaatgatgccaccgcggagcctaaccacgaggtgaagcgcagactccttttggatgttatagtccgcaagggtgcgaccatcctccagctgcttcccggcaaacatcacccgctgctggtccgccgccatcccttccttgtcctggatcatggccttgacattgtccactgccccgctgctctcgacctccaaggtgatgctcttccctgacagcgtcttcacgaagatctgcatcttcgtccatctgcgatttcttccgtcctgctgtgattgctgctgcggcgccttctccctctccgatattgaataggatgtactagctaacgaccctcctgcgaattccctgcaccccggcgcatccacctacttcttataccgaccacctacccagatcggatcctccagaccattcgattcccccttaaccgcaacgcaccaatctgcccccaccttggcgctatattcaacggtgactcaaaccaggtatacccggcccctgtaaaacctgtct

SEQ ID NO: 10652 - protein, 129 aa, Zea mays
  misc_feature: Ceres CLONE 1281429-R
MKLTTSSTSALDLLLGPHLVAVTTLLLVAVDSPRVQPCIEFAADNLVLVVLASERLQRRLNDATAEPNHEVKRRLLLDVIVRKGATILQLLPGKHHPLLVRRHPFLVLDHGLDIVHCPAALDLQGDALP

SEQ ID NO: 10653 - DNA, 873 bp, Zea mays
  misc_feature: Ceres CLONE 1281429-R2
gaggtcgacgttatcgataagcttttttttttttttttttattttttttttttttttttttttttttttttttttttttttaacagggaccaaaactacaataacagagttgctattgtcatatagtattgtgtcatcgacaacaaggtaaaacataacagaaggcccaaatgttgggtaaacaaacacggttcaacaaccacacagcaatacagcccaacattgtccatgaaactgactaggagcagcacctcagttcttgatcttcttcttggccctcagctggttgctgtgaccacacttcttcttgcggcagttgacagccctagggtgcagtcgtgcatagcatttgcggcaaatcatcttgtcctggttgtacttgcgagcgagcgcctgcagcgagggctcaatgatgccaccgcggagcctaagcacgaggtgaagcgtaaactccttttggatgttatagtccgcaagggtggggccatcctccagctgcttcccggaaaagatcagccgctgcttgtccggcggaatcccttccttgtcctggatcttggccttgacattggcaatggtgtcgctgctctccacccccagggtgatgttcttccctgtcagcgtcttcccaaaaatctgcatctttgcggacctgggctttctccgggctgctgtgattgctgcggcggcggttttcccctctccttttccataaagatgtctaggaaatggtctcgggcgaatttcctgcaccggggggatccattaatctaaagccgccgcccccgcggggaaccttcgtctttttgtccctttaaggagggtaattgccccgttgcggaatcatggacaagcttgtttcctggggaaaat

SEQ ID NO: 10654 - DNA, 625 bp, Zea mays
  misc_feature: Ceres CLONE 1281433-R
  misc_feature: Encodes the peptide sequence at SEQ ID NO. 10655
  misc_feature (625)..(625): n is a, c, t, g, unknown, or other
acccggattcactggagcggcgatgaacccacgacgaacccaggacatacgtaacacacactcggggggagaaagacaagacggaaggacggtcacccacacgtacaggaacacagcattccgcgacgaccctgctggctgctgatactgatagacacgcacgcgcgcatctatccataatccatgcatggatgacttgcttacgaggaagccctgccgccgccgccagcgccggcacctgcactccccggcgccggcctcctgcgccctgccctggatggcctgggccttgcctggccccggtccttgttgggccccgcgttgcgcccgcgggccctccgcccattcctgtgggggggccccctccctcccacgttaagtcccgggggggggcccccttgggaaaaaaaccctttgtgccgcgagcccccttttgttttttggcccaaaagggccccccctttttaaacccccaaaaggaaaaaaaagggggcccccccccccaaaaggcccccccccaagagggggcgcccccccccccaaaaaaaaattttttttggggggggagaaaacaccccccccccctttttttttttaaaagggggggggcgcccctctttttttn

SEQ ID NO: 10655 - protein, 40 aa, Zea mays
  misc_feature: Ceres CLONE 1281433-R
MNPRRTQDIRNTHSGGERQDGRTVTHTYRNTAFRDDPAGC

SEQ ID NO: 10656 - DNA, 663 bp, Zea mays
  misc_feature: Ceres CLONE 1281632-R
tcgaggtcatcgtatcgataagcttttttttttttttttttatttttttttttaatttttaatgtggtatctgattacggttggacttaaacaaacatggtttaacgttatcagttacccatcacagttacccatcacgttacaaatatgtaaaacaaacggcacctaactctttgatttgttttgttcgttacaagacaaccatacataaccagtttaccacttctttttctaagatagcagcaatccaagcaccacaaatgagtggcatacaaattacatgatacagggtcggtcaagtcaagcaaccagctccaaagccttcttgttactcggcgccatcccctgaatgccctcaagatgtcggcagattccgagatttgcggtctagctgaacactttctagggcagtcgatgcccgcagcacctcttcagatatatcatccggggtatcgtatctccaagtgtactcatcttccctggggtggaaactgaaacccccctctgcgatctgatgctgctgcgaaaaaaaaaaggtcccccctaagaaggcaattcccactgatgctgatggggcttcccatggcccaatttcagcaatttggggagggaagaatttgaaatataaatcccctggcgccaaacttgtttagaaaaatttca

SEQ ID NO: 10657 - DNA, 963 bp, Zea mays
  misc_feature: Ceres CLONE 1281977
  misc_feature: Encodes the peptide sequence at SEQ ID NO. 10658
gaacggaccaggccatcaggttatctagaaagctctcatgctcttccatttctaggctagcctaggtctggaccagttagagtagacacgcaagtatcaatcgattcataagaggaggaggccattgagggagccaagtagaaggcagtcactgcaaacaacgtatcttgttgttagaaagctggtgagcaactttgtcaagcctcaagagctcatggaagatggcagtgctccaagacggtctactccacccacccgcagaagcagatctgccgagttccacaatttttcagaaaggaggagaagggataagatcaacgagaagctgaaagcattacaggagcttcttccaaactgcaacaagaccgacaaagtttcgatgctagacgaagcaatcgactacctaaaatcccttcagctacagcttcagatgctggtcatggggaagggaatgtcaccagtggttcctcttgagctgcagcaatacatgcattacatcacggctgaccctgcccagttgcctccattgcgcccatccggccagcagcaccggcaatttcagataactcaagccaacccccagcgacaatctaacgtcgagtcggatttcttgagccagatgcagaacttgcactcttctgagccgcctcagaactttctcaggccgccgaaattgcaactttatacaccggaacagaggggtggcctacccaacacgagccacaacactggatggatttctgggagttcctcgtataacttcatggagtgatgtgctcctaatgacaaaatttgacacggcaggcgtgcagccttgaactcggaagagatcgttcagtttgggacctgcagcatggttcacctgagagaattccatgaatgtgtagtactagttaactagctagctagttgtgttattaaataaaacgttgtgattgtgatgctaaaaaaaaaaaaaaaaaa

SEQ ID NO: 10658 - protein, 185 aa, Zea mays
  misc_feature: Ceres CLONE 1281977
  misc_feature (19)..(68): Pfam Name: HLH Pfam Description: Helix-loop-helix DNA-binding domain
  misc_feature: The sequence is a functional homolog of SEQ ID NO 160 in the 10/225,066 US patent application
  misc_feature: The sequence is a functional homolog of SEQ ID NO 1866 in the 10/412,699 US patent application
  misc_feature: The sequence is a functional homolog of SEQ ID NO 292 in the 10/374,780 US patent application
  misc_feature: The sequence is a functional homolog of SEQ ID NO 538 in the 11/435,388 US patent application
MEDGSAPRRSTPPTRRSRSAEFHNFSERRRRDKINEKLKALQELLPNCNKTDKVSMLDEAIDYLKSLQLQLQMLVMGKGMSPVVPLELQQYMHYITADPAQLPPLRPSGQQHRQFQITQANPQRQSNVESDFLSQMQNLHSSEPPQNFLRPPKLQLYTPEQRGGLPNTSHNTGWISGSSSYNFME

SEQ ID NO: 10659 - DNA, 1026 bp, Zea mays
  misc_feature: Ceres CLONE 1282059-R
  misc_feature (22)..(22): n is a, c, t, g, unknown, or other
ccccccctcgcccccctatcgngtaccaccaaaccacaaaaaaaaataaaaaaaatatacaatccaaatgagtaccgggccccccctcgaggtcgaccccatcgataagcttttttttttttttttttgactcaaagataacaacgtttacatgcagatacaagacaacaatatcattgttctctgaacacacatgacctccattggtaaaactgaaatccaaccacgccacacaaatacataacgctctaggcaaatgcaagaggattctttattcatctgtgattgcgctctgtgataaatactcttgttcatcctcctccaccgacccagcctgcgatgacttctcgtggtcattctcaagctggttgaagttccccttctccttgatcacctgcacgcgacgccgcttgcaacaccgctatcccctcccgcccaatcgcaccacaaacaatgccgcatgtacgcacccaccccatgtcaagaacttgcaaccaaccttcctcgcgcccacctagctgtcattctaccagcgaacccctcctctcgccgcactacgaacagacctctgccatttactccccatcaacactcttcctctcttcttgttttgttccatcccaatacggaccgtttaccgcaccccccttttatctcatacccatctctctcccatattccctccacaaagtaccattcctcctccctccgccccttccgcaaaaaaccctattggaccaaagaattcccctttcacaaacagctttcttttatactcacaatttcccccatgctaccctcccttataaaccccccccgcgtatctaaaattatacatccttgctccccccccaccccccttccccctcccaccccaacactcccccccctccactccccccttaatgtccacccccccccccccttgccccgcaaccccaaaacaacccccctgaaccccaaccccccctatttcccctccccgactcctcaccccccctccccctccttcctttccccaccccc

SEQ ID NO: 10660 - DNA, 707 bp, Zea mays
  misc_feature: Ceres CLONE 1282239-R
caattgggtaccgggccccccctcgaggtcgatcggtatcgataagcttttttttttttttttttccattaaaatctggaaatgtaacttcttatttccggttggccacgtacatcatcacaaaaaactttattattgaattacaactaataagcaatctaaaaaagggcaccaccaatgatgtgttgttggtaggaggccgctcagcctgtcaaatcaagttggacaaagggcaacaattgttgtaattgtaaaaaggttgcggggttagccgcaaactgctggtagaaaggcaccaactgttgctgtgtcaagaagagaatcaccgtttgctgcagctacctggctaaatggtagtattatttgctgctccaaataagcagcggggttcaatgcggccaaatggttaaatggaacaagttgttgatgctgagagtaagcagtacctagctggctgaaaggtaatacttgttgctacaaataagcagcagggttcagtgtagacagctggttgaatggaagaaattgttgttgctgagagtatggagaaaggtttgccagagctacttggttgatcacaggtagcacgagttgctgcagctgctgtgccctgatggtttgtaccaatgactgcaccaaaaatagggctggcgattgttgaaacaacaagggtgataaaggtatgttgcttgctgcgattgcttgtt

SEQ ID NO: 10661 - DNA, 541 bp, Zea mays
  misc_feature: Ceres CLONE 1282249-R
  misc_feature (164)..(164): n is a, c, t, g, unknown, or other
  misc_feature (165)..(165): n is a, c, t, g, unknown, or other
caattgggtccgggccccccctcgaggtcgatgctatcgataagcttttttttttttttttttagaatctggaaatgtaacttcttatttctggttggccacatacatcatccaaaaaactttattattgaattacaactaataagcaatctaaaagagggcannccaccaatgatgtgttgttggtaggaaaggccgctgggtctgtcaaagcaagttggacaaaggggcaacaaattgtttgtaagttgttaagagggggttgccgggggttagcccgccaaactggcttggttaaaaagggcccccccaccctgtttttctttttttcaaaaaaaagaaaaaaaccccgttttttttttttccaacaaataaagggggggggaaaaaaaaggggggggaaaaaaaaattttttttttgccgccccgcgcccccaaaaaaaaaaaaaaaacccccggccccgggttttgagggggcgacggcggggggggttgttttctgtttgagataagaatggagcggccgactattaaacgccca

SEQ ID NO: 10662 - DNA, 725 bp, Zea mays
  misc_feature: Ceres CLONE 1282793-R
  misc_feature (173)..(173): n is a, c, t, g, unknown, or other
ccgattggggaccgggccccccctcgaggtcgacggtatcgataagcttttttttttttttttttgcgaaacaacttcatgagcttgctattgctaggacacatccccgatcatcacatagcatagcatgtgaactccaggccacctaatggtagattacttgttactagcanatattccgaactgtatgcagcagtacgtctatcactctatcctaactcctacacatggtacatgtagaaatcttttacagaacttagctcttgccagacacatatatggccctcgttaagggtcagaaataggcttttttatttgatacaggcaaaataagaagctcctaaaccagttctgtctgaatcttcaagctttttcatgcatcaaccattgcaaaaccgcattgcgaaatggttccaaggtttttcatttgaccgggcttaaaaaaaggtcttaaaaccaggtcaagctgaaatttcaggtttttgaatggctccccctttggcgggaccgcattggcaaaaggttccccctggccccaagacatacggaaaccttttgggggaggggatcccctggcccccctccccgaaaaaccccgggagggaccccaaaagaccggccctaaaaaccccaaaaaagcccccccccctcttttcccaaagaggggcaacagaaaaaaggccccctttgggaaaagaaaattttcttttccccccccctttttt

SEQ ID NO: 10663 - DNA, 990 bp, Zea mays
  misc_feature: Ceres CLONE 1282845-R
  misc_feature: Pfam Name: DUF248 Pfam Description: Putative methyltransferase
ccccccctccaccccctatcccccccccaataatataaaaaatattctaataatcattcttcccaattgcgtcacgggccccccctcgaggtctattcccatcgataagcttctccttatccggtgtacaatgcctctcccgatagatcatgttatctctagggaaggtcatcgcacgcttttgctcctcacaaggagtgtaatcagtgtactgctcatcacatggtttgaaaggttccattttggaactaccagtatcatttggaaggttgcatgcactatgatgggtctcaaaactcagatttggaagttgtgcacatttggtctgctcattgacccaattctgcattctgtctcctcctccagaaccacttttctgccaagcacccaagacatataagaaggaatcgaggccacaaaccacaatcacaattagtgcatttttggtcctgttctcagtcaagcttcgtgccataccacacccttgcagaacaacaacatcacccactagacccataccggtgcgccgcatcggcgccacctcgccgagtaacccgcgacgagtcacagcccgacctcccgcagttactcttccatcaattcgctcagcggtgtgttaaccgtagttgaagaaccaggttacccttggctaattgtactcctctgaaaggtcgcacgtacagttcccgattttcccctcctcttcatttccccgtgtagatccatcctccgcctcgccccataataatatttgctcacctcttgcccctttctccccccaacgccatgcctcctatcctttacttgccccctccgtagtggaaacatccctttgaaaccccccgttattgaactcaaccaaacccccccatcacccggttccgtccttctgctgcccgccattttccaccaccttcctggaataccccctctaacggaagagatcacttcgcgcccgtatttggtggcaaatcaatcgcccaatccctg

SEQ ID NO: 10664 - DNA, 706 bp, Zea mays
  misc_feature: Ceres CLONE 1283728-R
  misc_feature: Translation starting site: 280
  misc_feature: Pfam Name: ShK Pfam Description: ShK domain-like
  misc_feature: SWISSPROT Homolog: EC 1.14.11.2 Procollagen-proline dioxygenase
  misc_feature (573)..(573): n is a, c, t, g, unknown, or other
  misc_feature (683)..(683): n is a, c, t, g, unknown, or other
ccgggccccccctcgaggtcgacggtatcgataagcttttttttttttttttttaaaggatgattagatcattagtattagaacatctggtggacgaaacagtccaatggaggcgactgtaccgaaattcgcattacactaggttactgattcatctgttatgagcagagagagtgaaaacatgatgggatcaaaatctacccccaaaacatgcacgttcaagcatcacagatcccgcagctcttgcggcaaaacccgagagtgtctttggtcccaaccatgtacgtcgggttcctgtggcactccccgatagcagcccatctagggcagagctccttgtcgtcggagcacggcgcgtccgtcctcacgtctggggggttgtcgaacgacctgacgtggatccatttcgtcgccgaccatttctcgccctcgatcaccgggcagctcccgtggagactgcctgtatcggctgtggcgttgacgtggaggttgaaagacagtagcgcgtctcctttctttggcttcacaggccagatctttgacactcccgacaagtttcgtccttgtactgtnaatggctccctcagcgtttgaaatacagtctctccaccctgttgacatctgtgaagtacataaagacggtcgcaactcgctggccgcccaagctcagggttgttctgtcntgaaaataagtcaagtgggcgtt

SEQ ID NO: 10665 - DNA, 623 bp, Zea mays
  misc_feature: Ceres CLONE 1283791
  misc_feature: Encodes the peptide sequence at SEQ ID NO. 10666
atactaacatcaacatcgtattggcacaagatgactacaaaagcaatcattcagcttctgttctttgctttggtttttgccacatttacggcgcatggggcttggggagagaagggttgctacgatgaaaaagaaaggttcaagcgtgaatgcagcacaagctatgagcgtccaagtaagtcttgttgcgacactgtgcggtcggtcgacatggcctgtgttcgccgtaccatgacctccgaggaggagacgggattaagtgttcaaaagatctcttttctttcaatggcttgcaacaactcagtgcgagtcgtcgggaaaaaatacggagatattcctaaacgaccaatgtggcagtcattctcgccgccgccgccacatagggcacatccatgagagataccgagggaggggtagcaaacaaggcacaagcatatatagcttgtgagttattaacatgtactccctctatttctttttagttgtcgctagatagttcaatcttacattatccaacgacaactaaaataaaacggagggactattatgtcatgacaatgcaaccgcagcaagtatccatataaataaatgtccatattgtcaccaaaaaaaaaaaaaaaaaa

SEQ ID NO: 10666 - protein, 121 aa, Zea mays
  misc_feature: Ceres CLONE 1283791
MTTKAIIQLLFFALVFATFTAHGAWGEKGCYDEKERFKRECSTSYERPSKSCCDTVRSVDMACVRRTMTSEEETGLSVQKISFLSMACNNSVRVVGKKYGDIPKRPMWQSFSPPPPHRAHP

SEQ ID NO: 10667 - DNA, 682 bp, Zea mays
  misc_feature: Ceres CLONE 1284292-R
ctcgaggtcgacggtatcgataagcttttttttttttttttttaaatcaaaactgcctgatgcgcaaatgatatacttcgatataagacattgcccaaacactgtagaactgtcttccaaagtttctaaacacggtctgatggacagaaacatatgaaagtagattcaaaaaaaccccctaagagtgcacaatgctcatcggttcttccacgtcaaaatacaggggcaaactcaacagtgaataatctacttcatccgctgggcggcctccttggccagcaacttttccctggccttggtcttggcctgcgacttgcagcccatgatgccacctccccacttcttcctgacttcatcaaacttgacattgaagttcgccttaatagcctctaagatcttgctgaaatcaagcttgtcctcgatcttgacagtggtcagacacaagactgatgcactcttcttgtgaacgatctatccaaggcgagcctttcctttaacaataccatataggacctccatcttcctgcacagggctagaagacaaacaaccacttcattcggatccacatcatgagcgatgacaacgagctgagccttgttatgctcaatgagggaaggccactggtaaacgcatacttcacaacgattggatttctggatacaacactttttccatcatcta

SEQ ID NO: 10668 - DNA, 853 bp, Zea mays
  misc_feature: Ceres CLONE 1284835-R
  misc_feature: Pfam Name: Cys_Met_Meta_PP Pfam Description: Cys/Met metabolism PLP-dependent enzyme
cccccctccccccgttttcccctttcacccccacgccccccttcccccctccttattccctacgaattgggtaccgggccccccctcgaggtcgacggtatcgataagcttttttttttttttttttaagacaaatcccatttattcaggtccattcccaggttccccagagatcgagccgcttgcactggcatatcgatccatctgaaccagagggatcagatggtgtttaatattcttgcttgaatggcactagtagtatatacacgaacacgacacacacaagtccacacaggccatgcacgctcggaagcgcaagcgcgtcagtgcttgcggtggtggttgttggcggcttcggggccgtcgcggtcggcggcggcggccttgagatggtgcgcgggcgtcggcgtctgcatgagcgcgagcgcgcgctcgaactgcgcccagcgctgctccagcgtgccgttgtagccgacggacatgcggacgaggcccggggagatgcccgcgcgcgcgcggtcctcgggcggcatctcgctgctggtgctgctgccggagcaggacatgagcgtctcgtagtagccgaggctgacggccatgaggccgaactgggcggtgttctggaggtggcgcatgcggcggttggcgcgctcctcggtgcccatgtcgaggaacagcatgccgccgcagccgtaccccgggttgtccatggcggccaagcgccccgtggtgcggttggtccggtcaggcccgggaaccagacgcccaggccccaccccctgcctcccgctcggcgaaacgcccaaccgcgtggtgcccagctgcttcctgcaatccgcaacccggaaggtgg

SEQ ID NO: 10669 - DNA, 632 bp, Zea mays
  misc_feature: Ceres CLONE 1285026
  misc_feature: Encodes the peptide sequence at SEQ ID NO. 10670
tcccttcaacgcttccccctcctcttcccccttcctccgctacaaccatcccctatcacctgcaacgccttcctctaccttgccctctatccaaggggaaccgtttctctccccctcgatctggagctccccaacatcaattcccatgactggtgttggtcagccagcgtccacgccttcgtttcccactcccatggccaccaccacggtgctccccttcccggcgtcgaccaggcacaagtccggtgatggagccctcacggggaacatcacgacgacgctaatcacgaactgtgcatccgcaagacgagcctatgagctccatggcacgacagagtgcgtcctacccagtctaccggtcctgaggtggaggtccagtcgggcagatctactctatgctcgtcatcgagatgcaacacctccgcctcacacacgcagaagtcgatgcgctcgcggtcatggccagctcggagcctgtctaggccctagctagcctaccagccatcctcgtcctcccctccctcatccctctcaagatgaacatccagattactgaatcaaccttgtcagttctatttgcaaagtttctcaaataaagctgaagatcttttattgtaaaaaaaaaaaaaaaa

SEQ ID NO: 10670 - protein, 115 aa, Zea mays
  misc_feature: Ceres CLONE 1285026
MTGVGQPASTPSFPTPMATTTVLPFPASTRHKSGDGALTGNITTTLITNCASARRAYELHGTTECVLPSLPVLRWRSSRADLLYARHRDATPPPHTRRSRCARGHGQLGACLGPS

SEQ ID NO: 10671 - DNA, 801 bp, Zea mays
  misc_feature: Ceres CLONE 1285774-R
cgattgggtaccgggccccccctcgaggtcgacggtatcgataagcttttttttttttttttttctttttttttttttttttttttttttttttttttttttttttttttttttgcaagaaaatataaattaacatattaaaaaaccccagttgctgctatcttccagggtacctataaaatcaaatacaaaaacgggggggaggatggatttctatggcacaacatctccaaaatggatttcatcgaaaatattggatggggatccctccaggcatctatcgggggtggttcatgccaaaagtttcaactggccgacatctactaaataccaacagcccccccggatccctatccaggctcatctctcgtcccccatggtgggactggttaaagggaaccaggcgaaatggagggggaacgccccttcatcaaaactgggggttgctcattccccaaggacgtaaaggtctatcccgaccggggcggcgggggtctgctccaatccgcggctgctggggcccctcatcctaaaacgggcccccccggggaaaaaatggacatgacgggggcgaattcagggcaaggaccacggcgcaaacccgaacaacgaggtcaatggcgcccgggcgcatatgcaacgagcgacttccccgtaaggaaaagtggaggcgccaacggtgtgggttaaggtcttaaggacttgaggcgcggggagagggcaaagttttttccattaagatgttctaaggaatgggcccgggcgaattcctgcagcccgggggatccactaattctaaaa

SEQ ID NO: 10672 - DNA, 886 bp, Zea mays
  misc_feature: Ceres CLONE 1286030-R
  misc_feature: Pfam Name: PPDK_N Pfam Description: Pyruvate phosphate dikinase, PEP/pyruvate binding domain
  misc_feature: SWISSPROT Homolog: EC 2.7.9.4 Alpha-glucan, water dikinase
  misc_feature (52)..(52): n is a, c, t, g, unknown, or other
cccccctccctccctttcccccttatcccgcccctaccccccgccccccccnaaattaatccgaattgggtacggggccccccctcgaggtcgacggcatcgataagctttttttttttttttttccacaagaatatagatagaattattgattacccaataagcccacacgcccattttcatagactcccaggcgtaagagcacacttaattactggagacagtgaaatgtacaaactacggtacaggaccaatgcttgtgccagcattcatacatatacatacgaggacacgcgtggcacatctaggcagacaactatgcatgccataacgcccatatgtcccaaccatagaagaggacaacagtgcttattgagctgtctaatagacgcatacgtcactacatccaggggacctgtctggacgacatacagttttccatccttcagtacgccctcgacgtcgtgaggagaaccatataactccccgatggcacggccagcacgtgctatgcttgagaggattgaggttcggaatccacggtccagtataagaggctctgttgcataatcaagtacaacctcgtcctcctcatccatcggtgacctatcatataatcctgctccagaataaccttccagggcctcaccgctggagtcgcgacggaataggatggattgccttatcgagagccccaatggctttgtgtgggcaaccaagatcgcttgccgagagttacggcccatctccttttgtaaaacataggcccctacatattgatccgcgacaggactcctcccgagggctcccgcgccacatcccttttgcaacaacttacagcaataacctcccctataagaaatcctctcaggaccaaatgcggttt

SEQ ID NO: 10673 - DNA, 695 bp, Zea mays
  misc_feature: Ceres CLONE 1286036-R
  misc_feature (612)..(612): n is a, c, t, g, unknown, or other
  misc_feature (636)..(636): n is a, c, t, g, unknown, or other
ccgggccccccctcgaggtcgacggtatcgataagcttgatgggctcaccagcaggcagtggcttaggagcttgaagttgaccgggtccacccgaagcttttttttttttttttttggatgaatacaggttccgtataaccgtaaaacccatcaccactcttcttggtactcctagctcagttcttcactacccaatcgttgaatgaatacaggttccgtcttgacatactaaatacagaaagaatgagaaaccaaggggcaaatacaaactggaggatgaaccaagcacgagtggaaggaaagatctgcaccccgttgccatttcgtataataataactaggatgcaaacagcaaaagaaagaaaaatggagactagagcagaaatttcatcttcttcttcccccgagcgagccttttcccccacgtcggtctcaacaacgcttccgttggctgcaaccttttcttgcatcttactacgcatcagccggcgcggacgagaagatgaggctcatcaggagccccaccatgagacctattagcccagcaaaggcggcgaacgtcaaggagaaacctgcatcgcctttgcggctcctgcgcctccgaagcacantcaattcacgttgcatttgctgantttgctgaagcacgttgtctcttttctctttcaacgctgaattgtctggatctcttcaa

SEQ ID NO: 10674 - DNA, 600 bp, Zea mays
  misc_feature: Ceres CLONE 1286101-R
  misc_feature (473)..(473): n is a, c, t, g, unknown, or other
  misc_feature (474)..(474): n is a, c, t, g, unknown, or other
  misc_feature (495)..(495): n is a, c, t, g, unknown, or other
  misc_feature (503)..(503): n is a, c, t, g, unknown, or other
  misc_feature (512)..(512): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (552)..(552): n is a, c, t, g, unknown, or other
  misc_feature (556)..(556): n is a, c, t, g, unknown, or other
  misc_feature (557)..(557): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
caattgggtaccgggccccccctcgaggtcgacggtatcgataagcttttttttttttttttttccaggggaatggcgtgatcattgccccctcaccacacttatgttgcttctaccttgaacaaatttgaacaaaattgcctatctgcgtaaaatcccttgggagataacatactgatatttccaatgatgccactagaggaacggggcggaccacatgtcctcagtctccgacgctctactagataccaccatcactgagacgagctcgcttcggactcgcgcatcctctcagttggcaatactctgcttcgccaactcctcgtattttatctggccatcacgcgcgacatgggggttcacgatccatctgtgccccatcatccgtctcagttgcccaccaaaaagtggggaagggcccccccaaaaattttttaaaaaaaagggggggggtggtttcccccctccccctnntcctttctcactaaatcgccncttccgtncccccgggnttgccgacgcaaccccccccccnnnnnnnnnnacgaaaanaaannggcnnnnncccaccccccccccccccccccccccattttttgt

SEQ ID NO: 10675 - DNA, 1783 bp, Zea mays
  misc_feature: Ceres CLONE 1286218
  misc_feature: Encodes the peptide sequence at SEQ ID NO. 10676
atctaattacgccccgctcgctgtccctctcagatctcttccttgttctcgcctcgtcgtccccaatcgtcgccgggagtctcccgatccttcttccaccacctcaccggtgatgtcagggccggctcgcggacggtgcttggactgcccccgtcccgtcatggatcgcgccgagctcaccaccgaacaggttctgaagcgagatattccatgggagcattacatgtcaactaagcttatctccggaacgtgccttcagcttttacggcgatatgaccacaaaccggagagccagcgagctcctttgcttgaggaggatgggccagcatatatccgagttttcctgaatatcctgcggagcatctccaaggaagagactgtggaatacgtgcttgcactcattgatgaaatgcttgcaacaaatcctaagcgtgcagcactgttttatgatcaatctttgtcgggtgaagatatttatgaaccgttcttaaggttgttatggaaaggcaactggtttgtacaagaaaaaagttgtaagatattgactgttataattagtgcacgaccaaagcttcagaatggcacacttccaaatggagatgcttcgaattcgaagagcaagcttacttcaacacacgatgtattgagaggtttggttgattggctctgttcacagctgaggaatcctacacacccgagctactctattcctacttctatccattgcctctccactttgctaagagaaccatatgttaggacattatttgttcaagctgatggcatcaagctgctcattcccttaatttccccagcttccacacaacagtcaattcagctcctttatgaaacttgcctctgcatctggcttttatccttttatgatgctgcagttgattatttgtccaccacaagggttatgccaagacttgtagaggttgtcaagggctctactaaagagaaggtggtcagagttgttgtgttgtccttccgcaatttgctggcaaagggtgcatttgctgcccagatgatcgatcttggattgccacaaatggtacaaaacttgaaagctcaagcatggactgatgaggatctgttagatgctctgaatcaactagaggtgggactcaaagaaaacctcaagaagttgagttcctttgataagtacaaacagcaagttcttcttggtcatctggactggtctccaatgcacaaagatccaagtttctggcgtgagaacattaacaattttgaagaaaatgatttccagattctgcgagttctcatgacaatcattgacacatcaagtgacaccaccgctcttgccgtggcctgctacgacctctcacaattccttcagtaccatccatctggccgaatcgtggtggcagacctcaaggctaaggaccgagtcatgaaactcatgaatcatgagaacactgaagtgaggaaaaatgcattgatctgtgtgcagaggctcttccttggcgcaaagtatgccagtttcctgcaggcttgagaaaagctgagtcttgtatttagatccagagaacccctggtcatttttcagaatggctgttgagaaagaaaaaccttgaaaattcttgttcagtgtatcctattgttatttgatttctgaagccgatgtataataaataatcagagtcatagaatgctcgatgtaataaagtgtccatgggcttgttgattcatttatgtaaattttgacttgtaacattaaaaaaaaaaaaaaaaaaaaaaaaaaacaaaaaaaaaaaaaaaa

SEQ ID NO: 10676 - protein, 468 aa, Zea mays
  misc_feature: Ceres CLONE 1286218
  misc_feature (15)..(423): Pfam Name: V-ATPase_H Pfam Description: V-ATPase subunit H
  misc_feature: SWISSPROT Homolog: EC 3.6.3.14 H(+)-transporting two-sector ATPase
MSGPARGRCLDCPRPVMDRAELTTEQVLKRDIPWEHYMSTKLISGTCLQLLRRYDHKPESQRAPLLEEDGPAYIRVFLNILRSISKEETVEYVLALIDEMLATNPKRAALFYDQSLSGEDIYEPFLRLLWKGNWFVQEKSCKILTVIISARPKLQNGTLPNGDASNSKSKLTSTHDVLRGLVDWLCSQLRNPTHPSYSIPTSIHCLSTLLREPYVRTLFVQADGIKLLIPLISPASTQQSIQLLYETCLCIWLLSFYDAAVDYLSTTRVMPRLVEVVKGSTKEKVVRVVVLSFRNLLAKGAFAAQMIDLGLPQMVQNLKAQAWTDEDLLDALNQLEVGLKENLKKLSSFDKYKQQVLLGHLDWSPMHKDPSFWRENINNFEENDFQILRVLMTIIDTSSDTTALAVACYDLSQFLQYHPSGRIVVADLKAKDRVMKLMNHENTEVRKNALICVQRLFLGAKYASFLQA

SEQ ID NO: 10677 - DNA, 952 bp, Zea mays
  misc_feature: Ceres CLONE 1286404
  misc_feature: Encodes the peptide sequence at SEQ ID NO. 10678
ccatcacattcccaaaccctccgtcgacccctcctcctcgatctacaccggcgatcggcggcgagcgatggggtgggcgacgcggttcctggcggcggtgtgcttctttgctgcgggtgtcctcttcgtccccgaggctctccttggttccccctccggcgcaggcgccgtcaccgccgccaagctggcccacgtcctctcctttgccacttcctggggcgccgccctctgggccacctttatcggcggcatcatcatgttcaagaacctgccgaggcacatgttcggcaacttgcagagcaagatgttcccggcctacttcacgcttatctctgcctgcgcagccatctcggtcgccgccttctcgcacctccacccgtggaagacggcgtccaccgtggagcgctaccagcttggattcctcctatcagcgctcggttgcaatctctccaacctgctagtcttcacccccatgacaattgagatgatgaagaagaggcacaagattgagcgggacctgagtatcggtgaggaagtgggatggtcaaagaatcagcaggtggctaaatccaaccccacccttgctgcaatgaacaagaagtttgggatgatccacgggctgtcatcactggccaacatcatgtcgtttggtagcttggccatgcactcctggtacctggccagcaagctggagctgtgaagaggagccaagacgtcttccatctccgcgttcttgtgaattttatcactatggtggtaatggtgcacgtcaggttgtcagatcgctagactaaactgtacgattgcgctattggcttcacaagataataaattgtactcctagttaaaaaagaaatcctgtgttgcatggagctcccaaactagttattcaaaatcagaataattcagccaacaacgtggtatttgttgatctttaaaaaaaaaaaaaaaa

SEQ ID NO: 10678 - protein, 210 aa, Zea mays
  misc_feature: Ceres CLONE 1286404
MGWATRFLAAVCFFAAGVLFVPEALLGSPSGAGAVTAAKLAHVLSFATSWGAALWATFIGGIIMFKNLPRHMFGNLQSKMFPAYFTLISACAAISVAAFSHLHPWKTASTVERYQLGFLLSALGCNLSNLLVFTPMTIEMMKKRHKIERDLSIGEEVGWSKNQQVAKSNPTLAAMNKKFGMIHGLSSLANIMSFGSLAMHSWYLASKLEL

SEQ ID NO: 10679 - DNA, 709 bp, Zea mays
  misc_feature: Ceres CLONE 1286419-R
  misc_feature: Translation starting site: 370
  misc_feature: SWISSPROT Homolog: EC 2.4.1.207 Xyloglucan:xyloglucosyl transferase
  misc_feature (709)..(709): n is a, c, t, g, unknown, or other
ccgggccccccctcgaggtcgactgtatcgataagcttttttttttttttttttgaaactaaacttgggtagtataaacataaacgattgattttaaacgaatctcttgcgaccaatcaaatgaattaaattatagtactagagtattctttcacaccaaagaatcgatcgatcggtataaataatgaattgacccgtgcgtcgtatatagtgtgcactgatcgacatcgcaatcgaagtgcaccgtggttcagcccagcacctctatacgccgactacgccatggagcactcaggcggcgcgccctgcgagaagcgcttggtgtcggcgcagtaatcgtagaccatgtagttgtcccgcgcccacttcatggcctgctgcgcctccgcgtccatctgctgcccgtactggccggccgccgccgtggccggcggcgcggccgtgaagttgcggtactgcgccacgaagggggcccgcgaccagtccgtcttgacgcggccgccctgcgtggcccagtcctcggcgtcccacagcgagccgtagaggcgcatccgctgcgacgacgggtacggcacgccccggtccgcgtggttcttgaactcccggatcggcgtcccgtccaccagcacgaggatgtgctgctgcgtccactggatggagtaggtgtggaagtcggcggtggggtcgaaacagaggtggaactgttgcn

SEQ ID NO: 10680 - DNA, 1080 bp, Zea mays
  misc_feature: Ceres CLONE 1287030
  misc_feature: Encodes the peptide sequence at SEQ ID NO. 10681
aaaaatcccagacgccacgccacccaacacatacaaacacacgcacgcgcgcgcgcgcgcctcccgctgttccgcaaaacaaaggaaacgaaggagaggaggccatggcgccgagaacgtcagagaaaaccatggcaccggcggcggccgctgccacggggctcgcgctcagcgtcggcggcggcggcggggccggcggcccgcactacagaggcgtgaggaagcggccgtggggccggtacgcggcggagatccgcgacccggcgaagaagagccgggtgtggctcggcacctacgacacggccgaggacgccgcgcgggcctacgacgccgccgcgcgcgagtaccgcggcgccaaggccaagaccaacttcccttacccctcgtgcgtgcccctctccgcagccggttgccggagcagcaacagcagcaccgtcgagtccttcagcagcgacgcgcaggcgcccatgcaggccatgccgctcccgccgtcgctcgagctggacctgttccaccgcgcggcggccgcggccacgggcacgggcgctgccgccgtacgcttccctttcggcagcatccccgttacgcacccgtactacttcttcgggcaggccgcagccgcagccgcggaagcagggtgccgtgtgctcaagctggcgccggcggtcaccgtggcgcagagcgactccgactgttcgtcggtagtggatctgtcgccgtcgccaccggccgctgtgtcggcgaggaagcccgccgcgttcgatctcgacctgaactgctcaccgccgacggaggcggaagcctagtcgtcgaagcttttaatgactgtctgtcttcttagttctttcttctcctttttctcgaggaaaattcggtactactaagctgagagacgctctcctccgacagacgacgtcgacgacgggcatttttgtaaatagtttttgcgccgggacctttttagtttatgatgaaagctgtattgtcaccgaagacaggtcctgccggcgttgttatggaccggattactatattatattatgcactactagtattttgatagccaaaaaaaaaaaaaaa

SEQ ID NO: 10681 - protein, 233 aa, Zea mays
  misc_feature: Ceres CLONE 1287030
  misc_feature (33)..(84): Pfam Name: AP2 Pfam Description: AP2 domain
MAPRTSEKTMAPAAAAATGLALSVGGGGGAGGPHYRGVRKRPWGRYAAEIRDPAKKSRVWLGTYDTAEDAARAYDAAAREYRGAKAKTNFPYPSCVPLSAAGCRSSNSSTVESFSSDAQAPMQAMPLPPSLELDLFHRAAAAATGTGAAAVRFPFGSIPVTHPYYFFGQAAAAAAEAGCRVLKLAPAVTVAQSDSDCSSVVDLSPSPPAAVSARKPAAFDLDLNCSPPTEAEA

SEQ ID NO: 10682 - DNA, 987 bp, Zea mays
  misc_feature: Ceres CLONE 1287031-R
  misc_feature (29)..(29): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (722)..(722): n is a, c, t, g, unknown, or other
  misc_feature (751)..(751): n is a, c, t, g, unknown, or other
  misc_feature (785)..(785): n is a, c, t, g, unknown, or other
  misc_feature (795)..(795): n is a, c, t, g, unknown, or other
  misc_feature (871)..(871): n is a, c, t, g, unknown, or other
  misc_feature (900)..(900): n is a, c, t, g, unknown, or other
  misc_feature (919)..(919): n is a, c, t, g, unknown, or other
caagtattccccccccaacaaaaacacanccccccctccaggtcgacggtatctataagctcacctttttttttttttgaacaaaaactattcattattataatttagaaacctgtaccagattaaaagcaacacgagagaccaaaacataaagccagcaaatcaagcccaaggacattgaggtgccagctctgctaacataaaacattgctaccgcatgtcaacggaccaggtacacgaacgaccaacgacggtagggaacactattatgaagtgattgagctaatgggggtggatgcaacaaactcctccctctatattgtgccaataagaagggatgacacaagcttagcttaggaattgttttggtaaggggaacggattgcgtttcggctttatataggtggtgtaggttggtgtgcggagggagcccccccctctatggttaaaggcggtggtacataatttacggcaaccttcggtgcgatatctaacacttttgctcattaatatgagaaatccactaccagaataaaacgctcaccccttgtttggtggtgatgtttggggtgggggtcgttgtggatcaacttattttatacaagcggtgtcttcnnnagagcgaggggcacgggggaaggggagataatatgatgagggagttgtcaccatttgtttgtgcttcgtgtcatggtgtgttgcttatgctgctggttgatacntcgggcctgtgcggttgtgaagagggganccgtaacgcgtatgattgatatggtgaggaatanccccctgtanaacaatcccttttttgggggggtggaaaacataagaacaaaaatttcaaaaaaatggaggtttggggtggggaggnaaaacaaaaaaaaccccaatgtgacccanaaaagggtgtgtgtgtttnacgtacgtcaaaaagcgacaatataaaaccgggggcgaggctgttggattgtgttgattacactcaca

SEQ ID NO: 10683 - DNA, 877 bp, Zea mays
  misc_feature: Ceres CLONE 1287050-R2
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (13)..(13): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (48)..(48): n is a, c, t, g, unknown, or other
  misc_feature (776)..(776): n is a, c, t, g, unknown, or other
nnnnggggggggngggnnnggccgtccatccgccccccccactctacncccccctctgattttcctgtactcactatgcaaatgtcgtgcttacattttagttgttggtatatacactcaaatgatgcatgctacatgtcgccttcaaggacgtgcccagaaaataaatgatcatgtacaaagtctatgaaaacaatccttacattcctctactttccaagagcaagcatgttgtcaccatctggagatctcggacccttcagggtattcttttgtatcaagaactcctcgcagttctcgtcgatgcaagacaatgggtcgagcttgatcattttttctagcatgactaacatggagaggctgaggaagcccgccatcacctgccatgaatagaccgccattaattcggccatgccaagctgattgccgatgcgagaaaggatactggagagaggtaggtgctgccctgtgggatactacagatgaatcgtggtcataagacactacaccaagatgatgaagcgaccaatgctaacccgcaggacaccctccacgctcaagcagcaacgcgccagcggacggatgaaggagtagcctgtgcggaagagtgaatctatgtcatactcgtgattggaggcatgattgccgtttgtcacgcctcctgtggatgacgattgatggggttgcactcgttgaagacaccgtaatcgacaagatagggtttggaatgtttcgattaggatgttctaagcaatgtgctcaagcgaattcctgcncaccgcttgatccactacttctagagcgaccgccaccgcgatgtagctccaccttgtgttgcctttagtgaaggtttattgcgcgctttgtcgaatcatga

SEQ ID NO: 10684 - DNA, 822 bp, Zea mays
  misc_feature: Ceres CLONE 1287050-R
cgattgggtaccgggccccccctcgaggtcgacggtatcgataagcttttttttttttttttttaaaagataattattcctgtactcaactatgaaaatgtcgtgtttacattttacttgttggaaaatacactcaaatgatgcatgctacatgtggcttcaagtacgtgcccagaaaataaatgaacatgtacaaagtctatgaaaacaatccttacattcctctactttccaagagcaagcatgttgtcaccatctggagatctcgggcccttcagggtattcttttgtatcaagaactcctcgcagttctcgtcgatgcaagacaatgggtcgaggttgatcattttttctagcatgactaacatggagaggttgatgaagcccgccatcacctggcatgaatagaccgccattaattcggccatgccaagctgattgccgatgcgagaaaggatactggagagaggtaggtgctgccctgtgggatactacagatgaatggtggtcataagacactacacgaagatgatgaagcgaccaatgctaacccgcatgacaccctccacgctcaagcagtaacgcgccaccggacgaatgaaggaggagcctgtgcggaagagtgaatctatgtcatactcatgtgtggaggcatgattgccgtttgtcacgcctcctgtggatgacaattgatggggttgcactcgttgaagaaactgtaatcgacaagatagggtttggaatttttctataggatgttctaagcaatggtctcaagcgaattcctgaagcccgcttgatccactacttctagagcggccg

SEQ ID NO: 10685 - DNA, 826 bp, Zea mays
  misc_feature: Ceres CLONE 1287112-R2
ccggcgagattaaaaccctgccacccttatcttctattcctaacatatatcgctcacttagacggagcgttaggctacagtagaccggaagagccttctcttctctttgcagggtcatggcaagttagcataggtatgtttgggagcaaggggactctaaaatcctcttactattaaattttaaatagtaaagggatttatccctccaattctcatcaatcttcacaagggagcaagccctaagcaagttgtgctgttgttgcccttttctttgctcccgtatctgaattctgaagaatggcatgagccttatcgttcgtctgcgaaggcggaagagtgaagctgagcacgatgctgtcaaggttgaattcacatgaaggtgaaacaaactgccagtaaatctctagatctgtccatgacaaaaactcaaggctagtacacattttagatgaaagcggcggcagcagcatcagtatctcagtagtacacattttggattaattagatcttggacagggacagggtggcgagggaaatcccaagcccaataatggagacgcgagcaccaagggacgctgccaaccccaccatcttggtggtggcggcggccgcttcccccggtgtccctcaacggcatcaccgtggcgggtgttgttgtggccggtgggcaattgcaccgtccggttgctttccggtgaacgggggaccccttcggccggcgggttccacacccatggtgccccaaatcggaaacccaggggccctggggcctccggcagtttccgaggtaaaaccgaatatcgcccggcctgtagcttcctgtatc

SEQ ID NO: 10686 - DNA, 879 bp, Zea mays
  misc_feature: Ceres CLONE 1287112-R
  misc_feature (682)..(682): n is a, c, t, g, unknown, or other
  misc_feature (722)..(722): n is a, c, t, g, unknown, or other
gggccccccctcgaggtcgacggtatcgataagcttttttttttttttttttggcaacaaccgtgccatgattccacggcgagattaacaaccctgccacccttatcttctattcctaacatatatcgctcacttagacggagcgttaggctacagtagaccggaagagccttctcttctctttgcagggtcatggcaagttagcataggtatgtttgggagcaaggggactctaaaatcctcttactattaaattttaaatagtaaagggatttatccctccaattctcatcaatcttcacaagggagcaagccctaagcaagttgtgctgttgttgcccttttctttgctcccgtatctgaattctgaagaatggcatgagccttatcgttcgtctgcgaaggcggaagagtgaagctgagcacgatgctgtcaaggttgaattcacatgaaggtgaaagaaactgccagtaaatctctagatctgtccatgacaaaaactcaaggctagtacacattttagatgaaagcggcggcagcagcatcagtatctcagtagtacacattttggattaattagatcttggacagggacagggttggcgagggaaatcccaagccccataatggagaccgaggcaccaagggacgctgcctaccccaccacccttggttgtggcnggcggcggcgttccccggtgtcggtcaacggcatcaccgntggcggtgttggtccctgcccggtgggcaattgcacccgtccggggttgctcccattgaacggggaccccttggcccgccggggcccagcccaaggtggcccaaccgaaaccggtgccccgggcccggttgttcaacggggaaaccccaatggcggc

SEQ ID NO: 10687 - DNA, 889 bp, Zea mays
  misc_feature: Ceres CLONE 1287532-R
ccccccttcccctcattttcccctcctcctctctacccctctccaaaaatttattccaattgggtaccgggccccccctcgaggtcgacgcccatcgataagcttttttttttttttttttacctccacaatggaccggactccaccgtgtttccgggtgttctggtctcagatctgttcgcggcataaaccagatgtaaatgtatcatgttcactactctctgtgcacagaccaagggaagctgcagtccactgaccacacacacaccacgctaggattcagactcagaggcttcgtctctgtccgatgcctccacgcccagcgtcggcgtggccctgaacgctgctgccttctcccggctaaacctcctgaagtcggcaactaggccgacgtccacgtcccgcttcatcttctcccccagcgtcgacaggacctgctcgattctaccacgtcgcgcaggacgatctctgtcacgaggggctcgtaccggcctcaggacgcttgcgatggtgatctccaagaggtccctcatcccgctacccgcggttcctgctccggtcggcgtacagcgacccgctcactgcgaggtcgaattctgtctggcgcgtaactagcgtccagccccctgagctcccactccgtgactccgtagcctgagtccgccgttgcggtcgcctcagctgcatgaccacaatcgccttaaacgttgaggaacgagaaactgccacgtgacaatgcggacactacccattccccacccccgagaccccctgccctctcgctctcctccgcccaccatgccaccaccaccaccccccccgcggctcctgccatgtcctcctttacaataatcaccccctttgaaattccaaggaaacaccctccgtc

SEQ ID NO: 10688 - DNA, 947 bp, Zea mays
  misc_feature: Ceres CLONE 1287608
  misc_feature: Encodes the peptide sequence at SEQ ID NO. 10689
aacaacgagttaacgaaagccttttatccaagctcaggaaagctcacagtttcgttggatccaatcttagttttatccaagctcagcaatggcttctcgtcagcagcatcctactagctaccacgccggcgagacaaaggcccgtgccgaggagaagacgggtcaagtgatgggggcggcgcaggagaaagggagggaggccaagcacaaggcgtccgacgccgccgaccgcgccatggggatgggccacgacgccagggaggcgaccagggagaaggcgcgcgccgccgcggaccgaaccatggggatgggccacgacgccggggagacggccaaggacagggcgtaccgcgcccacgacggcgcgcagcagaccgggagctacgtcgcgcagacggccgaggccgccaggcagaaggcggccggcgccgcgctgtacgccaaggacaccgtggtggccggcaaggacaagaccggcgctctcctgcagcaggcaggggagaaggtgatgagcacggccgtgggggccaaggacacggttgtcagcacggccgtgggggccaaggacacggttgtcagcaccgccgtgggagccaaggacgcgatgatgaactcgctcggcatggccggcgaggacaaggacggcaccaccaccaccgacgccggcaaggacaccagcacccgcaagcctggcagggactattagaggacacggcagccaaacttctcagtgtttctgttccagaagtttctgatcccatcatttaggttcaaaagtttcccatttcattccaaactttcagtgtttggtgcaggctgtaaactttcttcaggacgggtcgtttgacatttgtgtcgactgaagcctccgcgctttcgactcaacgatgtatatgtaataataaagtcgcaaagctgttgttttattttcaaaaaaaaaaaaaaaa

SEQ ID NO: 10689 - protein, 205 aa, Zea mays
  misc_feature: Ceres CLONE 1287608
MASRQQHPTSYHAGETKARAEEKTGQVMGAAQEKGREAKHKASDAADRAMGMGHDAREATREKARAAADRTMGMGHDAGETAKDRAYRAHDGAQQTGSYVAQTAEAARQKAAGAALYAKDTVVAGKDKTGALLQQAGEKVMSTAVGAKDTVVSTAVGAKDTVVSTAVGAKDAMMNSLGMAGEDKDGTTTTDAGKDTSTRKPGRDY

SEQ ID NO: 10690 - DNA, 1284 bp, Zea mays
  misc_feature: Ceres CLONE 1287685
  misc_feature: Encodes the peptide sequence at SEQ ID NO. 10691
agttttcactgctccagttttcttatctcccccatcttcgtcgtcctcacagcgccggcgctccatcttccgttccttcccttactcgcgctcggcacgcaggcgacggcggcggcggcggcgctcaggctcgggctcgggctctcagcgacggcgtcagcggcttcccctcccgcctctcgctagtcgactcgcgccctcgcatccgttcctccgcacaccggccggtgaccctgcgtttcgttcttgttaactattcaagaagtaggaaatgatgagcaacttccaagccactacttgcaagcctcacagtaggatcattgtgaagaaacctatagcaagtcttggaagcacatgtcagtatccattatattcacatgctctcggattccacacgttgcaagagaaggtgtacccaaggctagttctcatttctgctagccacaaaaggcttacttctgtatgtgccttaagtggaaagggaagctctggcactgctgatgaccctttgatggaatctttgaagaaagctgtggctgatgcaaaaaagccccgttccatacaagacttactgaaggagcaggtggctaaactgagagaacaagcgtctggtggaggcagagggaatgggaatcgccgtggaggcagtggtggttctggtggcccagatgatgaatcgttcaaggaaacattggatgaagtagtgcaagttatcttagccactgttgctttcatacttgtgtacatccacataatcagaggggaggagctttaccgtcttgccagggactacaccagatatctcgtcaccggtaagaggactgcccgactgaagcgtgccatgcaaaggtggcgcaacttctcggagagcttcatgcagaaggcaggctcagaagacgaccaatatgagagaccagctgtgtcaaaacctgcatggtggcaacagcctcagaaatttgtgcattttgtggaggacctttgcaggggaaactggcgtccccatgctcaggagtcttagttgatggagtaccccccgacccattgcagaatgcatacttggctgtgattggagcaaggtcgcctgtcaggctgtcacctggggcaggttttttttttttgttatttatcggatatttgccactggtttcttaggagtatgtagaaagtcgctgaattgttggcaattttgcagttgatagaacctcgttttgagactctaacctgccaagtcgggtgtggaattgtttattaataagctgtttggtttgaaaaaaaaaaaaaaaa

SEQ ID NO: 10691 - protein, 248 aa, Zea mays
  misc_feature: Ceres CLONE 1287685
MMSNFQATTCKPHSRIIVKKPIASLGSTCQYPLYSHALGFHTLQEKVYPRLVLISASHKRLTSVCALSGKGSSGTADDPLMESLKKAVADAKKPRSIQDLLKEQVAKLREQASGGGRGNGNRRGGSGGSGGPDDESFKETLDEVVQVILATVAFILVYIHIIRGEELYRLARDYTRYLVTGKRTARLKRAMQRWRNFSESFMQKAGSEDDQYERPAVSKPAWWQQPQKFVHFVEDLCRGNWRPHAQES

SEQ ID NO: 10692 - DNA, 715 bp, Zea mays
  misc_feature: Ceres CLONE 1287748-R
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (31)..(31): n is a, c, t, g, unknown, or other
nnnaaaaggggggaaaaaaaaaactgagggnggggaagaggggagggggtgagagaggggggcgattgggtaccgggccccccctcgaggtcgacggtatcgataagcttttttttttttttttttaataactcaagcatcaatttttcatttagtaggtacgaatcatctattcaagttctcgtaaagtttaatatgaagcaaagattaaaaagaagtaaaaccgcacgaatgatgcataaacatcgttttaatcagacaaaaataatgaaataaaacccagttttatcccatccgctcctctaacgtccgcgtaatgattgttctgtttttaagttccggtgctctgccgcaacacctgattactaccagcctcttccttatggtcaccacaagtacagctttgctcagaccggttcgccggcgtacccaggtatgtgggtttgacgtctcctgccatgatgattagaaacttctctggcaactctgaggtcttggtcttgggagtgatcccttagggttggggcataatctccagcctcgagatctctgtaagccgtgccagtgattcgcccgtacgaacaacgactgaatgagaagagagaaggcgatgaaggctagactgggggggcctaaccaccgcaagagataaaggaacctggagaatggccacgggggaagtgctggacaccaacccattgtaagaagacctaga

SEQ ID NO: 10693 - DNA, 679 bp, Zea mays
  misc_feature: Ceres CLONE 1288153-R
  misc_feature (679)..(679): n is a, c, t, g, unknown, or other
acaattgggtaccgggccccccctcgaggtcgacggtatcgataagcttttttttttttttttttggaaaatacttttttcttttcatttcaattgttcattcaagtcattgctcacactgacactgccacccatggtgatgcgtgacacattattactcaatcatcgccgctaaatgactcaactagctagctagccagcggctatactacagcacatagtttcttcagtgggggacaccgccggcagcagcgtaagggcatggagtcggctgctgcaagccgcacatcgccgtcagttgctgcgctatctgcgccgccaacagccccgcgacctggccgctttgcggctgctgcttcttgatggacccgaggaccaaggcgaagatcacctggtacccgtgctgcggctccacctgcctgagctgctggaaacactgctggcccaacgactgggactgagaggagaaataggggggcccccctccgggctcactgaatgcctcacaaactccacccactgggccaagattcggggggctgcccaaccccccaagtttccctgcaacttggaacagggcttggatgccggctgtttggcaccgggcatagggggttggctgggaaaaaaagcctaaagccccgggcccgtttaaataagggtaatctgcatggtggcn

SEQ ID NO: 10694 - DNA, 870 bp, Zea mays
  misc_feature: Ceres CLONE 1288335
  misc_feature: Encodes the peptide sequence at SEQ ID NO. 10695
accgatcccattccccaggcccaagcgcccatggatcccaagcccgacgccagcgcgcccgccgcggtgccagcggagcacgcggcgtacccgaggctgtcaccggaggacatcgccccgccgccgccgcctgtcgtgccgccgtccggcgccaacccctacgtgctctccgccccgtcgcctaacccgcccgccaagagcgctagggagaatctgagggagatgttcggcatggtggggaagaagttcaacgaggccgcgcgcaagaccgagggcatcgccggcgacgtctggcagcatctgaaaactggacccagcatcactgatactgccatggggaggattgctcagatatccaaggttatatctgagggtggctacgacaagatatttcagcagacttttgagtgctcgcctgatgagaagctcaacaaggcatatgtgtgctacctatcaacgtcgcatggaccaatcatgggcgtcctgtatctctcgactgtcaagattgcattcggtagcgacagccctgtgaaatatgtgactgagaacaacaaaactgagtcatccttttataaggttgttttaccccttcatcacctgagatcagttactcccacagcaagtcagcaaaaccctgcagagaggtacattcaggtcgtttcagtcgacaactacgagttctggttcatgggtttcgtgaactatgatagcgctgtaaagaatcttcaggagtctgttcgagttgttcacggggcctagaggttgcccatcacttttcctctatgtggatgtagtatgcccgtgtaaatgtatttgtgcatggcacctgtaaagttgtgtgttgaaattggtacaaaaaaaaaaaaaaaa

SEQ ID NO: 10695 - protein, 242 aa, Zea mays
  misc_feature: Ceres CLONE 1288335
  misc_feature (119)..(197): Pfam Name: GRAM Pfam Description: GRAM domain
MDPKPDASAPAAVPAEHAAYPRLSPEDIAPPPPPVVPPSGANPYVLSAPSPNPPAKSARENLREMFGMVGKKFNEAARKTEGIAGDVWQHLKTGPSITDTAMGRIAQISKVISEGGYDKIFQQTFECSPDEKLNKAYVCYLSTSHGPIMGVLYLSTVKIAFGSDSPVKYVTENNKTESSFYKVVLPLHHLRSVTPTASQQNPAERYIQVVSVDNYEFWFMGFVNYDSAVKNLQESVRVVHGA

SEQ ID NO: 10696 - DNA, 624 bp, Zea mays
  misc_feature: Ceres CLONE 1289245-R
agaattgggtaccgggccccccctcgaggtcgacggtatcgataagctttttttttttttttttttacctccaggactttttcagggaaagatgaattcccaaaggacccagctcaccaattcaacaggattaaatgcaatccaccttcaagaaaaaaaaaaggccctttttcgtttgctgcatgcttatgtcaccaaaccgaatcaaaatcaaaacccggttgctgttgaatcaatccaattgccccttattactttattacaataaagggcccccttctggttaaaaaaaagacaagaaaattagggggctaatttttcttccccaggcaattcgaacaactccccccggttggccaccccttcttgtgttcctggacaaacttgaagttcttgaggccttccccggtgaagttggccgccatcttggtgataataaacccggtgatggcaaaccccgtgaaaaagggccagttgcccttcccctcccggcggaaaaaaaccggccacgggtcaaacgtcttcatcctctcggcctccggctccggctgctcgcaatctccttcctccctcctccggcttcccttctggtgaaataaggaacggatgggggcaactggaatt

SEQ ID NO: 10697 - DNA, 1117 bp, Zea mays
  misc_feature: Ceres CLONE 1289380
  misc_feature: Encodes the peptide sequence at SEQ ID NO. 10698
gactcgtcgccactggagaagtggctggctacctccgattcagcacgtaaagaaagcaaaccgcccgcagttccgttccgcaagaccagatcgcccgcttttctcctccggtcctctcctccctcccctctcccctgagccctgatcgaatcgatccacggtgccggcggacgcctcgacccctccagttccatccaatccgccagtgaacagatggcgtcgcagtgggctgctccgccgccgggctacccggccgggcacgggcaggcgtacggcgaccagcagctggccacgccgccgcctcaggcagcgacggccgtggccgtgacggcggcgagcaacggcgtgggcaacccctacgtcgtcgtcacccccgcgtctgccgcaccgtccacctgccagaccgtcaggaaggcgctgggccgctacggcaagctgctcgaggacggaacccgcaaggccgccgacgccaccggcaacatctggcaccacctccggacggcgccgaacatggcggacgcggcggtggcgcggctgacgcaggggaccaaggtgtacgcggagggcgtccacgacagggtgttctaccagacgttcggcgccatgcccggggagcagctccgcaaggcctacgcctgctacctctccacctcctcggggcccgtcatcggcacgctctacctctccacggcgcgcctcgccttctgcagcgacagcccgctctgctaccagggccctgccggccagccgcacgagtgcatgtactacaaggtggtgcttcctctgagccaggtgacatccgtgaacccttcttccagcatgcgcaaccgggcagaaaggtacattcagatcaggaccatggataaccacgagttctggttcatggggttcgtgaactacgacaaggccctcaagaatctctacgaggccctgcagcaccgcgatgtcagcgcccaccagcgctgctgatgctgatcaggcttgggttaggtccgacagtcctactgctacttatttcgtccatgatgaactgtgatacctttatctcatctgatgttcttgatgaataagagaaccaccgaaaactcctggtgtgcttaaaaaaaaaaaaaaaaaa

SEQ ID NO: 10698 - protein, 251 aa, Zea mays
  misc_feature: Ceres CLONE 1289380
  misc_feature (122)..(201): Pfam Name: GRAM Pfam Description: GRAM domain
MASQWAAPPPGYPAGHGQAYGDQQLATPPPQAATAVAVTAASNGVGNPYVVVTPASAAPSTCQTVRKALGRYGKLLEDGTRKAADATGNIWHHLRTAPNMADAAVARLTQGTKVYAEGVHDRVFYQTFGAMPGEQLRKAYACYLSTSSGPVIGTLYLSTARLAFCSDSPLCYQGPAGQPHECMYYKVVLPLSQVTSVNPSSSMRNRAERYIQIRTMDNHEFWFMGFVNYDKALKNLYEALQHRDVSAHQRC

SEQ ID NO: 10699 - DNA, 1060 bp, Zea mays
  misc_feature: Ceres CLONE 1289686-R
ccccacccccagaaccaactctaacgatccccatgccaccttatcatataagtaaacaaatgccgacgggtcccccctcgagacgtttccatcaataagcttttttttttttttttttccactgctggaacactgtaccggcacctgctgcaggagatgcaaatcgatctgtatgccccggagttctttccgacgaatagcaaccaattaaccagcctaagaacaacacaacccactgcaccgatgaccgatgtgtcttgaacacaggacacagccatacacacgcgcggtcggtgtatacatatacaaacgcagctaggcgactttgtttcgacgaccttaatttctactataactacagtataggagctagcacaagcgacgcactttgtactaccggtcgtgacgacgacgcaccacggagtttggattattgatctggccgacctcctcagtccagcctgagacggccctccgttcgaaggttccttccgggtaccctttgccttggctccttggacgcctgtttggtggccgaaacggattggtaaaattgttcccactccaacgatccacccctcaccctgtacggcctgccccgtacttctttcatccattcacacgtccgagaaatcgccctgtcgatgtcacctgaagaagaacactgtaatctttcaacaccccacgtagtgcggtagagtcttggctgggatgcgtttccccccaggacagaaagagcatctctctgcccattgccggcaccatcgtcgcatcatctactttgcgtaccaaggagcagttattacaaatgagaaaaggtatagccaggaaagggataatcatcaataggagcctgccctctttccccgagatggaagcactccaatttcctgacttgtctctgtttcactaaaacgaagccactgtgtatgtatcctttagctccgccgcgacctctcataccgtaattaaacaccaaggtggcacccgacccaccatatcctgagaaattctataaacctgcacacgggccatcgcttgtaataacattttttccata

SEQ ID NO: 10700 - DNA, 804 bp, Zea mays
  misc_feature: Ceres CLONE 1290090
  misc_feature: Encodes the peptide sequence at SEQ ID NO. 10701
atacctttctcggccttttggctaagatcaagtgtagtatctgttcttatcagtttaatatctgatatgtggaccatgtgttcacttcgatattaaatttattttttgtgggggagggtccactacagtggcttgccactgggcccctcgagcgtcgctcggccgttgcactactggctgagcctggcgcaccccaaccaatccaattcgagattttttattaatattttttacgacatataagcagaagttgaaagtcttagtaacagatccagaggcaagggaggctgtgcatctcctgtaatcctgtcttacaatcatcgaatgtctcgttccttcgatactaccagccccaaggcgcctgacctcgctctcttccccttacccttcagctgtatgcttcgatcgagtttcatgtgcctgtccaaccctgatccaaatcggactcaacaaactccaggaactacatcctcctgtgtcgtatgcaaccggcaaatccacttcattccaagcaggcagagatcaccagtgccccttcattctcttcttgcatcccaaacacggcagtataaaacatgaatgcaagccacttcattccagctgatcacaaatatgaatgcaacagatacaggcactgcaaggcatatcgtactaaatttcaaaaacattttctcatctctttcctttttatcttaatacatgctaatagtcaacttcctcgcaaatgatcacctcaccaaacaatgggatctacacatctatagcagtataaaacaacatcaagacataaaaaaaaaaaaaaaa

SEQ ID NO: 10701 - protein, 84 aa, Zea mays
  misc_feature: Ceres CLONE 1290090
MSRSFDTTSPKAPDLALFPLPFSCMLRSSFMCLSNPDPNRTQQTPGTTSSCVVCNRQIHFIPSRQRSPVPLHSLLASQTRQYKT

SEQ ID NO: 10702 - DNA, 801 bp, Zea mays
  misc_feature: Ceres CLONE 1290213-R2
acttctttactgtcgatcttacaccagataactatcaaccacttttggagactagaagcacataagaatctacaaatgtactttcttatttctgggaagccacaaacatcagacaaaaaactttattattgaactataactcataagaaatctaaaaaagggcaccaccaatgatgggttgttggtagaactctgctgggtttgtcaaagcaagttggttgaatggcagcaattgttgcagttgtaacagggtgccagacttaagcacaacgtgctggatcaactgcaacaactgtggttgtatcaagaaggtaacatgctcacaccatctatgctggctgaatggtaatagttgttgctgctgtaaataaccacgacagttcaatgctaccacttggttaaatgaaacaaattgctgggagtaggcagcaggtaactggctaaatggcatttgttgttgttgcaaataagaagcagatttcaatgcagctatttggttgaatggaagaaactgctgttgctgagagtaggcagcaaggtttgctaacacaagttgttgtagatgttgtgccctgatgtcttgtgccaataaatgcaccaaaggtaactgatgtaatagggctcatgattgttagatgaacaagggtgataaaggtaacatgccagctgtgattgcctgttggatcctgtagggttgaagaattgggttttcacataccaaacacacctctgtgagaggtactgggcgaacaaagcaagcttacaggagattgcggagcattgcggaaaaacgttctgcta

SEQ ID NO: 10703 - DNA, 872 bp, Zea mays
  misc_feature: Ceres CLONE 1290213-R
  misc_feature (797)..(797): n is a, c, t, g, unknown, or other
  misc_feature (872)..(872): n is a, c, t, g, unknown, or other
caattgggtaccgggccccccctcgaggtcgacggtatcgataagcttttttttttttttttttatcacaccacgacgatgatttatacttcattactgacgatgttacaccagaataactatcaaccacatttggagactaaaagcacataagaatctaaaaatgtactttcttatttctggaaacccacaaacatcagacaaaaaactgtattattgcactataactcataaaaaatctaaaagagggcaccaccaatgatggcttgttggtaaaacgctgctggatttgccaaagcaagttgcctgaatgccagcaattgttgcagttgtaatagggtgccaacggtaggcgcaacgcgctgatagaacggcaacaactgtggttgtatcaagaacgtagcatggttcacaccagctagctggatgaatggtactagttgttgctgctgtaaataagcaggagagttcaacgctggcatctggatgaatgcaaaaaattgctggagctaggcagcaggtacctcgctgaatgccagctgctgttgctgcaaataataaccacagttcaatgcagctagttggttgaatggaataaactgctgttgctgagagtatgcatcaaggatttgctatgcacaacttgttgtaattgatgtgccctgatgctttgagccaataaatgcaccaaaagcgactgatgtaataggactgatgattgtagaaggaacaagggtgataaaggaaccatgccagctgtgattgcctgttgcatcctgtaagcctgaagaattggnttttcacataccgcaaacactgcttgcgagaggtacggcgctaccaagcgaaactataggaagttgcgagcattn

SEQ ID NO: 10704 - DNA, 878 bp, Zea mays
  misc_feature: Ceres CLONE 1290445
  misc_feature: Encodes the peptide sequence at SEQ ID NO. 10705
agtccgcggccgccgtctctgtgcccttcccatcccttccgcccttcgctactccccagtccccagtcccccctcccggctcccgggcaaaaaaaaaaaaaaaaaaaaaaaacacgccccatcgctgcgcagcaccgcgcggcagtataggaaaacgcactggttccattccaggtcaaaacttacggcgcgctgcgaagggagtcgggcgcggtggggtgtagcatgagggagcagcagggttccggcgacgtggcggggcgccggggcggggtcatcaggtccctgctgggcgtcgagcgccggctcgcggagggcgacgccgagggggcggtcggggtctcctcaggcaagcagccggcgaccgagggcggtggcggtggcggtggcgaggaaaggaaggccgtggtgagggtggtggcggccgacatgccgcccgcgctgcagcgccgcgcgttccgctgcgcccgcgacgagctcgccgcgatgccgcacttcccgcgccggctcgagcccaagcgcctcgcgctcgcgctcaagaaggagttcgatgctgcttacgggccagcttggcactgcatcgtggggacgagtttcggttcatatgtcacgcacgcccggggtggattcttgtatttttccgtcgataaggtctacatcctgctcttcaggacagccgtggagccctagccgcattgacggccaccagcctaccagcaatggacaaatggttcataaaaatgcccagttcttgggatagctcacaccaaattcagttgttcagtcagctaggccgaggccttgtaacttgtaaattgcattgtttcttcgaaggcaaatggaaactccttgtgtttctgataaaaaaaaaaaaaaaa

SEQ ID NO: 10705 - protein, 154 aa, Zea mays
  misc_feature: Ceres CLONE 1290445
  misc_feature (55)..(151): Pfam Name: Dynein_light Pfam Description: Dynein light chain type 1
MREQQGSGDVAGRRGGVIRSLLGVERRLAEGDAEGAVGVSSGKQPATEGGGGGGGEERKAVVRVVAADMPPALQRRAFRCARDELAAMPHFPRRLEPKRLALALKKEFDAAYGPAWHCIVGTSFGSYVTHARGGFLYFSVDKVYILLFRTAVEP

SEQ ID NO: 10706 - DNA, 655 bp, Zea mays
  misc_feature: Ceres CLONE 1290499-R
cgattgggtaccgggccccccctcgaggtcgacggtatcgataagcttttttttttttttttttgaagatcacaactataaactagaattaagcacgcaaaatgtgcttgcacacaaatggtcacacatcacaattatttccatgacaattatctccataacagacaccaaccgatttacagacataataagcacgcctgctgcatctatcaagatgccgaggatatagtagaaacgtacataggcaggtagggtgcttcactcggagcgtatccctcccatgaaggttcttgggtcagggcaggttccactgaactgagcctgtgaaaagtcgaacccagggttctcttcctgaaacctttggagcataagccgcttttgctcttgatctgcagcatatggatccaaaatcccttgcccttgtattggagatgaccatgttttccccttctctcttttttgcagtgtgatatgcatctcaccatcttcattgtattaattggtaaaagtagcatgccgatttgacaaatataagtgcaaaaacactacttgcgaagatgcaggggcggatccatgtagaaggcatgctgtccctggacaccaatgagttttggcttggtccatatataaaactaaatcttatagtagatgacag

SEQ ID NO: 10707 - DNA, 711 bp, Zea mays
  misc_feature: Ceres CLONE 1290788-R
  misc_feature: Encodes the peptide sequence at SEQ ID NO. 10708
  misc_feature (396)..(396): n is a, c, t, g, unknown, or other
  misc_feature (421)..(421): n is a, c, t, g, unknown, or other
  misc_feature (422)..(422): n is a, c, t, g, unknown, or other
  misc_feature (467)..(467): n is a, c, t, g, unknown, or other
  misc_feature (468)..(468): n is a, c, t, g, unknown, or other
  misc_feature (562)..(562): n is a, c, t, g, unknown, or other
cgattggggaccgggccccccctcgaggtcgacggtatcgataagcttttttttttttttttttgagatgcagctagtactctgcgccacccagtgctaagcgactagcatgaagtggaaatttcatttggaaacatataacatgaccgggttaacaggaaggaaatttgaagccacgacaaacaacccggcctacattagagcaatttacagcctgcaaattactatataacttctcaaaacatgttcgatcgcgaattagaaattaccccaaattctacaagtgcacaaccgaaacattcacaggaatggcagtaacgcgtcgtaacttctcaaacttcgaaatgcacattcagagtattcacatgcacacaaacatcacgagataaaggtggncaacaacaaagagagaggatccacnnaatagcaactagctgggattcataggcattggtactggtccatcnnagatacagtgctaccggaggagaccgacacagcagcacctaactacggcagacacggcgacctaccagggaagcctgcaagcgaaggcacgcancccaggacgaggtgaactgggtgacggccttggggcctcggaaacggcgggcttggcaagctccccgggaaggacaggcgcacgaagggtctgatctcagggaaggggaggggggcttcttgttgaccggcggagttgggggcctcggg

SEQ ID NO: 10708 - protein, 40 aa, Zea mays
  misc_feature: Ceres CLONE 1290788-R
MKWKFHLETYNMTGLTGRKFEATTNNPAYIRAIYSLQITI

SEQ ID NO: 10709 - DNA, 768 bp, Zea mays
  misc_feature: Ceres CLONE 1290951
  misc_feature: Encodes the peptide sequence at SEQ ID NO. 10710
ccaccgttcttggattcttgtcattgccacacctctcctcttctcaagaagggccaccaacaaaatgcctgcccacggccaccatcgctggctcttcctcccgatctgctgcccaagcttcgcggccggcgccgagccgtcgtcgtcccagtctgctgcatgctccacggggcgcctctgctggatagccaggaagaagaggaagcggctgaagcctcgtcgtcgtgctagtagcgtcggctgcgaggagcgcctaggtgctgctctctgattgattgacgctatcctcgtcgagcttattcttcaccgtcgtcgttgtgtttaattaattacatatatatctcttcactcttcttcttgaccttgcaagactttctagtttaagataaacctacacccattatcttccttttccatatacctatacctcttcctcccacgtctatcagttctagtatctctcccgtccccgtctatccctcttgagcttggaacgctggcagtagctgcctgcgactcctacgtactttcgtttgagctgttggtcgttgtgtcggtgctgctgtgcattgtttcattcctttttcagctactttagcatgagcaactctgttatttgctgtaatgaagctgtgttttctggtgtaatttccttattttgtagtcgctcattattgcctttcggctagtacgtacctcggcttgaactaatgtgtccatgcatgtaataataatgatgagagtgaagctaaaaaaaaaaaaaaaaaa

SEQ ID NO: 10710 - protein, 68 aa, Zea mays
  misc_feature: Ceres CLONE 1290951
MPAHGHHRWLFLPICCPSFAAGAEPSSSQSAACSTGRLCWIARKKRKRLKPRRRASSVGCEERLGAAL

SEQ ID NO: 10711 - DNA, 817 bp, Zea mays
  misc_feature: Ceres CLONE 1291039-R2
  misc_feature (482)..(482): n is a, c, t, g, unknown, or other
  misc_feature (491)..(491): n is a, c, t, g, unknown, or other
  misc_feature (817)..(817): n is a, c, t, g, unknown, or other
cgaggtcgacggtatcgataagcttttttttttttttttttaagaaactaaaacatgtattaaggccccaaacaattttttatggagcaccttgttcaaatgatgatgcatgggtgatttggagagtgggtttagaacgactctatcctcacttacttgcatccattccaattagtaacacatagctaaccgcaacaggcactggaaaaaccaatgtaaagaggtcaccgctagatgcaaaccgtttttcacgatctctctcccacacgcacacacacacggaacccctactttattctactaccaactcttgcattcaaaagagtgatgagtcttgctacgcgcctctcggtacgttcgtcaacttcttcggcatgctgcaaaaagacatacgtactacacaagataactgagaccgatgcggtgagtgatgctcatcaggtatccatgttgatgtcgggggggggggggggggggggggnccccctccnccggccccccgcgatcctcgtcgccctcccggtatttcagccattctccctccctttccccagaagcctaaactccttatctctgctccttgtcggatctgctcctcaccctctccctctctccgttattatttgccatcaccccctctatccatcatttccccctcctccttaatctcccatcccccctcccccgcgccccgattactcagccccctttgccatcctactcttctttgcctccccttgcccacccctattctccgtctcttcattcctccctccacctactcactttcctgcaccatttgactctaaatcaattn

SEQ ID NO: 10712 - DNA, 990 bp, Zea mays
  misc_feature: Ceres CLONE 1291039-R
  misc_feature: Encodes the peptide sequence at SEQ ID NO. 10713
  misc_feature (1)..(1): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (50)..(50): n is a, c, t, g, unknown, or other
  misc_feature (51)..(51): n is a, c, t, g, unknown, or other
nccccccccccccnnnnnnnnnnccccnnnnnntcccctccccannnatnncaacatccataccgcccctacaattttttatggagcacctcgttcaaatgatgatgcatgggtgatttggagagtgggtttagaacgactctatcctcacttacttgcatccattccaactagtaacacatagctaaccgcaacaggcactggaaaaaccaatgtaaagaggtcaccgctagatgcaaaccgtttttcacgatctctctcccacacgcacacacacacggaacccctactttattctactaccaactcttgcattcaaaagagtgatgagtcttgctacgcgcctctcggtacgttcgtcaacttcttcggcatgctgcaaaaagacatacgtactacacaagataactgagaccgatgcggtgagtgatgctcatcaggtatccatgttgatgtccccccgcccggcccccccccccccctcccacctttctcatccccatcccccttaaaaatgacccccccgcaactcccaccccgactccttcaccaacccactctcgtgtcagcacgcgccccgagacccaccgcaccaatcaaaccacaaactacaaccaccacaccccccactaacccaaactcactaacctacaaaccactcccccccccccctccatcccacccgcttcccaacccccgctccacaattacctcaccccgcccacacactcccccactccgagattcccccgcccacactcaaccccctccccacatctaagttcccctccccccccccccattcgacgtcctaccttctcctcccctcctctctccccccccctcctcaactctccccccccctcccgcctcctctcacctccctcacttcgtccactatacctgttgacgttctttacccctctaccccacctagtttcctcccccctcttgttgctgtttttgctcccccacacaataccccacacg

SEQ ID NO: 10713 - protein, 88 aa, Zea mays
  misc_feature: Ceres CLONE 1291039-R
MTPPQLPPRLLHQPTLVSARAPRPTAPIKPQTTTTTPPTNPNSLTYKPLPPPPPSHPLPNPRSTITSPRPHTPPLRDSPAHTQPPPHI

SEQ ID NO: 10714 - DNA, 1079 bp, Zea mays
  misc_feature: Ceres CLONE 1291064
  misc_feature: Encodes the peptide sequence at SEQ ID NO. 10715
attcctcaccgcacgaacaccatcccccacctcccccctcctcgatcttcaacaaccgccgagacctgtccaccaccaccgccacacgccgcgaatggagctcctcggcctggtgcccgcggaggccatagcgctccgcctctactccctccccgcagcagccgcggccgccggctcgctctacgcctggctcgtcgccgcactcgccgccgccatcggcctctggcgcatccgcgccgtcagcgtttccaacatcaacaagcgtgacgcaggcgtcagcgccctcgtcgacgataaccaggagccactggtgcctcttctgccgtctcggggggctgccattactgacgagccgcccgccgccgagccgtcttccgtgagcgagccgagcacgccgtccaaggttcggttcactgcgtactacggtggctcgggagacgaagacggagtggtcgacggcgtcaggaaatgcgcggatgacgacgacgtcgacgacggtgcgcgcggccgagactgcgcggtggaggtggttctcagaaggaccgtgtcagagccggggacaagaagagcggcggccctggccacggggccgtgggaagggagggagatggcggtgaggcggaggagtgacctgggttggtaccgccacatcgacatggccgcgctcgacggcagcgtcgtgaggctgtgggacggcgacctgacggcgtcgccgagggggcggatgaggaggtcaggattggaattgcaattgccattataggaggtactagtgtggttaatatatttatgcgggtacaaacaatgggatactattaggaggatacgacgattttgtccttgagatcgtcatgagctacagccggggcgaagtgcctttgtgtaataataatgtactctagtgcaaggacacaaatgcgatctgaacgtgtctctgtgctctactgctatcttcctcgccagtgccggtcctgacattagagaggcccaggacaagacttataaaggagaccctttataataataattattacacgtaaatatagtgtgtatatattgtcaaaaaaaaaaaaaaaaaa

SEQ ID NO: 10715 - protein, 222 aa, Zea mays
  misc_feature: Ceres CLONE 1291064
MELLGLVPAEAIALRLYSLPAAAAAAGSLYAWLVAALAAAIGLWRIRAVSVSNINKRDAGVSALVDDNQEPLVPLLPSRGAAITDEPPAAEPSSVSEPSTPSKVRFTAYYGGSGDEDGVVDGVRKCADDDDVDDGARGRDCAVEVVLRRTVSEPGTRRAAALATGPWEGREMAVRRRSDLGWYRHIDMAALDGSVVRLWDGDLTASPRGRMRRSGLELQLPL

SEQ ID NO: 10716 - DNA, 952 bp, Zea mays
  misc_feature: Ceres CLONE 1291208-R
  misc_feature: Translation starting site: 640
  misc_feature: Pfam Name: AP2 Pfam Description: AP2 domain
  misc_feature (1)..(1): n is a, c, t, g, unknown, or other
  misc_feature (14)..(14): n is a, c, t, g, unknown, or other
  misc_feature (37)..(37): n is a, c, t, g, unknown, or other
  misc_feature (920)..(920): n is a, c, t, g, unknown, or other
naaaaaaaaaaaanaaaaaaaaaaaaataaaaaaatntttcccttctttcctctctctgctccccctcttttatagtgatctctggctaaccaaagctaagtacagtacagcactactgcacaagtgacaagaacctactgaatgtgccaaggcacaggtccttattgcccgcgaccctcccaatcctagcctgccatctcccgtgctggtgatgccttctcaggtgcgcaatgaactcctgcctcgacatgtgcttcatctcctccagctccttctcgtagtggctcaccggcaaatttatgtgagtcgaggcgccccagcacttgagagctgccaggccataagccctcgcagccttctcctccctgtcatagccgcctaggtagacttgcctccctttcctagtctggccttccttcctgcaagtgttgccccacaggtgagcctcgtaccgcccggtccatctgtgcctggtgacgccacggaactgcgacgtccgctgcccgaacgtctgcgcgggcttgcggtgcaccggcaacggcgccggcagcacctgcggcggctcggccggcggcacgtcatccgtcacggcgaacgaccgcgcagccgcccgccggccgtttccgtaggcacgctacatgggccttcccggagccagtgacttgatcgccggaaatggaacatggagcccgccgaacaacgcttgccgccggccgcagcttgaacatccgaaattgctcgccccctgctggacggcccccccccttggcggatggggaagcccccagaaatacctgtacctgggggcgaagaccgaaactacactgatggatcccggctggccccagaaacccccccggttgacaggcgcggccctcaatgttgaatcctcaaactaaatgccgcgctccgtccccgnccgtgcctgttcgacgcacccccgccacacta

SEQ ID NO: 10717 - DNA, 884 bp, Zea mays
  misc_feature: Ceres CLONE 1291250-R
cgggccccccctcgaggtcgacggtatcgataagcttttttttttttttttttcaccggaacactgcattttattcctcatcataaacatgacatccaaactagacatatcgagcatgctgtagctccgcctctccgatcaaagagagacgcatactgcatatagtactgcactgcactgcatgcccccagacacatgcttgcacacacaagagcacaacacataaacgactagcttgagctatcgcggccaccgagactctacggcagcgtacgtagcagcagccacacgactttaagggccatatgccgccgcaccagcagtggttcaaggaggacgctcgcgcggtccgctcgagtgtggttcttctctcaagacccctgcgcctggtcgatgcggtgctgtgctgcatccttgatgtcgcgggccttggacgccagcctcgccttggcgtggtccaactggtcggcgcccggagggtgcttgcccgtcaggtacttgtacatccaggagaacacggacagcgcagcgacgcctaggccgccggaggtgaccaacccggccgccatgatcgccagcacgatggcggccggcaccagcacctggttgaagatccagcacccgggagtggcagcagtgagcgcgatcacgggtgcggctctggatcaaccacgaaagtaacggttcatttacccgcctaaaaggttccggccgtaaggggcccttgagcgacttccttcagggcgggctgggcttctggtgtgtgatggcggccccccaatggcatggcgacccccccacctttgtagtgcgcctataagcaacgggtaaactttccgttctggccccaggtggtgggatacaaacccgtggtctccgttgga

SEQ ID NO: 10718 - DNA, 715 bp, Zea mays
  misc_feature: Ceres CLONE 1291384-R
  misc_feature (715)..(715): n is a, c, t, g, unknown, or other
tcgaggtcgacggtatcgataagcttttttttttttttttttcaggaaaaaataataatctgtactgaaattacattgtatagttccccttttcaacccgacgagtgataatactccagagttcatcaagtacaacgtaagacaatttgcctcattgtacaacaactaattcaattattttgccaaaatccagattgtaggccggtactttccagaaacattttattcaagcgcttataccataaacaaatggggaacttcaacaagcactaatgaaatatcgagacaaacattttagagcagcaaaaacactgcagaatcgaaaaaaatcaaaccgcagccttgaagaaggagctagaacaggcagcaacatatcctagaacaaaataatccaacagcaaactataacacaccaggggtgaactgcagaattctttctgagttttgcccctgttcgaaaaacgaacaaaatgcatagttgggattgttgcaattgttggaaaccagtcccccctcacgccatttgccccttttcccataaaaccgaaatttccctgccccaaaggtaatggcccgaaagttccctttgccaaattttggaaagggaaaattgcccattgccggttcccgcctccttggtcaaaacccaaaaaaaaattattttgacctccccggtaaaaggggaaaatggcctttccccggaattaagcccttn

SEQ ID NO: 10719 - DNA, 1363 bp, Zea mays
  misc_feature: Ceres CLONE 1292248
  misc_feature: Encodes the peptide sequence at SEQ ID NO. 10720
agagcaaagagacaacatgcttgagacttgagagaggaaagtgaccggggtgccgctccggccaggtcaaggtggtgaaggaagtgggtgcgaaggaagttggggctcgcgttcggaaagcttttcagcctctcttcgccaagaaggagattccgatttttggcgcccacacgcatgttgtacaatggcttgttcgttctgtatcttattcttgcggtttcggaatgtaatccagctctgattcaagatttattaggctggagagattatttctcgctttgagaagacaaagtttttgttgaaatgctaaaaacttttccagtgcaccaaagacttgggcaccatcagaaaaccacatggctcggcaaccttggagcaataatggtcatagaaattccccttcaaattcattagatggaggagttcctggacccatgcctctgctccctttccaggacgaacttgcagttggttgttaagagatttgtagaattgctgctaataatactcttgtgctagaggatattttgggccttaggcaagaattagctgtcattgaagacgagatccatatacttgccaaacaaaccattcctagacttcgtgttgataatgaaatggaatacagggatattatccagggaggcatgaagttagaggaacatatgcatgctcttaaacttatcaaggaagaagtgttggtcctaagttctgaaaagatggagttggaagctttgtgcaaagagctatttgtgaaggttcagtcattgtacagggagctggagcagatccaatccgagaacaagcagatacctgctataagagaagggttgcatgatatacaagaggagatttcgagggccaggatggcatacgagcatgagaaacgtgcaaaagttgagcttcttgaggagagtcaggccatagagagtgattttatcaacataaaaatagaagcacagagattacggacagagctggagaagcggaggtctggtgtgttcaagcatcatgcatttggctcatactataaaaagatagagcatggcattgcatcctccaactggtaggtgggtgtcacaaagcgtagctaagggtttggtgtctatcagagaaattagtcgaactcaggagtcaagaccaaatgcgtttgtctttcggatgagcagctgatagttatttgcgaacacattgctattactatatctcattattaagtaggagtataaattggacgattgaaagaagaatattatcaatttggtctttattgtactcctacttatttttttctctcgagaagtactcctacttatttttaatggatgttttatgtcttattatccgaaaaaaaaaaaaaaaa

SEQ ID NO: 10720 - protein, 150 aa, Zea mays
  misc_feature: Ceres CLONE 1292248
MEYRDIIQGGMKLEEHMHALKLIKEEVLVLSSEKMELEALCKELFVKVQSLYRELEQIQSENKQIPAIREGLHDIQEEISRARMAYEHEKRAKVELLEESQAIESDFINIKIEAQRLRTELEKRRSGVFKHHAFGSYYKKIEHGIASSNW

SEQ ID NO: 10721 - DNA, 909 bp, Zea mays
  misc_feature: Ceres CLONE 1292306-R
cgggccccccctcgaggtcgacggtatcgataagcttttttttttttttttttacagatgaatcttccttttttctgggaagccacagaactcttcctgttaacttcattattgaactctccctcataagcaatctaaatgaggggaccaccaatcgatgggttgttggtacaacggatttcgcgtgtttttgcaccaattattccacatgaaagcatctcacagagacatgtcccctaaccagtccccgactatgaagaggcgcctaacctagcctcctaagccgtagagggtgcgtccctggcgcttgagggcgtagacgacgtccatggcggtcacggtcttgcggcgcgcgtgctcggtgtaggtgacggcgtcgcggatgacgttctcaagaaagatcttgagcacgccgcgggtctcctcgtagatgagccccgagatgcgcttcacgccacccctcctagccagcctccggatcgccggcttggtgatgccctggatgttgtcgcggagcaccttcccgggggcgcttcgcttctacctttaacaaaaccgggttgtggtttgattaaacagagtattagcagcaatatagattttgtcggttgtgagggctgggaaatatttgggctaactgggaaaaaaaaatggggggagatgggaaataaaggtgggaacaaaccttataccagtgcgtaacatttcctggttatatatttggtataaattctttcttatcattttttggtgtgcggaggtttaggtggggatccgctgttacgctgtaacattgtggggaataaaatattacctatattatgagggggggtccaaaacgacgcgtcatacgacttaaccaaacaataacataaagttaagtacatcggtgtggtagccacacacaca

SEQ ID NO: 10722 - DNA, 669 bp, Zea mays
  misc_feature: Ceres CLONE 1292599-R
cgattgggtaccgggccccccctcgaggtcgacggtatcgataagcttttttttttttttttttcccagttcaagatggttattttggcaaccaggaactcaatactggcttatgtattctgcgacagcaaacaagacttgagtttccttattccggcgcatctgacaacctcaattactagtttcttttatggatctgttgctctgctcagaactagtaggggccaccccccgaatccggttgcctataaactgagatgatgcctattatgctggccacatcaagggcatcctattcgtgcgtcagtttcacatagcccttcttcttcgcatcaggcctgatcagcgggatcgatcttctttgcttgaatgacatacatcttcctgaccgcagccaatgagctttatcttgacatgcgttgaggccacaataaagacagagtgtttatatcttccatcgtcttcatggaaattctgtggggaggaggcacctgaggatttggaactgatcaagtttgtttcttcaataaggacgaatcttgggacttctggggccctggaactgcacaaagtttttggcctgagaaaaaggaaccaagggtcgaaaccacatggggctttcttctggccggccccgaaattttcggcccttagcccgcctccagggcc

SEQ ID NO: 10723 - DNA, 645 bp, Zea mays
  misc_feature: Ceres CLONE 1292778-R2
  misc_feature (478)..(478): n is a, c, t, g, unknown, or other
  misc_feature (525)..(525): n is a, c, t, g, unknown, or other
  misc_feature (559)..(559): n is a, c, t, g, unknown, or other
  misc_feature (645)..(645): n is a, c, t, g, unknown, or other
cgccagagtgtttgataagcttgaagtgagaccttttccgttcatctagtcccattttgttttattaacttactgcagacgccaacccaatttcgaagttctaaacatctattgccgcgataaaaattctccatatgaatctcctcccgaattcgagcttcagaacacctagataaaagagggattagacctatgccagacaaagctctcaccaaattcctggacggtactatctcgttagctcgaagcctccaactccaatgttcagtagcatctgccatctcccactctatggagttgccgctgcatcctgtagctcaaaccccctctccaccgcatagtccacgaagctgtacaagggcagcacccgatcgccgtatttttccgcgaacctgtcagccgttgtcttggcctgagccttgagctcctcacaatggcaagcgcgcggtccatccccagggagcgcaagacgctagcngtgctcctcatcttgccgtttcccgatgcgctccggatgtcgtcgancagctcgtacaggacgccgatggtgcgggcgtancgtcccagttcggcctcctcgtctgccccgggcccaccgagcatggcgccgccaagccgcggaacattccggcatctccccgaaan

SEQ ID NO: 10724 - DNA, 660 bp, Zea mays
  misc_feature: Ceres CLONE 1292778-R
  misc_feature: Pfam Name: polyprenyl_synt Pfam Description: Polyprenyl synthetase
cgattgggtaccgggccccccctcgaggtcgacggtatcgataagcttttttttttttttttttaaacagcagaacgccaagagtgtttgtataagcttgaagtgagaccttttccgttcatctagtcccattttgttttattaacttactgcagacgccaacccaatttcgaagttctaaacatctattgccgcgataaaaattctccatatgaatctcctcccgaattcgagcttcagaacacctagataaaagagggattagacctatgccagacaaagctctcaccaaattcctggacggtactatctcgttagctcgaagcctccaactccaatgttcagtagcatctgccatctcccactctatggagttgccgctgcatcctgtagctcaaaccccctctccaccgcatagtccacgaagctgtacaagggcagcacccgatcgccgtatttttccgcgaacctgtcagccgttgtcttggcctgagccttgagctcctcacaatgccaagcgcgcggtccatccccagggagcgcaggacgctagcgttgctcctcatcttgccgtttcccgatgcgctccggatgtcgtcgacaagctcgtacaggacgccgatggtgcggccgtagcgtcgcagctcggcctcctcgtct

SEQ ID NO: 10725 - DNA, 871 bp, Zea mays
  misc_feature: Ceres CLONE 1336059-F
gcggtggcggccgctctataactagtggatcccccgggctgcaggaattcggcacgagctcactatgccccccccaccccctccctttgcgcgctttgttctcttttgtgtttccacactggtgttgactatacctgtgcgctatgaaatgagaggtgtattcgcaaacggtacgaagccataatcaccaacgccgattccgtgttgactatgtcagtacgcagggggtgcctcactcggctgctactcggaatcatgaatcctcctccatctccaccctggtgtgtggcactgactgcaaatactaccactgatgacatgcgtctcgtggtttcttcgtccgaccctatgaaacgtagtcgcgtaaggtcacagtgttcatgtctccggggaggctctaagaccctattcgacctatagtgaactatatttgaactcgctgtcctttgttatataacgtcgagactggaagaactgtggctggtaccttatataagcgccttgcatgaacttcccctttctgcgcctgaatttatagccaaaaggccgacctactagtcgtccttgccatgccgttgcgcagcctgtatgccccaatgtcaaattgtaaccgttatttttttggtaccattcgagccaatttctttgtaaaaccagtcgcattttttaacaactgggcccgaaattgtgcaaatcccgttatgaaacaaaacaagtagatcgccgaacgtgttcagccgttgcttccattccgcgaataagagatctcttattaatgaacgtggaagtcccacgccaaaagggccgtaacaacccgttttataaggcccgagatgcccactagctctaaatcgtcacccccatttctatg

SEQ ID NO: 10726 - DNA, 887 bp, Zea mays
  misc_feature: Ceres CLONE 1336143-F
  misc_feature: Encodes the peptide sequence at SEQ ID NO. 10727
  misc_feature (493)..(493): n is a, c, t, g, unknown, or other
  misc_feature (650)..(650): n is a, c, t, g, unknown, or other
  misc_feature (669)..(669): n is a, c, t, g, unknown, or other
  misc_feature (687)..(687): n is a, c, t, g, unknown, or other
aagctggagctccccgcggtggcggccgctctagaactagtggatcccccgggctgcagggagagagagagagagagagagagagagagagagctcactagtccccccccccccccgtccaagtgacaaggcgtggccgcaagtcgcgcacgagtcgtggcgacggcatccaagcaaggaaaagaaataaagcggaaaactttaaacgggtacgcaggagatccagcgaaatggcggcgccgccgccgtcatatccagcggccttgaagccggagatcggccctgacggcctcgctcgagattctcccgtaatcgcctacaccgagaaggtcattttggaggagcagctgcagctgaagaaatacattcaggagaactattccaaaattcgtgatgtagaaaaggagttagagagtcttactttagaaatgaaactgacatctggaccaaagaaagcagcactagagcatctgaggaagaagattgaaatatncacagagaaaatacgtttagctaaggtgaaaagagaacatgcaaaaaagacttgggaaggtgctgcacaagttgttaaagacgaagaggatgcctagcagaaattatgtgatgacctaaaccatctagtccagggagagtgctgcttccccatatgncagattggaggagctgaanaaacgtttagaatctctnaatcccataaggggattctgttatgtggcagggggttatactgcacagcatgctactctggattcagaccctcacaaacaactggacaaaatcttgcaaatggaactgggcgtcaaaattttgccaacaagcctgcttctatgcaacggaagcctatacctggggaggaaaaaaaaagaaaacacctccatttcggaagg

SEQ ID NO: 10727 - protein, 119 aa, Zea mays
  misc_feature: Ceres CLONE 1336143-F
  misc_feature (88)..(88): Xaa is any aa, unknown, or other
MAAPPPSYPAALKPEIGPDGLARDSPVIAYTEKVILEEQLQLKKYIQENYSKIRDVEKELESLTLEMKLTSGPKKAALEHLRKKIEIXTEKIRLAKVKREHAKKTWEGAAQVVKDEEDA

SEQ ID NO: 10728 - DNA, 884 bp, Zea mays
  misc_feature: Ceres CLONE 1336177-F
  misc_feature: Encodes the peptide sequence at SEQ ID NO. 10729
  misc_feature (518)..(518): n is a, c, t, g, unknown, or other
  misc_feature (559)..(559): n is a, c, t, g, unknown, or other
  misc_feature (560)..(560): n is a, c, t, g, unknown, or other
  misc_feature (581)..(581): n is a, c, t, g, unknown, or other
  misc_feature (664)..(664): n is a, c, t, g, unknown, or other
cgctcttaactagtggatcccccgggctgcagggagagagagagagctcactagtcccccccccccccccatgaggatgccccgatggaaattgtggatgaggaagccaccaagcctgagggatggttggatgatgaacctgaggagattgatgatcctgaggcagccaagcctgaggactgggacgatgaggaggatggtgaatgggaggcgccaaagattgacaaccccaagtgtgaagaggcacctggatgtggcgagtggaagaggccaatgaagcagaatcctgcttacaagggcaagtggcatgcacctatgattgacaaccccaactacaagggaatctggaagcctcaggagatccccaaccctgagtactttgagcttgacaagcctgactttgatccaattgctgctattgggattgagatctggacaatgcaggatggcatcctgtttgacaatatcttgattgctgacgatgagaaggttgccacctccattctggagaagactgnaagctcaagtatgatgttgagaaggaaaggagaaggctganngagaggctgctgctggtgcanatggtctttctgagttccagaagagatttttgacgtcctgtacaagattgctgatgttccgttcttggcaccctacaagaccnagatcatttgatgtatcgagaagggaggagagcagcccacatcactattggcattctggtctccgttgtcggcgtggtcgttacccgtctcttcagatcctgttgggagcaagaggccgtgcacctgtgaacctgcagctgaggcgaaaacccaaggccccagtgaccgacgtgctggaccagtggcgaccagttgaaaaagaggccgaaggggggaacc

SEQ ID NO: 10729 - protein, 157 aa, Zea mays
  misc_feature: Ceres CLONE 1336177-F
  misc_feature (1)..(130): Pfam Name: Calreticulin Pfam Description: Calreticulin family
  misc_feature (145)..(145): Xaa is any aa, unknown, or other
MEIVDEEATKPEGWLDDEPEEIDDPEAAKPEDWDDEEDGEWEAPKIDNPKCEEAPGCGEWKRPMKQNPAYKGKWHAPMIDNPNYKGIWKPQEIPNPEYFELDKPDFDPIAAIGIEIWTMQDGILFDNILIADDEKVATSILEKTXSSSMMLRRKGEG

SEQ ID NO: 10730 - DNA, 767 bp, Zea mays
  misc_feature: Ceres CLONE 1336218-F
  misc_feature: Encodes the peptide sequence at SEQ ID NO. 10731
  misc_feature (755)..(755): n is a, c, t, g, unknown, or other
cgcggtggcggccgctctagaactagtggatcccccgggctgcagggagagagagagagagagagctcactagtccccccccccccccccattttgggcacgtagccgcctcgctttctcctcttccgccccaccccggtgaggcgctgatccatcgcctcggacagcggctccagaacctccgcgttgcagaaacacagtagcgagaactattcggtggggccgaagatggtgtcgctgaaggtgccaaagcgcctcgccgcaagcgttctcaagtgtgggaaaggcaaagtgtggcttgaccccaatgaagttagtgagatctccatggcgaactcccgccataacatccggaagttggttaaggatgggtttatcatcaagaagcctcagaaaatccactctagatctcgtgcaagaagggcgcacgaggctaagcagaagggacggcactcaggatatgggaagcgtagaggtaccagggaggctaggctccccaccaaggtactgtggatgaggaggatgcgcgtgctgaggcgcctgctccgcaagtaccgcgaggccaagaagatcgacaagcacatgtaccacgatatgtacatgaaggtcaaaggtaactcgttcaagaacaagagggtgcttatggagagcatccacaagtccaaggctgagaagggccaggagaagacgctctccgatcagttcgaggccaggcgcgccaagagcaaggcgagtcgcgagaggaagaatgctangagggaagagag

SEQ ID NO: 10731 - protein, 179 aa, Zea mays
  misc_feature: Ceres CLONE 1336218-F
  misc_feature (2)..(149): Pfam Name: Ribosomal_L19e Pfam Description: Ribosomal protein L19e
  misc_feature (176)..(176): Xaa is any aa, unknown, or other
MVSLKVPKRLAASVLKCGKGKVWLDPNEVSEISMANSRHNIRKLVKDGFIIKKPQKIHSRSRARRAHEAKQKGRHSGYGKRRGTREARLPTKVLWMRRMRVLRRLLRKYREAKKIDKHMYHDMYMKVKGNSFKNKRVLMESIHKSKAEKGQEKTLSDQFEARRAKSKASRERKNAXREE

SEQ ID NO: 10732 - DNA, 806 bp, Zea mays
  misc_feature: Ceres CLONE 1336220-F
  misc_feature: Encodes the peptide sequence at SEQ ID NO. 10733
  misc_feature (774)..(774): n is a, c, t, g, unknown, or other
tccccgcggtggcggccgctctagaactagtggatcccccgggctgcaggaattcggcacgagagagagagagagagagctcctatcccccccccccccccaatttgtagcgactgtacatgctctacgagaagggagaacaaaccccaagacagcgtgttgtataaccatttgtagatctagtttgtactgtaaatgtgtaatcctacgaaaacggtcttgttcattcgcttgtatacgatgtattgatgtttaatgatataaaaaaactctggtgggtccttatacccgcttatgtgaaaaaaaaaaaaaaaaaaaaaaaaaaaaaaaaaacctcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcaaattgtaagcgttaatattttgttaaaattcgcgttaaatttttgttaaatcagctcattttttaaccaataggccgaaatcggcaaaatcccttataaatcaaaagaatagaccgagataggggttgagtggttgttccagtttggaacaagagtccactattaaggaacgtggactccaacgtcaaagggcgaaaaaccgtctatcagggcgatggcccactacngtgaacatcaccctaatcaagttttttggggc

SEQ ID NO: 10733 - protein, 115 aa, Zea mays
  misc_feature: Ceres CLONE 1336220-F
  misc_feature: SWISSPROT Homolog: EC 3.2.1.23 Beta-galactosidase
MFNDIKKLWWVLIPAYVKKKKKKKKKKKTSRGGPVPNSPYSESYYNSLAVVLQRRDWENPGVTQLNRLAAHPPFASWRNSEEARTDRPSQQLRSLNGEWQIVSVNILLKFALNFC

SEQ ID NO: 10734 - DNA, 893 bp, Zea mays
  misc_feature: Ceres CLONE 1336227-F
  misc_feature (1)..(1): n is a, c, t, g, unknown, or other
  misc_feature (14)..(14): n is a, c, t, g, unknown, or other
  misc_feature (16)..(16): n is a, c, t, g, unknown, or other
  misc_feature (17)..(17): n is a, c, t, g, unknown, or other
  misc_feature (21)..(21): n is a, c, t, g, unknown, or other
  misc_feature (22)..(22): n is a, c, t, g, unknown, or other
ntttttaccccttntnntatnntatttacgtccatttcttcttttcccaccccctcccttaaaactggagctccccgcggtggcggccgctctattttagaggatcccccgggctgcaggaattttgcacgagccccccccccccatggacgaggacgcccccgctggcagcggcggccctggccccaagatcgaggaggcggactaagcggtgtgttgtcagacttgagcgtgctgcagctgctggctggcccacacgctgccgcgagttatcgccgtcggtcggtgcggtgtgtgcgcttaaactgtatatgaggtggactggtcacttttgtgacggctatttttttaggacctcctgatagtcgatcggctccatgttatcaccgctactgcgcaaaccttacatgatacggcaattctctcgtcttgcagtcaaaaaaaaaataaaaaaactcgagggggggcccggcacccatttcgtcctatagagagcccaaatacaatgcactggccgacggtttacgacttcatgactggcgaaaccctagcgataccacgctgaagcgccctgcgagaactcacccttacgaccgctggaggaatacctgaaaagcccgtagcaatcgcccaatccaacagtcgggcagactgaaatggaaaatgaaaaaataaaacccgtaattatgtcgagaaatcgcccgataccttattgtgaaaacagcttatctttctaaccaataagggcgaaacccgcaaaattccccttgtggaatcggaacctattttccccccaagaggattaattgtcccgctccagggtggggaacaacaaattgcccccacgaaaagaagtggaacctccacccgtcccaaaggctgccacaaacaca

SEQ ID NO: 10735 - DNA, 816 bp, Zea mays
  misc_feature: Ceres CLONE 1336259-F
  misc_feature: Encodes the peptide sequence at SEQ ID NO. 10736
tccccgcggtggcggccgctctagaactagtggatcccccgggctgcaggcccccccccccgcctagagcgtatttctgggctcatctacgaggagacccccgcggcgctctctattttcatagagaaagatatgcgccaccccctgatgtacatcaaccatatccgccgtaagaccgtcaccgccatgtatgtcgtcgaccctctcattcgtcaatatcgcatgctctactgcttccgcgagctactgcgccatccccttctgatgattagatgggacgatcgtggcctgttgtgtgtctagttggccggactactggaggttgctctgtatcttcttctccagatgttgaggcttataacccatttgtggtaatattttcactgctattatcaatggaaagacctcggttctatcaccattaatcaaatagaaaaacattccgacgttcggcccgtgacccaatacgcactatagcgagaccgattaccattcactgcacgtgggtatactggatggtgaatggcaaaatgctggcgttactatactgatcgactcgcgttacatctccgttacatcagctgatttattaccgataagccgacatcgatagatctcttataaattgaacaacagactggataaaggggtgaattgtattcccttattattatgttaagactctatttaaagatttgtacatcacgtcataggtagacaaacgtcttaaaacggcgatgtcccttatgatcacatatacactcgaatattgttttgaaggcgagtcccctttagaccaaaatccactacttaaag

SEQ ID NO: 10736 - protein, 56 aa, Zea mays
  misc_feature: Ceres CLONE 1336259-F
MRHPLMYINHIRRKTVTAMYVVDPLIRQYRMLYCFRELLRHPLLMIRWDDRGLLCV

SEQ ID NO: 10737 - DNA, 737 bp, Zea mays
  misc_feature: Ceres CLONE 1336314-F
  misc_feature: Encodes the peptide sequence at SEQ ID NO. 10738
  misc_feature (326)..(326): n is a, c, t, g, unknown, or other
  misc_feature (335)..(335): n is a, c, t, g, unknown, or other
  misc_feature (442)..(442): n is a, c, t, g, unknown, or other
  misc_feature (484)..(484): n is a, c, t, g, unknown, or other
  misc_feature (487)..(487): n is a, c, t, g, unknown, or other
  misc_feature (488)..(488): n is a, c, t, g, unknown, or other
  misc_feature (505)..(505): n is a, c, t, g, unknown, or other
  misc_feature (522)..(522): n is a, c, t, g, unknown, or other
  misc_feature (523)..(523): n is a, c, t, g, unknown, or other
cgcggtggcggccgctctagaactagtggatcccccgggctgcaggcccccgcgatactgatgaggcctgcgctgtggaaatggattcagctatctgtagcacacagtcatgttcaaagattgcgatggatgtttgtcctactgaaggagccattggagggcctaactctgttataatctctaagcaggcagaagcatatatatcaaatgggtgcaatgctgatgttaaaattgaggaagatgagaaggtagctgataaaaattgcagcattgttgatgctaagaggtccagtgatgctactcacgaagctggtcctattgacatncattgcccnagaagcacagataagctggcaggaactgatgatgtcgttgacctagtaaacatgcatagtaatagtggcatcagctcctcagctaagcatgcagtggccattcactncggaatgaaatccactttactttctggtagaggtcctcaacngannaaaggggaagaactggnacctgatttgccttggnnggaaaaaaggtccaccccatgttctggtaacccccccatggaaaatggaaaatccgggggccccgggtttttttggtttcaaaaaggggatcaagggacaagggtcccctccaaaaataaaggggcgttccccccgggaacccctggtttccttccaggttaccaaatttggggacccgggaaaaatgccccccccaaaaaacaaagggccttt

SEQ ID NO: 10738 - protein, 219 aa, Zea mays
  misc_feature: Ceres CLONE 1336314-F
  misc_feature (82)..(82): Xaa is any aa, unknown, or other
  misc_feature (121)..(121): Xaa is any aa, unknown, or other
  misc_feature (135)..(135): Xaa is any aa, unknown, or other
  misc_feature (136)..(136): Xaa is any aa, unknown, or other
  misc_feature (142)..(142): Xaa is any aa, unknown, or other
  misc_feature (148)..(148): Xaa is any aa, unknown, or other
MDSAICSTQSCSKIAMDVCPTEGAIGGPNSVIISKQAEAYISNGCNADVKIEEDEKVADKNCSIVDAKRSSDATHEAGPIDXHCPRSTDKLAGTDDVVDLVNMHSNSGISSSAKHAVAIHXGMKSTLLSGRGPQXXKGEELXPDLPWXEKRSTPCSGNPPMENGKSGGPGFFWFQKGDQGTRVPSKNKGAFPPGTPGFLPGYQIWGPGKNAPPKKQRAF

SEQ ID NO: 10739 - DNA, 926 bp, Zea mays
  misc_feature: Ceres CLONE 1336343-F
  misc_feature: Encodes the peptide sequence at SEQ ID NO. 10740
cttctctcccccccccttctccttctccccccgggctcctccctctcttttttcaaaactggagctccccgcggtggcggccgctctataatagtggatcccccgggctgcaggcccccccccccccccccattttatgagtcggatccaatgccatctgccgccatgtcaaagcgaggtaagcagcctcttttaccaactggattcggccatttctcgtcgctcgatctggctataaatctcgcctgctcgtgcatgtgacatagttcggctgcttcaaggtgctcggaaaggggatgctgttgtccaaccccatcattgttagggccaagctcatctccaagatcatcgagaagaggatcaatgttactggaggcactgtcttgctgaccgccacataggtctttatgcatcttgttttatctatctgtgataagaaagctttccatttctttttgtggatcatgcgttgtgagataatattctctggcacgtctaattgtgggcatgtattgtccttttctggtgtatggttggaaacgacaaaatcaattgatttcagtctttattactaatctgagatgcagatgctgccgaaggatatgcatagaagagaacatatatgcctaaaagggagtaaaactaagatttggagaaaagaattctccactctcttgacttgacgaggctatataacccagaggccatcataggaaaactgaagaactgagagaatcccccggcttataatcttttatccccccaaattccaaatttatttttttccaatccccttcccccctgggattcgattccgaatcccccacccccccacggggggggttctttccctaatatcccaataaagggttgttttccccttggcccatagtggatcgaaaagggcatctgggaaaaaagccccc

SEQ ID NO: 10740 - protein, 34 aa, Zea mays
  misc_feature: Ceres CLONE 1336343-F
MLLSNPIIVRAKLISKIIEKRINVTGGTVLLTAT

SEQ ID NO: 10741 - DNA, 835 bp, Zea mays
  misc_feature: Ceres CLONE 1336354-F
tggcggccgctctagaactagtggatcccccgggctgcagggctcactagtccccccccccctcccccttgatactggtaactactcatggggaagtgaagctgttacccgcaagacccgtatcctcgacgtggtctacaatgcgtcaaacaatgagcttgtgaggacacaaacccttgtgaagagtgccattgtgcaagttgatgctgccccattcaagcagtggtacctcactcactatggagttgacattggtaggaagaagaaaacccctgctgcaaagaaggataatgctgagggacaagaggttgaggcaccagttgaggaaacgaaaaagagcaaccatgtcacgaggaacctcgcacaagcgcaaggaggtacgcacccttgacccacacattgaggagcaatttggcagtggacggttgcctggcatgcatttccttccgcccctggacagcgtggccgtgctgatgggtacattccttgaggttaaagagccttgcgttctacctgaaaaaagccaccccaggaagaatggctataaagcgctgcagctcaaaccatttcccctggattgtctttgcacctaaatgtgtgcccccgactgatcacactttttttggatacaccccccaagcttcataaccccctctcatgcccccccaactgaattaacacccccttttttaaaaaccgattgatcctcagtccaatgttttggtaaattccccaccacccccactttttttttctccccctcacttcacacccctatgtatctttctttcttgtggggtggaccggtacacccatactttctattcaatcgtat

SEQ ID NO: 10742 - DNA, 848 bp, Zea mays
  misc_feature: Ceres CLONE 1336410-F
  misc_feature: Encodes the peptide sequence at SEQ ID NO. 10743
  misc_feature (539)..(539): n is a, c, t, g, unknown, or other
  misc_feature (547)..(547): n is a, c, t, g, unknown, or other
  misc_feature (588)..(588): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (702)..(702): n is a, c, t, g, unknown, or other
ggagctccccgcggtggcggccgctctagaactagtggatcccccgggctgcaggcccccccccccccccagcagcctcccaaatccccaaagcctccgacccccttcctctctccctccgccgccgctgcgcacgcagggaacaagcgacatgggcgtctacacctttgtgtgccgcaacaacggcggcgagtggaccgccaagcagcactccggcgagatcgaggcttccgccgctaccccatacgagctgcagcgccgcctcgtcgctgccgcctccgcggccgactctgcctacggcgtccagtcgtccttctccatggtcacccccagctccgccgtgttccaggtgatcgtcggtgctgtcggtggtggtgcaatgatggtgagcggaggtggcggcggcggtgctgctgcatctggtggtgctgctgccgaggctcccaaggaggagaagaaggaagaggagaaggaagagagcgacgacgacatgggattctccctgttcgactagagttgtgtgtgtcatctggatccanaaaggggntgttttggtcctgttgccgtagttaaattttgctggcctgnctggggaacctgaagaactccttggaaattgttacaagcgaccctggttcccgtttatggggaaaatttgaatatggtgttgggaaacccnnnnnaaaggaaaaaaaaaaaaanaaaaaaatccgagggggggggccccggaacccccaattccccccaaaaaagggggcccgatataaaattccccctgggccggccgtttttaaaacaccgcggggtaacggggaaaaaccccgcgtgggggttcccccatcttttag

SEQ ID NO: 10743 - protein, 120 aa, Zea mays
  misc_feature: Ceres CLONE 1336410-F
  misc_feature (41)..(119): Pfam Name: Ribosomal_60s Pfam Description: 60s Acidic ribosomal protein
MGVYTFVCRNNGGEWTAKQHSGEIEASAATPYELQRRLVAAASAADSAYGVQSSFSMVTPSSAVFQVIVGAVGGGAMMVSGGGGGGAAASGGAAAEAPKEEKKEEEKEESDDDMGFSLFD

SEQ ID NO: 10744 - DNA, 839 bp, Zea mays
  misc_feature: Ceres CLONE 1336416-F
  misc_feature: Encodes the peptide sequence at SEQ ID NO. 10745
  misc_feature (407)..(407): n is a, c, t, g, unknown, or other
  misc_feature (413)..(413): n is a, c, t, g, unknown, or other
  misc_feature (549)..(549): n is a, c, t, g, unknown, or other
  misc_feature (611)..(611): n is a, c, t, g, unknown, or other
  misc_feature (614)..(614): n is a, c, t, g, unknown, or other
  misc_feature (658)..(658): n is a, c, t, g, unknown, or other
cgcggtggcggccgctctagaactagtggatcccccgggctgcagggagagagagagagctcactagtccccccccccccccccccccgaaattatccctgagatggagatctgtgattttgacttcgaaccctgcggctactccatgaatgcaatccatggctctgcgttctccacgatccatgtgacgcctgaggatgggttcagctacgccagttatgaggttatgggcttggatgccactgccctgtcttacggtgaccttgtcaagagggtccttgggtgcttcggcccctcggaattttctgtcgccgtgaccatcttcggcgggcggggccaagctgggacatggggaaaggaacttggtgcggaggcttatgactgcaacaacatggtcgagcaggagntgcctnggaggtgggatcctcatctaccagagcttctgtgctgctgaagacgccgttgctagctcgcccaaatccgttcttcgctgctttgatggcgagaatgcagcaccttttgcgaaggactgcaagctggctaatcttngtctgcttggaggaagttggatgctatcgaggagaaggatggagtgcttgatgagtaagacnggntttctggtgtcgatttgcttctgagtttttttctttttatatcngttgcgatctcgtgggttggcggtttgggtagcagccaagccaggctattagtacgaagaatgtcgtctataaacatgtggtcctacgttgccacatgctgaatccatctgtatacagctaacttctagggggccagttgcgtctacacaaggagcatcatgaatggataaatcttctggg

SEQ ID NO: 10745 - protein, 116 aa, Zea mays
  misc_feature: Ceres CLONE 1336416-F
  misc_feature (1)..(107): Pfam Name: SAM_decarbox Pfam Description: Adenosylmethionine decarboxylase
  misc_feature: SWISSPROT Homolog: EC 4.1.1.50 Adenosylmethionine decarboxylase
  misc_feature (102)..(102): Xaa is any aa, unknown, or other
  misc_feature (104)..(104): Xaa is any aa, unknown, or other
MEICDFDFEPCGYSMNAIHGSAFSTIHVTPEDGFSYASYEVMGLDATALSYGDLVKRVLGCFGPSEFSVAVTIFGGRGQAGTWGKELGAEAYDCNNMVEQEXPXRWDPHLPELLCC

SEQ ID NO: 10746 - DNA, 916 bp, Zea mays
  misc_feature: Ceres CLONE 1336420-F
  misc_feature: Encodes the peptide sequence at SEQ ID NO. 10747
  misc_feature (787)..(787): n is a, c, t, g, unknown, or other
  misc_feature (824)..(824): n is a, c, t, g, unknown, or other
  misc_feature (825)..(825): n is a, c, t, g, unknown, or other
  misc_feature (861)..(861): n is a, c, t, g, unknown, or other
  misc_feature (872)..(872): n is a, c, t, g, unknown, or other
  misc_feature (887)..(887): n is a, c, t, g, unknown, or other
  misc_feature (888)..(888): n is a, c, t, g, unknown, or other
  misc_feature (892)..(892): n is a, c, t, g, unknown, or other
  misc_feature (916)..(916): n is a, c, t, g, unknown, or other
tacccgcggtggcggccgctctagaactagtggatcccccgggctgcaggaattcggcaccaggagagagagctcactagtccccccccccccccccgattacaaacccgtcctctgtccgtcctaccaccaccgctcacctcggtttggctttctcccctcttccgcacccgcttctcgctccggattccggattccctctgctctttccctaacgaaggtagccatggcggggagaggtaaggcgatcggctcaggcgccgccaagaaggccacgtccaggagctccaaggctggcctccagttccctgtgggaaggatcgccaggttcctcaaggccggcaagtatgccgagagagtcggcgccggcgcccctgtctacctcgctgccgtgctcgagtatcttgctgctgaggttcttgagctggccggcaatgcggcacgtgacaacaagaagacccgcatcgtaccgcgccacatccagctcgccgtccgcaacgacgaagagctctcccgcttgctgggcacggtgaccatcgctagcggtggtgtaatgcccaacatccataacctgctgctcccgaagaaggccggcggcggcagcgccaaggctgcggctggtgacgaggactaagtccttgactacgcctggtggcacctccaggatgctgccgtatcaacatgtgtctgtgtagtacgttaggtgttcgttgtagctgggtatgtggggtgctgtaacactgctaaactaaaagtactctgtgtttgctaagggataaagtctgtnattgttgctaaaaaggtgcatcctttgaatgactggnntcatcatcatagtgtcccattttgcattccgggggnctggatcattncaaatggtgcgctgnngtgntttggaatttattctgagatgaan

SEQ ID NO: 10747 - protein, 135 aa, Zea mays
  misc_feature: Ceres CLONE 1336420-F
  misc_feature (19)..(92): Pfam Name: Histone Pfam Description: Core histone H2A/H2B/H3/H4
MAGRGKAIGSGAAKKATSRSSKAGLQFPVGRIARFLKAGKYAERVGAGAPVYLAAVLEYLAAEVLELAGNAARDNKKTRIVPRHIQLAVRNDEELSRLLGTVTIASGGVMPNIHNLLLPKKAGGGSAKAAAGDED

SEQ ID NO: 10748 - DNA, 874 bp, Zea mays
  misc_feature: Ceres CLONE 1336424-F
  misc_feature: Encodes the peptide sequence at SEQ ID NO. 10749
  misc_feature (679)..(679): n is a, c, t, g, unknown, or other
  misc_feature (859)..(859): n is a, c, t, g, unknown, or other
  misc_feature (874)..(874): n is a, c, t, g, unknown, or other
gggcggccgctctagaactagtggatcccccgggctgcaggaattcggcaccagacaacaaacctgcagatcccccatggcaggctccacctccctcgttccccttcccgtccccgcccctccatctcgccaccgcttccacacgtccacgtccgcatccccccgccacctgcgcccctcccctgctacacgcctccgcgctgcccggcgtcggcatcccgacgccgtcgttgtcgtcccagatgcccgcccctgggtcggcgatctatcgggcgccgccgcgtcctaccgggacggaagtgaggaggacgaagacgacgcagatgaagatgaggacgaagacgaggaccgcagcctggacctactggcccggttcctgcactccgtattcaggaaggcctcacgccgcgcgcgccgcgctgccaggtccgtgctgccgccttccgtccccgccgagctggtgaagttttcggtcaatggcgtgcttgtcctgacgttcttatggatcctgaagggtcttctcgaggtggtctgcacatttggaagcatggtgtttgcaagcatccttcttgttcgtggtatatggtctggggtgacatacatcagagaaaaccgttacagctatattcaccggatcgacaacgatgagaaccgatggagcagagtccagactgctggntaaatatttgctttcctatctatgacagacacactctgcgttgacaggctgtatagtacaaaaagaaagatatggtcagcagtgcaaactatgatgattgcattgctagacctcgcgctaagctgtctctagcagtagctctctctagcagctgcgtatattaatctctagacccgtggntaagctgcctctaan

SEQ ID NO: 10749 - protein, 201 aa, Zea mays
  misc_feature: Ceres CLONE 1336424-F
MAGSTSLVPLPVPAPPSRHRFHTSTSASPRHLRPSPATRLRAARRRHPDAVVVVPDARPWVGDLSGAAASYRDGSEEDEDDADEDEDEDEDRSLDLLARFLHSVFRKASRRARRAARSVLPPSVPAELVKFSVNGVLVLTFLWILKGLLEVVCTFGSMVFASILLVRGIWSGVTYIRENRYSYIHRIDNDENRWSRVQTAG

SEQ ID NO: 10750 - DNA, 1052 bp, Zea mays
  misc_feature: Ceres CLONE 1336428-F
  misc_feature: Encodes the peptide sequence at SEQ ID NO. 10751
  misc_feature (1052)..(1052): n is a, c, t, g, unknown, or other
cctcccctcttccctctctcttttttaatttctttttctatcttcaaactatagctgtgctccaccgcggcggcggccgctctatactagtggatcccccgggctgcaggaattcggcaccagaagtcccccccccctccctcactagctagctgtgtcctgcctacctagcggtatcaatacccggctgcagctcaccaccaccaccaaccaaccaaccatcccacagttcccatataggtagccatcggctacacagcctcgcctccgtaagcagagtgtgtcgctgcggaggcaggaatagagacgacggcggccatggcgacctccttccaggggacgaccaccaagtgcaccgcctgcgacaagactgtgtaccttgcggacaagctcaccgtcgacaaccgcatctaccacaaggcctgcttccgctgccaccactgcaagggcaccctcaagctcgccaactacaattccttcgagggagtgctctactgcaagcctcactctcgaccagctgtttcaagaagacaggggagcttggacaagagcttccaaacgaactcccaaggtttgtcaagcccagaaataaatcgctggcgaatgaagaatgcctactaaagtcctcaacgcgccttttgcctggcaaccaaaaaaagacatggggttgtgactgctatcataaaactgtcctaatcccaatcttgacacgggcccacctgtccacacccccacctttgtaccccatcagaagtctggtttcctagtcggttgcttcaaggtagggttccgcccccctccattcccctcctctatcttacatttgccgcaccactgggcacaacttgttacttgtaaagcatcctccccccatctccccctgtttccaagggacgaatgggagtaatcttcccgccaacctttggtgaattgtaccccgcgagaaacacacctctccgtgtccgtcggtctatctggcggtagagctcgcacctacataacattggctctcccttgatctcaaactccccagagtcatattatgactaccn

SEQ ID NO: 10751 - protein, 100 aa, Zea mays
  misc_feature: Ceres CLONE 1336428-F
  misc_feature (12)..(68): Pfam Name: LIM Pfam Description: LIM domain
  misc_feature: SWISSPROT Homolog: EC 2.7.11.1 Non-specific serine/threonine protein kinase
  misc_feature: The sequence is a functional homolog of SEQ ID NO 428 in the 10/412,699 US patent application
  misc_feature: The sequence is a functional homolog of SEQ ID NO 616 in the 11/435,388 US patent application
  misc_feature: The sequence is a functional homolog of SEQ ID NO 992 in the 11/479,226 US patent application
MATSFQGTTTKCTACDKTVYLADKLTVDNRIYHKACFRCHHCKGTLKLANYNSFEGVLYCKPHSRPAVSRRQGSLDKSFQTNSQGLSSPEINRWRMKNAY

SEQ ID NO: 10752 - DNA, 859 bp, Zea mays
  misc_feature: Ceres CLONE 1336439-F
  misc_feature: Encodes the peptide sequence at SEQ ID NO. 10753
  misc_feature (585)..(585): n is a, c, t, g, unknown, or other
  misc_feature (649)..(649): n is a, c, t, g, unknown, or other
  misc_feature (673)..(673): n is a, c, t, g, unknown, or other
  misc_feature (713)..(713): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (765)..(765): n is a, c, t, g, unknown, or other
  misc_feature (767)..(767): n is a, c, t, g, unknown, or other
  misc_feature (768)..(768): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (800)..(800): n is a, c, t, g, unknown, or other
  misc_feature (801)..(801): n is a, c, t, g, unknown, or other
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
  misc_feature (815)..(815): n is a, c, t, g, unknown, or other
  misc_feature (816)..(816): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
  misc_feature (824)..(824): n is a, c, t, g, unknown, or other
  misc_feature (825)..(825): n is a, c, t, g, unknown, or other
  misc_feature (826)..(826): n is a, c, t, g, unknown, or other
  misc_feature (827)..(827): n is a, c, t, g, unknown, or other
  misc_feature (840)..(840): n is a, c, t, g, unknown, or other
  misc_feature (841)..(841): n is a, c, t, g, unknown, or other
tccccgcggtggcggccgctctagaactagtggatcccccgggctgcaggccccccccccccccccccggagctctcccctcctctcttacccttcctctccccacccacgcagcctcactagggtttagcggcggcggcgagatggtgcagcgcctcacgtaccggaagcgtcacagctacgctacgaagtccaaccagacccgagtcgtcaagaccccaggcgggaagcttgtgtaccagtacaccaagaagagggcgagcgggcccaagtgccccgtcaccgggaagaaaatccaggggatccctcacttgaggcctgctgagtacaaaaggtccaggttgcctaggagccgcaggactgtgaaccgtccttatggtggagtactctctggaattgctgttagggagagaatcattcgtgctttcttggtcgaggagcagaagattgtcaagaaggtcctgaaaatacaaaaaaccaaggacaagacagctgcaaagtaaatctccagtaatggggaagcctagccctggtttgtacactgcgaaaattaattttggtggatggaaaatctaagtggcttgntgagcatttagcatgtgagtttagagatctggacactggatcccttttcactttgaattgttgnatatcggggatctggtcccctagntgctttttatatgaatccggatcctatctatgcaagatcnaccttctgggtgagacatcttttgtccctggtnnnnnnnaaaaannnnaaanannaannnnnaaaaaaaaaaaaaaaaaaaaaaaannaaaaaaaaaannnnnnnnnnnnnnnnggggaaaaaaaannaaaaactggggggggccc

SEQ ID NO: 10753 - protein, 119 aa, Zea mays
  misc_feature: Ceres CLONE 1336439-F
  misc_feature (5)..(103): Pfam Name: Ribosomal_L34e Pfam Description: Ribosomal protein L34e
MVQRLTYRKRHSYATKSNQTRVVKTPGGKLVYQYTKKRASGPKCPVTGKKIQGIPHLRPAEYKRSRLPRSRRTVNRPYGGVLSGIAVRERIIRAFLVEEQKIVKKVLKIQKTKDKTAAK

SEQ ID NO: 10754 - DNA, 884 bp, Zea mays
  misc_feature: Ceres CLONE 1336440-F
  misc_feature (749)..(749): n is a, c, t, g, unknown, or other
  misc_feature (799)..(799): n is a, c, t, g, unknown, or other
tcaccgcggtggcggccgctctagaactagtggatcccccgggctgcaggcccccccccatcgaacttccccgagttcacctccacgactgcttctgggtgatctgcaagctcaaacatttcgacttccttgcctacctctttttgctcatctggtcattttctaaaaaaaggccgatgactaccctgtcccttatagatcacacgaataaaacgacagatggttgagaggtgttccatgtagtgacttcaatgcgctattaaataactggcactccgacttgccacagctagaaagcttatatcatgacgatggtcctatacctgtatacatgaccctaatcaaaattgttgggttacatgtgacgtaaagaactatgtccgaagcctaatctcagcccacgatttagaggttgccgtgaatcgccggcgaacgtggcgagaactgaagggaagaaaccgaaacgcagcttcgccctatggcgctggcaagtgaaatgcactcgctgcgcgtaaccaccacacccgacgcgcttaatgctccgctacacgacgtgactcgtgttacttttctcccactgtgcgcgcagccctatatgttatatgtctaatacattcaacatccatcagctcatgagacagtacgctgatgatgcttcgaaacattgaataatgatagatgcgcattcacatttgcgagtcagctcattcctatcttgcagcttatgcgtccagtcctgatcatcaaancactgacgaaataaagatgctgatgatcatgtgtgacgaagcgctcatcnaatgatgcctcacgtcagagtctaagacgttcatccgagatcgtctcacgagacactcctagttctgttattgcgcgaatatccg

SEQ ID NO: 10755 - DNA, 905 bp, Zea mays
  misc_feature: Ceres CLONE 1336444-F
  misc_feature: Encodes the peptide sequence at SEQ ID NO. 10756
  misc_feature (843)..(843): n is a, c, t, g, unknown, or other
  misc_feature (893)..(893): n is a, c, t, g, unknown, or other
ggagctccccgcggtggcggccgctctagaactagtggatcccccgggctgcagggagagagagagagagagagagctcactagtcccccccccccccccaggtgtggctggctcgtgcagcggcggcaggcgtgagtgagagcgatgagcgcggcggcggcgagctcaatcaccaagttcatcaagtgcgtcacggtcggcgatggggccgtcgggaagacctgcatgctcatctgctacacctgcaacaagttccccacggattatatccccaccggatttgacaacttcagcgccaatgtctccgtgggtgggagcatcgttaacttgggcctctggaacacggcaggccaggaggattacagcaggttgaggcctctcagctacaggggtgccgatgtgttcatcctctccttctccctggtcagtagggcgagctatgagaacgtcctcaagaagtggatgccagagcttcgccgattttcacctactgttcctgtagttcttgttggaaccaaactagatctccgtgaagacagatcttaccttgctgaccattctgctgcttccatcatctctactgaacagggagaagagctcaggaagcacataggcgctgtggcgtacatagaatgcagctcatagacacagaggaacgtaaaggctgtgttcgacactgcaattaaagtagtgctgcaaccaccgaggagaagagagttaccagcactacatggacgcacagcctgatcagtctctgagaagatacctctgctggaagcggatgtttcacatcgtaaagcacaggctcttactgcgatgttgtactggactgcctagatggntgcagctctatgaatgagtaatccctacgcagccactggtaacttctggntctctgctacct

SEQ ID NO: 10756 - protein, 166 aa, Zea mays
  misc_feature: Ceres CLONE 1336444-F
  misc_feature (14)..(165): Pfam Name: Ras Pfam Description: Ras family
  misc_feature (14)..(127): Pfam Name: Miro Pfam Description: Miro-like protein
MSAAAASSITKFIKCVTVGDGAVGKTCMLICYTCNKFPTDYIPTGFDNFSANVSVGGSIVNLGLWNTAGQEDYSRLRPLSYRGADVFILSFSLVSRASYENVLKKWMPELRRFSPTVPVVLVGTKLDLREDRSYLADHSAASIISTEQGEELRKHIGAVAYIECSS

SEQ ID NO: 10757 - DNA, 868 bp, Zea mays
  misc_feature: Ceres CLONE 1336475-F
  misc_feature (746)..(746): n is a, c, t, g, unknown, or other
cgcggtggcggccgctctagaactagtggatcccccgggctgcaggaaatagatagagagatagagttcactagtccccccccccccccccactgaattaattatacgaaacccgtttaacccagaccaaagctcaggagcatagtgctacgcaataagccactatgactgctaacgcgacggagcgagcaatcgccagatgaggccatactcgaaacaagtgactaaatggaatgcccatcaactccacggataaaacgcactccgtccaaaacaggctcataccccccaaaagtgcatatcgacttttctagctctgctacactcaatatcgactcgtcacatcactggggttgaaatagctcccaaggagatagatgaccaccatttgcaccgttacgaccacctgggttaagaacggcaagagacagtccattccctatctgtcgtgagcgctccacaactgaaacacctaccagtacccaattctccctataccgaaccctatcataattcactgcgacgaccatctacaacgatctgactgccaaaaccatcgtgtaacccatctaaatcgacttgccctacatcgcccttctcccagttgtataattagctaagatgcccgcaccgatacgccgtcccaaaagatgcttagcctgaatgcacaatgtgaatgagtaatctgacaatgctgattaaagacacagtgaatgtttgtaaatcagctcatttttaaccaatangccgaaatcggcaaaatcccttataatcaaaagataaccgacctcggggtgagtcctgtacaaattcggacagagtcactatatacgacttgcagtccacgtttagagcgaaaacgggtata

SEQ ID NO: 10758 - DNA, 757 bp, Zea mays
  misc_feature: Ceres CLONE 1336479-F
  misc_feature: Encodes the peptide sequence at SEQ ID NO. 10759
  misc_feature (523)..(523): n is a, c, t, g, unknown, or other
  misc_feature (592)..(592): n is a, c, t, g, unknown, or other
ggatcccccgggctgcaggccccccccccccccccgaggacctggcgaggttagataatgactaccaacctccccgttgtcaattcgactcaggaaattatgaattatatctctttgaggactatagaagtattttgttttacttgcctcgggctcctgtgctagcccttatcccgtgacctgccatgaatctctctcatgttatctaggaatgtaaggctgctcgactacatggtatgcatatcattgctcgatgtgctcaaacgtaatgattcccccgctctgctagcttacaattagctctcgctatcgtgttgcatacatctcgtgcttctgttagcgaagctgtcgaagttcaggcccctcccatgcccaaactacgcttatacacacggctctatttgtatgatgatattcctcatgccttttctgctcctgaaacttgtcgtcgccttgcaaattcattgaattgtttcctgctccatatactgctgctagcctatatgatttgacgtaccactancacctacttgccgaataagatatatcggatgtggctctagatcctgtaatttctttatgatctcgctgnacgctcgtgcgcacgtagataatcctacactattatttcagctcgcggccgactgccagtatgtcccgtctaaaccgagatcgtttgcctcgcttccgttcggaaatttcctcctttgtccaaaaaagagacaataaaacctcaagggggggtcccggtacccat

SEQ ID NO: 10759 - protein, 33 aa, Zea mays
  misc_feature: Ceres CLONE 1336479-F
MLSRNVRLLDYMVCISLLDVLKRNDSPALLAYN

SEQ ID NO: 10760 - DNA, 765 bp, Zea mays
  misc_feature: Ceres CLONE 1336498-F
  misc_feature: Translation starting site: 76
  misc_feature: SWISSPROT Homolog: EC 3.2.1.23 Beta-galactosidase
  misc_feature (531)..(531): n is a, c, t, g, unknown, or other
aagtgatccccccgggctgcgggatttcggcaccagcccccccccccccacaccttcggcggccgcttccaccgcatgctcaagctgggcctcagcatcgacgaggacgaggcttccggaggccgacaccgacttgcctccctctggaggatgacgctggcgagagcaagatgggaggaggtcgactagtcgggcttatcgtgtcttaattggtgtgggtgcgtggggtttttttacttttgctagcctgcaaacttcgtacgtttacgtataaaagtgctccggcttgcccaaaaaaaaaaaaaaaaaaaactcgagggggggcccggtacccaattcgccctatagggagtatattacaattcactgggccgtctttttacaacgtcgtgacgggaaaaacccgggcgttacccaactttaatcgccttgcagcacttccccctttcgccagctggcgtaatagcgaagaggcccgcaccgatcgcccttccaacagttgcgcagcctgaatggcgaatggcaattgtnagcgtaaatattttgttaaaattcgcgttaaatttttgttaaatcagctcattttttaaccataggccgaaatcggcaaatcccttataaatcaaaagatagaccgagatagggttgagtgttgttccagtttggaacagagtcactattaagaacgtggactccacgtcaagggcgaaaaacgtctattcaggcgatggcccctacgtgaacatcacctaatcaggttttttg

SEQ ID NO: 10761 - DNA, 744 bp, Zea mays
  misc_feature: Ceres CLONE 1336530-F
  misc_feature: Translation starting site: 127
  misc_feature: Pfam Name: Asp Pfam Description: Eukaryotic aspartyl protease
  misc_feature: SWISSPROT Homolog: EC 3.2.1.23 Beta-galactosidase
  misc_feature (520)..(520): n is a, c, t, g, unknown, or other
  misc_feature (614)..(614): n is a, c, t, g, unknown, or other
  misc_feature (658)..(658): n is a, c, t, g, unknown, or other
  misc_feature (744)..(744): n is a, c, t, g, unknown, or other
ggatcccccgggctgcaggaattcggcacgagagagagagagagagctcactagtccccccccccccccccccgcgagcgccggggagccgacggcgtgtggtgcctaacgttcgggaacgcggacatggtgcccctgacggcgtacgtgatcgggcaccaccaccagatgaacctgtgggtcgagtacgacctggagcgcggtcgcgttgggatcgcgcctgtcaagtgcgacgtcgccagcgagcggctcggcctgatgttgtgacgtggcctggcgaaccgtaaccgctctggctcgggggtttgttcctccagactccagtggccataagcccataaccttaacctgccaaacgtttctaagtttagaacttgtttatccttttttttcatgtaaggaaggaaaacttgcataaccttgatcgtgcgtgtggcatgtacgatgtttagcgtaaactgtaaagtaagtgtagtgcagtgttgtgcttctttattttactgaacacgtagtggtttanaaaaaagaaaaaaaaaaaaaaaactcgagggggggcccgggacccaattcgccctatagtgagtcgtattacaattcactgggcgtcgttttancacgtcgtgactgggaaaaccctggcgttacccaacttaatcgncttgcagcacatccccttttcgcagctgggtaatagcggagaggcccgcacgatcgcctttcaaaaagtgcgcagctgaatggcgn

SEQ ID NO: 10762 - DNA, 879 bp, Zea mays
  misc_feature: Ceres CLONE 1336539-F
  misc_feature: Encodes the peptide sequence at SEQ ID NO. 10763
  misc_feature (587)..(587): n is a, c, t, g, unknown, or other
tcataactagtggatcccccgggctgcaggcccccccccccccccccactcctactctgagatcatcaacgagagcgtgattgagtcggtggactcgctgaacccgttcatgcacgcccgtggggtcgccttcatggtggacaactgctccacaacggctcgcctgggatccaggaagtgggcgcctcgcttcgactacatcctgacgcagcaggccttcgtggcggtggacaaggacgccccgatcaaccaggacctcatcagcaacttcttgtcggaccctgtccatggtgccattgaggtctgcgccgagctgaggcccaccgtcgacatctctgtgcctgccaacgccgactttgtgcgcccggagctccggcagtcttcctagattgaggcagtgagcggagagggagagggagagagaaagagaggatttcgtgtcccgagttagaacagagtgctgtatgttttgtgcgactgtttgtaagtcaagtctgaactgtgaacctatgtgagcttctatcagaggacccggagaaagcctggccatctgtttccggaataaaatgggtccttcgggatacaanaacccccacggccccccacaattcctagccctctgtgagccccttaagtatgtgaaaggcttggagtcccttccctatctctactaccctcataagttcctaagcgaccaaacccgtatccataacgcatccatttggggggcctcttggggggagggggggtacaatttcccccctcacggggggaaaatccttcgtgcggctgcgcccttatcgctgcggcatagcggaaacccctgccgcacgtccatttacagcggggcggatcacgccctgtgctcctgaaagataa

SEQ ID NO: 10763 - protein, 92 aa, Zea mays
  misc_feature: Ceres CLONE 1336539-F
  misc_feature (1)..(89): Pfam Name: IlvC Pfam Description: Acetohydroxy acid isomeroreductase, catalytic domain
  misc_feature: SWISSPROT Homolog: EC 1.1.1.86 Ketol-acid reductoisomerase
MHARGVAFMVDNCSTTARLGSRKWAPRFDYILTQQAFVAVDKDAPINQDLISNFLSDPVHGAIEVCAELRPTVDISVPANADFVRPELRQSS

SEQ ID NO: 10764 - DNA, 898 bp, Zea mays
  misc_feature: Ceres CLONE 1336556-F
  misc_feature: Encodes the peptide sequence at SEQ ID NO. 10765
  misc_feature (872)..(872): n is a, c, t, g, unknown, or other
  misc_feature (873)..(873): n is a, c, t, g, unknown, or other
  misc_feature (874)..(874): n is a, c, t, g, unknown, or other
  misc_feature (875)..(875): n is a, c, t, g, unknown, or other
  misc_feature (876)..(876): n is a, c, t, g, unknown, or other
  misc_feature (877)..(877): n is a, c, t, g, unknown, or other
  misc_feature (879)..(879): n is a, c, t, g, unknown, or other
  misc_feature (880)..(880): n is a, c, t, g, unknown, or other
  misc_feature (881)..(881): n is a, c, t, g, unknown, or other
  misc_feature (882)..(882): n is a, c, t, g, unknown, or other
  misc_feature (883)..(883): n is a, c, t, g, unknown, or other
  misc_feature (884)..(884): n is a, c, t, g, unknown, or other
  misc_feature (885)..(885): n is a, c, t, g, unknown, or other
  misc_feature (886)..(886): n is a, c, t, g, unknown, or other
tccccgcggtggcggccgctctagaactagtggatcccccgggctgcaggctggtgccggagagagagagagctcactagtccccccccccccccccaacgcccgcagcgccggtggagacctccccgtcctcggcgaggaaggaagaactgctgcctgtggaggaaaagatctcggaattaagtgaatcacaatcagagcttctagggaggctccgtgggcttaaggaggatttgctgagttggaggagtaatttagactcccaagtgacgaaatacaaagtggaactctctgacatcaagagtgcactcaataatgaaatagagcagcttcgctcagatttccaagagctgaggaccacccttaagaagcagcaggaagatgtgtcacttagcttaaagaatttggggcttcaagatgctaccgaaaatgatgggaacaaaggaaatggagacgacacaaatgaggtcttgtcagctaacttggggaacttgaaactggatggttcttctgaaaactatgatgaaagcagagactcaaaggaggacaaggaaaacaccgacactgctggtgatggcatcgtcgacaaagctactaaggagacgagctcaactgatgaacaattctaacgcaggaaactgaactacattgttcgtgtctcagctgtagaaattctaggaacagcgatacattagttcctgtaagagagcgagtccatgctttgctattgctcagtcgggttggttatgggactctattgggacctgtgagtcgtgaggatccaaatctcctctagaatgtagcaactgaaagttacgatatggtatcacgggcatttgctcacctgaatgcatttcagctggtttgtcaannnnnnannnnnnnnaaaaaaaaaaaa

SEQ ID NO: 10765 - protein, 61 aa, Zea mays
  misc_feature: Ceres CLONE 1336556-F
PRGGGRSRTSGSPGLQAGAGERESSLVPPPPPNARSAGGDLPVLGEEGRTAACGGKDLGIK

SEQ ID NO: 10766 - DNA, 892 bp, Zea mays
  misc_feature: Ceres CLONE 1336607-F
  misc_feature: SWISSPROT Homolog: EC 3.2.1.23 Beta-galactosidase
  misc_feature (567)..(567): n is a, c, t, g, unknown, or other
  misc_feature (668)..(668): n is a, c, t, g, unknown, or other
ggcggccgctctagaactagtggatcccccgggctgcaggaattcggcaccaggagagagagagagagagctcactagtcccccccccccccccccctgctccgcacaaagaaggaaaaacaaaagtatagcggctcaagacagcgtttcaagatcgtttatttacaaccagactagcagaagatgctctctatatctaccgtcgccttgtattattagtagctgaagtaagttcatgtgaatgttgtcgtgttcccgcagctgcgacgccatggcgtgcgacgtgcgcgttcttggctgtcgcagctgctgaaacttttgatggtttttaacctgtaagctgggggggatgaagtaaattattttgttctacaatagtgcgcgagaagttccttggcaaaaaaaaaaaaaaaaaaaaaaactcgagggggggcccggtacccaattcgccctatagggagtcgtattacaattcactggccgtcgttttacaacgtcgtaactgggaaaaccctggcgttacccaacttaatcgccttgcagcacatccccctttcgccagctggngtaatagcgaagaggcccgcaccgatcgcccttcccaacagttgcgcagcctgaatggcgaatggcaaattgtaagcgttaatattttgttaaaattcgcngtaaatttttgttacatcagctcattttttaacaataggccgaaatcggcaaaatcccttataatcaaaagaaagaccgagatagggtgagtgtttgtcccagttggacaagagtcactattaaagacgtggactccacgtcaagggcgaaaaccgtctatcagggcgatggccctacgtgacatcccttatcaagtttttggggtcgagtggcgtaagcataa

SEQ ID NO: 10767 - DNA, 798 bp, Zea mays
  misc_feature: Ceres CLONE 1336650-F
  misc_feature: Encodes the peptide sequence at SEQ ID NO. 10768
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (703)..(703): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (724)..(724): n is a, c, t, g, unknown, or other
  misc_feature (730)..(730): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
gctctataactagtggatcccccgggctgcaggccccccccccctccgacggcgccgacaaaaccagaccaccaaacaagtgccagcgccctctcgcagtcgccgcaatggagagcaccttcatcatgatcaagcctgacggcgtccagaggggcctcattggtgagatcatcagccgttttgagaagaagggcttctacctcaaggccttgaagcttgtcaacgtggagaggtcgtttgccgagaagcactacgccgatctcgcctccaagcccttcttccagggcctcgttgactacatcatctctggccctgtggtggccatggtctgggagggcaagagcgtcgtcacaactggccgcaagatcattggcgccactaaccccctggcttctgagcccggcaccatccgtggcgactttgctgtcgacattggcaggaatgtcattcatggaagtgacagcattgagagtgctaataaggagattgccctgtggttccccgagggccctgctgattggcagagcagccagcacccctggatctacgagaagtaaacatggaaagtttcacatcaaaccttgagagccagaggaaaaatgtcaccatttgtgctttagcaatgttttcgaaaagattatgatctgtatcttggaaccttatttcaatggaccaaatttctttctttgccatgtttnnnnanaaaaaaaaaaaaaaaannnanacaaanggaaaaaaaannnnaaaaaactcgagggggggcccggtacccaatcgccctatagggagtcgtattac

SEQ ID NO: 10768 - protein, 149 aa, Zea mays
  misc_feature: Ceres CLONE 1336650-F
  misc_feature (2)..(134): Pfam Name: NDK Pfam Description: Nucleoside diphosphate kinase
  misc_feature: SWISSPROT Homolog: EC 2.7.4.6 Nucleoside-diphosphate kinase
MESTFIMIKPDGVQRGLIGEIISRFEKKGFYLKALKLVNVERSFAEKHYADLASKPFFQGLVDYIISGPVVAMVWEGKSVVTTGRKIIGATNPLASEPGTIRGDFAVDIGRNVIHGSDSIESANKEIALWFPEGPADWQSSQHPWIYEK

SEQ ID NO: 10769 - DNA, 860 bp, Zea mays
  misc_feature: Ceres CLONE 1336654-F
  misc_feature: SWISSPROT Homolog: EC 3.2.1.23 Beta-galactosidase
tacccgcggtggcggccgctctagaactagtggatcccccgggctgcaggcccccccccccccccgtcgaggcgtgggacgccgtggacctcatgttggcgtaggccggagtacgccgtagcagggctgcaggggggcccagccccagccccagcgcgcgcgtgccgtcgctgtgaacggccgccgcagctgttttggatcgagtaataatattattagtagtataatgtttctccaagcagctaagctaattgcatgccttgctgggtatggtggtattactagcactgctatctaggagtatgtactagcaggatgggtttatctagcttgttgctaaacagataattaatctaagaaaacagagatatggtctgttaattgccggctctaactaatgcccggcgataatctgttaggctacctcagattcaccatctccatttcttattttaaactcattttcctcgtctattattttgaactccattatataaatgcagtctacatattgtacaacaaaaaaaaaaaaaaaaaaaactcgagggggggcccggtacccaattcgccctatagtgagtcgtattacaattcactggccgtcgttttacaacgtcgtgactgggaaaaccctggcgttacccaacttaatcgccttgcagcacatccccctttcgccagttggcgtaatagcgaaaaggcccgcaccgatcgcccttcccaacagttgcgcagcctgaatggcgaatggcaaattgtaagcgttaatattttgttacaattcgcgttaaatttttgttaaatcagctcattttttaccaataggccgaaatcggcaaatcccttataatcaaaagatg

SEQ ID NO: 10770 - DNA, 809 bp, Zea mays
  misc_feature: Ceres CLONE 1336681-F
cgggctgcaggaattcggcacgagagagagagagctcactagtccccccccccccccccccccatgcattttgttttgtgttacattgagcaattgaaactatgagctagtgaaataatgtcgatgtataggagcaagaggagtaaatgtagcttttatgcccaggtcgtttagaacacctggtttaggtaattatattttactgcattaaatattttttccttcttgcatacagatcagttgctctctttgcaaagaaacaatagaacgtgtgaggtgggatcttcataaaggcgaaaagtgcccacaaagaatcgtcgcttgtgaatattgcgagtttgaattgcctgcagttgatctccatgagcatcaggatgtatgtggaaaccgaacagaactttgccaaacatgcaggaagtatattagattgcgtgaatggatagggcacgaaatacagtgccatacaggctcaaatggttctgcagacacatccagtgccagagcaattccagagagagaactacgaccgccgccgccggtgcggccagcacgaccagcacgtcctgctcatgcttcaccacacaagcggctcctcttcacaatcgctgtcattggaatagcagttatggttggctccatactgttccaaagggacgagagtttctagctccagtggccatggacttactctggctggcatggtgtttcttgaccgggagagcatgccacaggaggggtatttatgtatataaatcctccaatcaggcataaatcgagtttgttggagagcaaaaaaaacaaacaaaaca

SEQ ID NO: 10771 - DNA, 810 bp, Zea mays
  misc_feature: Ceres CLONE 1336688-F
  misc_feature: Encodes the peptide sequence at SEQ ID NO. 10772
  misc_feature (641)..(641): n is a, c, t, g, unknown, or other
  misc_feature (721)..(721): n is a, c, t, g, unknown, or other
agtggatcccccgggctgcaggcccccccccccccccaattccaaccccagctttgactgccctcgcttggtgctcagttctttcctctgctcctccgcctcttctcgcacctcggcgcctccttcggcaactgcgagcgagatggaggcgcaagacgactgcaagtggcggcagatcccggcgttcggcgactggaacgtgtgggacggcgacatgcccgtcacccagtacttccaggcaggggccttcttcttcgcggcgccggcggagaagggcgacgcggatctcttcaaggtgccccagttgcctgccaagccctacggctacaagaagtgcgttgttcgagtgaagggggagaaagaaaccgctgtgccgccggcggcgaggaagggacgcaggaggcgctgcgtgagcgagcagcacaagtggaagcccaagggagctgtggacgaggacctgtacaagatctccccgcagcttctctgcaaggtgaagaagaagaagctgctgaggaatttgcttggagggtgcctgggcttgggctgcattgcctgagagtgagagatgcagagcttaataagtttcttgaaagttcgcttgcttgatgctctggagagagttggatagttggctacgctantatgagattaatggaaacttactactgcttctgaactcgttttgaatgtaaactaccctggaatccatctttccaaccgnggcttcagggctaactagggggggttatttattccgaaaatggtaaattccaaaaaaaaaaaaaaactcgagggggggcccgttcccta

SEQ ID NO: 10772 - protein, 137 aa, Zea mays
  misc_feature: Ceres CLONE 1336688-F
MEAQDDCKWRQIPAFGDWNVWDGDMPVTQYFQAGAFFFAAPAEKGDADLFKVPQLPAKPYGYKKCVVRVKGEKETAVPPAARKGRRRRCVSEQHKWKPKGAVDEDLYKISPQLLCKVKKKKLLRNLLGGCLGLGCIA

SEQ ID NO: 10773 - DNA, 846 bp, Zea mays
  misc_feature: Ceres CLONE 1338739-F
  misc_feature: Encodes the peptide sequence at SEQ ID NO. 10774
  misc_feature (766)..(766): n is a, c, t, g, unknown, or other
acccgcggtggcggccgctctagaactagtggatcccccgggctgcagggagagagagagagagagagctcactagtcccccccccccccccctctacttggtgacccatcaggagggatgagtgaaatggacatgattgcagcgcagcaagaagaggctgatctgaatgctgctattgctgctagcttgatggacactgggggtccatttgccagctatgatgtagatcaagaatacagcaactcacaagatgctcctgccgttggaccagctcggagcaaagataataaccaagaagaagctgaattagactatacacagagaaactgccctccatttcagtggagttatgctttttttggttccgaacgccgtacgtatacaaaatgcatagtctgaactaaaaaaaaaaaaaaaaaaaactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcaaattgtaagcgttaatattttgttaaaattcgcgttaaatttttgttaaatcagctcattttttaaccaataggccgaaatcggcaaaatcccttataaatcaaaagaatagaccgagataggggttgangtgttgttccagttttggaacagagtccactattaaagaacgtggactccaacgtacaagggcgaaaaaccgtcctatcg

SEQ ID NO: 10774 - protein, 93 aa, Zea mays
  misc_feature: Ceres CLONE 1338739-F
MSEMDMIAAQQEEADLNAAIAASLMDTGGPFASYDVDQEYSNSQDAPAVGPARSKDNNQEEAELDYTQRNCPPFQWSYAFFGSERRTYTKCIV

SEQ ID NO: 10775 - DNA, 847 bp, Zea mays
  misc_feature: Ceres CLONE 1338752-F
  misc_feature: Encodes the peptide sequence at SEQ ID NO. 10776
  misc_feature (463)..(463): n is a, c, t, g, unknown, or other
ggagctccccgcggtggcggccgctctagaactagtggatcccccgggctgcaggcccccccccccccccatcctcgccaatgtgaccaccagcaacgtgtgtaacgctgggatgactccaacggagcagccggctcactcttcggcgtttcggttggagccgtggtggctgacatggacggagctggttgccttgtctctcttcacgctgtctttcttcgtctaggctatctgcggcaaaggctgaacgttgttgccatgcgtctgtcggtagaatctggccctctgatgcctagttggatgttgtgagaaatatctgcagtgtttgcgcgacttcgatctgtaactggctggatttgtaagggcaaactctagggtaacactgatctgtgttagacggaagatcaggaaacatttgtacttcgtcaaacttttgcaaagataatttcttctgttatcgccngtggactccaacgacaaagggcgaaaaaaccgtctatcaaggcgatggaccactacgtgaaccatcaccctagtcaagttttttggggtcgcggggggggggggcagtaacccagttcccccaagggaggccccgatttaaatcttgtgggcgaaattttacaaacgtggggaggaaaaaaccctggaaagccccaggtaagtgcgctagggcactggcccttgtagcgatctgctgaaatataaaaaagcacccgacgagcttactttccacaatattgggcaccctagatggcacatgtcaaataaaagcgcgcaaaatctcgataagattcgcgttcaatataggttcaaacaggtatctgttcatgcaataggcccatgc

SEQ ID NO: 10776 - protein, 74 aa, Zea mays
  misc_feature: Ceres CLONE 1338752-F
ELPAVAAALELVDPPGCRPPPPPILANVTTSNVCNAGMTPTEQPAHSSAFRLEPWWLTWTELVALSLFTLSFFV

SEQ ID NO: 10777 - DNA, 901 bp, Zea mays
  misc_feature: Ceres CLONE 1338764-F
gctccccgcggtggcggccgctctatactagtggatcccccgggctgcaggaattccgcacgagagagagagctcactagtccccccccccccccctcgcctcggcctccctcgccgccgccgatttcggttgcctattctgttacatctccatatggatactgggttctgtgctccaaaatatgaattcactgctctgcaacgcgtgagactcactcgtgcgttatgtctaactctgagtcatgcggcacggtaagcgtgtgtatgtatggagtaggccgcgccataaggagcgattgatgtgtgccatggtcgcgtgatcagtgattcaaagaggcactgtggcgacggccatcatgaactaccctgctgcgtttgtcgactatcagtgatacgatttattttgattcccgatgcaatcgtttttatgtgcagtaacgaatgtcttttggggggctccacgggcctgctcccactcgattctagacacgaattttagttcactgccgcgccagttgtccctagcgctgagaatggtcataacccgtgctgactgcaaaataagtcgcctttcagcacatgcccttttcgaaatggtggataactgcttcaaaagggcgactgccatcagccacattccaaaaggttgagcaactctaaaggtgctatcgcccaatctggcccgggtaaaatttctctccaaacaccaaatcatatttttcgataaccaagtaccattttctaagcgaaacgttaaaatcccctaaatccttcttcggtcatctccacttaccgggatatggttctagggcttgccccaggttgcaaccacacctcccctgtataaaaagggatcgcaacttggtaagggggaatacactatatataggggccgccccat

SEQ ID NO: 10778 - DNA, 874 bp, Zea mays
  misc_feature: Ceres CLONE 1338785-F
  misc_feature: Translation starting site: 388
  misc_feature: Pfam Name: Copper-bind Pfam Description: Copper binding proteins, plastocyanin/azurin family
  misc_feature (311)..(311): n is a, c, t, g, unknown, or other
  misc_feature (738)..(738): n is a, c, t, g, unknown, or other
tccccgcggtggcggccgctctagaactagtggatcccccgggctgcaggaatacagagagatcactaatagacagagagctcactagtagacctcccctgaaaacgaaaaatttaaaagccgaatcttattcgctactctaaaaaaatcttcttcatgttcatcgtaacctcatccagcgttgaaatcccatctttcaccgctcttatagcctcaaccatcaaatgcatccgccaccgacataatccaaactgctgctgttgcatcaccgaagcttacagtgaattcttctctaaagaacttcggtatanctgtacgtaacgtttgcagattcaattgttttggccggaaacaccatgccaatacaagttctcttggaacgatgggatgatccgttatcttttattcccatcgacttctcgatacctaaaggagacaagattgtgctctagaacaatgctgcatacccacacgatgttgtcttgcgatgaagacgagatccctggtggagtctacgtggacaagatctcgatgaacatatgagatctactcatcgctgcgacagagacatattaagttgctttgaccgaatcagggacttactgcttctactgtgcttcacatcaggaatgtatgctatgctgcatcagagtcaccggtaactaacacgtgtgtgtgactaggatgtcgtagtatcggactcaattagatgctcgtctttcacattcgtacatactnacatagaggggtttgttattctaaacagtgctgaatcatatggtagcgtgattgatgctgtactactgacttgctcatagacgggtgttcgtgacttatgaacatactcaagaaatctgagacgatgccgtaaccc

SEQ ID NO: 10779 - DNA, 877 bp, Zea mays
  misc_feature: Ceres CLONE 1338794-F
  misc_feature: Translation starting site: 228
  misc_feature: SWISSPROT Homolog: EC 3.2.1.23 Beta-galactosidase
ccccgcggtggcggccgctctataactagtggatcccccgggctgcaggaattcggcacgagagagagagagagctcactagtccccccccccccccgtgctggagagagcagacctgccagacgtctgatgacgcgcagttcatgcgcacagaggcgatccgtaattttgtgacgaggagcgagtgtatgtaacacgcagaaaacatagcctgcaaatatataaatatggtatatccgacaaaaaaaaaaaaaaaaaaaaaaaaaaaaaaaaaaaaaaaaaaaaaaaaaaaaaaaagaaaaaaaaaagaaaaaaaaactcgggggggggcccgggacccaattcgccctatagggagtcgtattacaattcactggccggcgttttacaacgtcgtggctggaaaaacccgggggttacccaacttaatcgccttggagcacatccccctttccccatttgggggtaattagcgaagaggcccgcaccgatcgcccttcccaacagttgcccagcctgaatggggaagggcaaattgtaagcgttaatatttttgtaaaattcgcgtaaaatttttggttaatcagctcatttttttaccaataggccgaaatcggaaaaatcccttattattcaaaaaatacaccgagataggtgtgagtggtgtcccagttgagaaaaagagtccccttttaaaaaacggggcccccacggcaaagggggaaaaccgccttatagggggatggccccctacgtggaccatccccctaatcaatttttttgggccaaggggccgaaagcctatatcggaaccttaaggagccccccatttaactttgcgggaaaacccgctaaggtggcaaaaagaaggaaaaag

SEQ ID NO: 10780 - DNA, 923 bp, Zea mays
  misc_feature: Ceres CLONE 1338797-F
  misc_feature: Pfam Name: UCH Pfam Description: Ubiquitin carboxyl-terminal hydrolase
  misc_feature: SWISSPROT Homolog: EC 3.2.1.23 Beta-galactosidase
  misc_feature: SWISSPROT Homolog: EC 3.1.2.15 Ubiquitin thiolesterase
  misc_feature (529)..(529): n is a, c, t, g, unknown, or other
  misc_feature (708)..(708): n is a, c, t, g, unknown, or other
tggagctccccgcggtggcggccgctctataactagtggatcccccgggctgcaggaattcggcaccaggcaagttatacggtctcgcggccgtcgtggagcactacgggaagtgtggaggagggcactacgcagtctacaggagagtcgcgtcgaatcctgaccctgatgatccaggcaaacctgttgcaggccttggcgagcggcggttttacatctcagacggctacgtgtcaaaagttccagaggaggatgtactgcgcgcggaggccacgctccttttctacgagagattgtagccgcttgttgagtagctaacgtgtgcatcataacaaaatctaggacagttttgttgtgaggagtctgatgttcttatcggtaccgtgagcttccaagtagacgaggaaactagctgtggcacaaaaaacaaagcctctctgcatctcgacgtggactgcaggcgtgtcttaggcagtgtggcctactttttttttgggtccttgcaaacgctaatataattcttcatgcnatacgtcagtgatgtcttcctcttgagaattggaacaagagtccgctattaaagaacgtggaatctcgaggggggggccggtacccaattcgccctatagtgagtcgtatatacattcactggccgtcgttttacaacgtggggactgggagaacccctgcgctacccagcttactcgncgtgaagcacatcccccttttctcagctgaagtattaagcgagagggccgcaccgatcggccatcccaacagttgcgcagcctgaatggcgaatgccaaatttaagccgttatatttgttacaactcgcggtaaatttttgtgaatcagctcattttctaacaataggccgtaatcggcaaatgccttataaacccaagatgagacgggataggg

SEQ ID NO: 10781 - DNA, 890 bp, Zea mays
  misc_feature: Ceres CLONE 1338822-F
  misc_feature: Encodes the peptide sequence at SEQ ID NO. 10782
ccccgcggtggcggccgctctacaactagtggatcccccgggctgcattaacgccgtacaagtcgaacatcccgtgtaggcagatgacaaaagaagtgctggagtgtgacgtgtacgaggaggtcgagagaatccaaaacccaaacctcgtgtaccctgactactatctcaacccgattcatgcctacgaccaatggaatctctgatggctggctgccacagaggccgagcctgcaacaatgacgatcgcaaagagggccatacctgaggctacatcaatctaagaggtcaaccaagtcatccgcggcaactggctgaatgtaattgaggagcatcatctgaatgactgggggagctctctcgtacacctggacattgcctgctctgttgaagtaagcatcagatagctcgacgacaacttcccatcagctcacgatgcatgtctctgaatgatgcaggaggtcgacctatcagcgtactgtcttgctgtggaggctcacaaggaagaagaactgtcaacgccaaagcctattctctgggttcatgccaatggtgaaacgaaccgcctgtcttcacatacaattgacctcgcctcccttgcctatgagcacgagcgagaaccggattggggatcgaagcgttccaggcccctcagcccaggagggacaatcgccctatcagacaaattgccggaggaaagcacttgaagaaatatccccagttgtggtccaccttgatgaagaccacaaagccgttgtcctgggcaggttcctggtacttcaacttgagtgaaatcacacacgtattgccagattaggacttctctcattgggtcaacatcgaaagggggccgacattcccttgagtgcttcaaaaaacaaaagaataca

SEQ ID NO: 10782 - protein, 84 aa, Zea mays
  misc_feature: Ceres CLONE 1338822-F
MQEVDLSAYCLAVEAHKEEELSTPKPILWVHANGETNRLSSHTIDLASLAYEHEREPDWGSKRSRPLSPGGTIALSDKLPEEST

SEQ ID NO: 10783 - DNA, 903 bp, Zea mays
  misc_feature: Ceres CLONE 1338823-F
  misc_feature: Encodes the peptide sequence at SEQ ID NO. 10784
aaactggagctccaccgcggtggcggccgctctataattagtggatcccccgggctgcagggggtgggccaggtacccaattcgccgtatagtgagtcgtattacaattcactggccgtcgttttacaacgacgtgactgtgaaaaacccgtgcttaaccaaatttaatcagcttgcgttaaagaccccattccttcaatggcgtaataaataaacaagacgtacgaatcgcccattccgacggcgtcacttactagagggtatatggacaatggtattccttaagattttgttagaaggggcggtacattattcaaattgcactacattgtttcactattaagcctcaaagctcggacgtccttcattaagagattggtaaaaccctggcgttacccaacttaatcgccttgcagcacatccccctttcgccagctggcgtaatagcgaagaggcccgcaccgatcgcccttcccaacagttgcgcagcctgaatggcgaatggcaaattgtaagcgttaatattttgttaaaattcgcgttatatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctattcgggcgatggcccactacgtgaaccatcaccctaatcaagttttttgggtgcgagcggccgtaaagcactaaatcggaaccctaaagggagcccccgatttagagcttgacggggaaaagccgggaagggggcgagaaaggaagggaagaaagccaaaggagcgggctgctaaggcccctgctaagtgaa

SEQ ID NO: 10784 - protein, 55 aa, Zea mays
  misc_feature: Ceres CLONE 1338823-F
KLELHRGGGRSIISGSPGLQGVGQVPNSPYSESYYNSLAVVLQRRDCEKPVLNQI

SEQ ID NO: 10785 - DNA, 903 bp, Zea mays; identical to SEQ ID NO: 10783
  misc_feature: Ceres CLONE 1338823-F2
  misc_feature: SWISSPROT Homolog: EC 3.2.1.23 Beta-galactosidase

SEQ ID NO: 10786 - DNA, 1035 bp, Zea mays
  misc_feature: Ceres CLONE 1338827-F
  misc_feature: SWISSPROT Homolog: EC 3.2.1.23 Beta-galactosidase
  misc_feature (1)..(1): n is a, c, t, g, unknown, or other
  misc_feature (109)..(109): n is a, c, t, g, unknown, or other
ncctcaccctccccttttctcggggcccgacctttttcaaaatggagctcccccgggggcggcgctctccataaaggacccccggactgattgttcccaaaagaggcgnattacaattactggccgccggtttcaacgtccggatttttaccccctggagataccaacttaatcgccttgcagcacatccccctttcgccaggtggcgtaatagcgaagagggccggaccgatcggccttcccaacagttgagcagcctgaatggtgaatggcaaattgtaaccgataatattttgttaaaattcgcgttaaatttttgttaaatcagctcattttttaaccaataggcctattatcagcaaatcccttataaatcaaaacaatagaccgatatatggttgagcgttgccccagtttggaacaagagtccactattaaagaacgtgaactgcaacgtcaaagggcaaaaaaccgactatcaaggcgatggcccactacgtgaaccatcaccctaatcaagtttttttgcggcgcaaggtgcccgcgaaagcactatcaccgtaaaccttatagtggaggcccccgcatttataaatttgaccggggaaaagacgggggaaccgtgggcctagaaaggggaaggcaaagaaaaagccgaaaaggagcggttgagactaatggccgcttgggcaaggcggcaaacgggatcactcctgggtgggataatcaacccaacatccccgtccgcggtttaaatgagcaacaactaaacggttccctgtaccggaggttccttttttccagggaaaatgggcgccggcaaccccctattttgagttacttactcctgaagaacatgcgaaatatgtactccggcccacggagaacaactcaccctgctaaactgcttctcgtctatatctgcaaatacgcagagaaagtacttattcaaaagttgacaggggtcggccataattccccttattgggcggaatattgacctcctagactttggtcacacagaacaaacctggg

SEQ ID NO: 10787 - DNA, 880 bp, Zea mays
  misc_feature: Ceres CLONE 1338847-F
  misc_feature: Encodes the peptide sequence at SEQ ID NO. 10788
  misc_feature (639)..(639): n is a, c, t, g, unknown, or other
  misc_feature (843)..(843): n is a, c, t, g, unknown, or other
tggagctccccgcggtggcggccgctctagaactagtggatcccccgggctgcaggaattcggcacgagagtccccccccccccagacccgaccgcagcagcccggggcaacaagcgaaccgacggcggcgatggggatcggtgagcacttcgagggcgtcaagcagcactgggcgagcaacttcgccttcctcgactacttcaagaaggtctacggccgcgccgagcccctccccaagtggtccgacgccgacgtcgacgagttcatcgcatccgacccggtctacgggccccagctcaaggccctgcgggagtcgaggaagttcgcgctcgccggggccctcgtcggcgccgcccacctcggcggcgtcgcgctcaagtactccaaggcgccgcacggcgtcctgctggcgaccggcttcggcgcgatcaccggcgccgtgctgggatccgaggtggcggaccactggtaccagctctacgagatggacaagcagggggccaacctcagggtcatctactggtgggagggacaggtctcaggccagaagagctgaaccacatcgagtgatgcctattctactgagcacaccagcgtgacaacaaaaacattgacgtctctcatgcccgagtcttagnttttctttccctagtttctctaataagtgtggattggttgaggaagcaactgggacatgcatttttctctccgtcatgggtatggtcatccatgggcatctggtgtaacagcaatcctatccgtttcgagatatggtttctcaacaaaaaaaaaaaaaaactcgaggggggccccggaccaatcgccctaagtgagcgtatacnattcctggcgtcgtttaacacgcgggactggaaaccc

SEQ ID NO: 10788 - protein, 141 aa, Zea mays
  misc_feature: Ceres CLONE 1338847-F
  misc_feature (66)..(110): Pfam Name: Rick_17kDa_Anti Pfam Description: Rickettsia 17 kDa surface antigen
MGIGEHFEGVKQHWASNFAFLDYFKKVYGRAEPLPKWSDADVDEFIASDPVYGPQLKALRESRKFALAGALVGAAHLGGVALKYSKAPHGVLLATGFGAITGAVLGSEVADHWYQLYEMDKQGANLRVIYWWEGQVSGQKS

SEQ ID NO: 10789 - DNA, 912 bp, Zea mays
  misc_feature: Ceres CLONE 1338864-F
  misc_feature: Encodes the peptide sequence at SEQ ID NO. 10790
  misc_feature (607)..(607): n is a, c, t, g, unknown, or other
  misc_feature (699)..(699): n is a, c, t, g, unknown, or other
  misc_feature (702)..(702): n is a, c, t, g, unknown, or other
  misc_feature (706)..(706): n is a, c, t, g, unknown, or other
  misc_feature (799)..(799): n is a, c, t, g, unknown, or other
  misc_feature (800)..(800): n is a, c, t, g, unknown, or other
  misc_feature (828)..(828): n is a, c, t, g, unknown, or other
  misc_feature (887)..(887): n is a, c, t, g, unknown, or other
tggagctccccgcggtggcggccgctctagaactagtggatcccccgggctgcaggcccccccccggagccaccagcacactcgtctctttcctctaccgccgccaccatcgcctcgcggccgcctgccgctccgctcggaagtttttggtgaagattttttgaagctgagaagatggtgctgaagacggaactctgccgcttcagtggccagaagatctatcctgggaaaggcatccggtttattcgtgctgattctcaggttttcctttttgccaactctaaatgcaagcgctacttccacaaccgcctgaagcctgcaaagcttacctggacagcaatgtacaggaagcagcacaagaaggacatccatgctgaagctgtcaagaagaggcgccgtgccaccaagaagccatactcgaggtccattgtgggtgcttccttggaagtgatccagaagaagagagctgagaagcctgaggtccgtgatgctgctagagaagctgctcttcgtgagatcaaggagcgcatcaagaagaccaaggatgagaagaaggcgaagaaggctgaggtgtccaagtcccagaaggcgcagacgaagggtgctngtcagaagggtcccaagacccccagtgggtggcggcggtggcaacgctgaaaaggacgagtgtcattccgagactcatcaagcccaccttgnagnaccntgggtattttgtatttctttcagagtacttgtgactctaattttgcatcttatatattgggagaatgatcgccgtcgttctatgatttcctcnnaaaaaaaaaaaaaggaaaaaaaaaaaanaaactcgagggggccccgtaaccatatcgctttagggagccgtatacaatccctggcgncggtttacacgtctgactgggaacc

SEQ ID NO: 10790 - protein, 160 aa, Zea mays
  misc_feature: Ceres CLONE 1338864-F
  misc_feature (3)..(73): Pfam Name: Ribosomal_L24e Pfam Description: Ribosomal protein L24e
  misc_feature (145)..(145): Xaa is any aa, unknown, or other
MVLKTELCRFSGQKIYPGKGIRFIRADSQVFLFANSKCKRYFHNRLKPAKLTWTAMYRKQHKKDIHAEAVKKRRRATKKPYSRSIVGASLEVIQKKRAEKPEVRDAAREAALREIKERIKKTKDEKKAKKAEVSKSQKAQTKGAXQKGPKTPSGWRRWQR

SEQ ID NO: 10791 - DNA, 763 bp, Zea mays
  misc_feature: Ceres CLONE 1338924-F
  misc_feature: Encodes the peptide sequence at SEQ ID NO. 10792
gctctagaactagtggatcccccgggctgcagggagagagagagagctcactagtccccccccccccccccccccacggatccaccggagagatctggtctgccattcccacgctccttcctgtgaaccacaaacctaacgcggagcggcgcgggccggccgccgggcgaggtgcgcgtacctgccgtcgatcgtcgccggatccatccaccatgggcggtggcaacggccagaagtccaagatggcccgcgagcgcaacttggagaagaacaagggggccaaggggagccagctcgagaccaacaagaaggccatgagcatccagtgcaaagtgtgcatgcaaacattcatgtgtaccacgactgaagtgaagtgcccgggagcacgccgaggccaagcaccccaagacagacgtgtaccagtgcttcccccatctgaagaagtgaaaggcctgaacttagcaaccagtgctgggtttggtcactacgatcgggccagggggcgttccttgtgttgagggtgttcattccgtgttatcttcccggcagtcatgcgtcctgtcctatgttaacctacttaggaaagtgattgtggtgtcacttctagggaaactactgtctgctggtaaaaactggttgggtttcagaacgacgatgattttcgtgtgcaaacagattactggtcccgggggagttgggcccgtttgaaaaaaaaaaaaaaaaaaatcgggggggggcccggtacccattccccctaaagggg

SEQ ID NO: 10792 - protein, 101 aa, Zea mays
  misc_feature: Ceres CLONE 1338924-F
  misc_feature (4)..(56): Pfam Name: DUF1909 Pfam Description: Domain of unknown function (DUF1909)
MGGGNGQKSKMARERNLEKNKGAKGSQLETNKKAMSIQCKVCMQTFMCTTTEVKCPGARRGQAPQDRRVPVLPPSEEVKGLNLATSAGFGHYDRARGRSLC

SEQ ID NO: 10793 - DNA, 619 bp, Zea mays
  misc_feature: Ceres CLONE 1338968-F
  misc_feature (41)..(41): n is a, c, t, g, unknown, or other
  misc_feature (222)..(222): n is a, c, t, g, unknown, or other
  misc_feature (223)..(223): n is a, c, t, g, unknown, or other
ccccgcgggtggcggccgctctagaactagtggatcccccngggctgcaggaattcggcacgaggaggaggagcccgcgacagagaaggtggagaaggctccggcggggaagagcccaagccgagaagcgctcccggcggcagtccaaggaggcggcgagggcagaagggaaaagaaggcgagaaagtcgtggagactacagatctacatcttcaggtgctnngagcagtgaccccgacttcggatcttcgtcagggcatgtcatcatgacttcttcatcaacgattctttcaaaactcggggcggatcgccagttggccgcttaaaaaaaacccccctaccctccggggaatcaaacctggggggccttctctccccgggagtttccaaaaaccccttcccaggggcataaagggggttaaaaaacccccccctctaaaaacttttaaaggccaagggggccccccccaaaaaggggccccccctttttttaaacccccccccgcgggggggaggatttttcccggcaatttaataaaaaaaaaagggggggggcttttttccccaaaaaaaaaaaaaaaaaaaatatggggggggggggcgccgccccccccctctc

SEQ ID NO: 10794 - DNA, 885 bp, Zea mays
  misc_feature: Ceres CLONE 1338979-F
  misc_feature: Encodes the peptide sequence at SEQ ID NO. 10795
  misc_feature (602)..(602): n is a, c, t, g, unknown, or other
  misc_feature (603)..(603): n is a, c, t, g, unknown, or other
  misc_feature (608)..(608): n is a, c, t, g, unknown, or other
  misc_feature (609)..(609): n is a, c, t, g, unknown, or other
aaagtggagctccccgcggtggcggccgctctagaactagtggatcccccgggctgcagggagagagagagctcactagtcccccccccccggaatcgctccctgtctagggttttacccgcgtgccttatatatcctatcacttcccgccccgccgccatcttcgcatttccatctccccgtgggatcccagccgccgccgcaagaagaagagctcggggacttgcaggtctcgagagaagatgccgaaacagatacacgagatcaaggattttcttctcaccgcgaggaggaaggatgcccgatcagtgaagatcaagaggagcaaggatgttgtcaagttcaaggtccgctgctccaagtacttgtacaccctctgcgtattcgatgctgagaaggcaaacaagttgaagcaatctctccccccaggcttgagcgtccaggaggtttgattggatacatgacaacgtcgggtcgaacctctagagcatctttatcatcagcagagcatgctgtttatgtagttttggatcttaagctattagaagtgctggatttgtggatcttgaatttttggagaataccaatttgcctcgttcccnnccccnnccccccccccccctcccccccccccccccccccccccccccctccccaaaactcccagggggggcccgcgacccacccccccccaatacggaccccaaataaaaatttcgcgggccgccgtttttacaacgcgcggcgcctgggaaaaaccccgggccgttccccacccttaaccccccttgcaccccctctcccccccttccgcccgctgggaaaaacaccgcaaaaagggcccccccccctccgccccccctcaccagaagtgggccaaccccc

SEQ ID NO: 10795 - protein, 69 aa, Zea mays; identical to SEQ ID NO: 5090
  misc_feature: Ceres CLONE 1338979-F
  misc_feature (2)..(69): Pfam Name: Ribosomal_L38e Pfam Description: Ribosomal L38e protein family

SEQ ID NO: 10796 - DNA, 894 bp, Zea mays
  misc_feature: Ceres CLONE 1339032-F
tggagctccccgcggtggcggccgctctataactagtggatcccccgggctgcaggaattccccacgagagagagagagagagagctcactagtccccccccccccccccttcccagggtggatttcaatatgaattgacaacttgctattgttgggagcatacctgcagtggatgacttaggctatctctagcagattttcttatctcatgccgtatttgatttcctttttcaaactccactctgcatacagcgacaaacagcgcggtcatctacagtttcgaattcgcctggtataccctatctacgcgagacagtcttatcaccgaacgaactattgagccgaaacctgccggattgaatcgtgttacaaaacataaacacactcgaggggtggcccggaacccagatcgccctatagagagtcctattacaattcactggcccgctgatttgacaatgggagaactgaaaaaacccaggctgttaccaaactttatcgcccttggaattagttccaccctttccccagttggaccaaataggcgaagaaggcccgaaactgattgctcttttccaaaaaattggccccccctgagtggggaaaaggcaaaccggaaagggaaaaaaattttcgctaaaaatccgggggtaaattttttggtaaacccaggtcctttttttaaccaataaggggcgaaagtgccacaaacccctttataaatccccaaaataaaacccttttagaggggtgagaggggttttcccgcttttggaacacaaacccccctattaaaaaccccggtgttccccctcgcccaagggggcaaaaaccccctttttcgggggaaggtgccccaaaaaaggaaacctcccccctatttaagggttttg

SEQ ID NO: 10797 - DNA, 1049 bp, Zea mays
  misc_feature: Ceres CLONE 1339033-F
  misc_feature: Encodes the peptide sequence at SEQ ID NO. 10798
  misc_feature (17)..(17): n is a, c, t, g, unknown, or other
aaaagatataacaacancacccccccaacccccagcaaggaaattccttttttcttaaagtggagctccacgcggtggcggccgctctagactagtggatcccccgggctgcatttagagagagagctcactagtcccccccccccccccatcgcacaaatcctcttcctcgagttctcctcaaccaaattcaaagtcacagcggcgaaactctcggcgatgtctggccgcggcaagggcggaaagggtctgggcaagggcggcgccaagcgccaccggaaggtgctgcgtgacaacatccagggcatcaccaagccggcgatccgcaggctggcgaggaggggcggcgtcaagcgcatctccgggctcatctacgaggagacccgcggagagctcaagatcttcctcgagaacgtcatccgcgacgccgtcacctaataccgaagcacgcccgccgcaagactgggaccgccaataaacgttggcctacgcctctccaagcgccaggggcccgaacccctctcacggttttcggcggggataggtacgccccctctccccggggggccgacctttacttcggatggacgtgtggaccgcctctgagtctgtggttcccttggtactaaactataagccgtgaggagtggcccttttaattcggggcggctcgtttcttcctgtagagggggattggatacactggcaatcggaggcaataagaacttcctaaggccgcgaggggggcattggtaaataacactccgccgggcgtggtaaaatataaaggggaaagggactcctcgagatcgcaggggctttcattggaccgtaatcggcctcctttttgctaaaaaccctggcaaaagaattacctagtgggacactaataggtaacagtacgatcaatccccttatgggtggtgcgctccggaagaacccaattcgctctcctaaaagagtggaggggtaaattatacaacttatccctgggagtgtgagtatttgtatacaaaccgctggcagagagtaacaaccccgagtataag

SEQ ID NO: 10798 - protein, 72 aa, Zea mays
  misc_feature: Ceres CLONE 1339033-F
MSGRGKGGKGLGKGGAKRHRKVLRDNIQGITKPAIRRLARRGGVKRISGLIYEETRGELKIFLENVIRDAVT

SEQ ID NO: 10799 - DNA, 890 bp, Zea mays
  misc_feature: Ceres CLONE 1339139-F
tccccgcggtggcggccgctctagaactagtggatcccccgggctgcaggaattcggcacgagagctcactagtccccccccccccccccccccggagctgtcccaaaaaatgttcctgctcccatctacgaagaactgtgattcggttgtgcctctgcatggataaggataaatttgaatgtggctattgggattttgaccagtgtgtggtggccatgtaccgatctgcgattcattaaaataatttcacatgaagctttcaaagctcttaacctctggggggggcccgctaccccattaacccgatagtgagtaccattacaattaactgggcgtcgttttagacgatcctgacgtgaaaagaaccctggcgatacccgacttgatcgcattgaagcacatccccctttcgccattatggagtaatatggaagaggaccgcaccgcatcgcccttcgcaaaagttgcactcactgaatggcaaatggtaaattgcaagctctaatattttgataaaattcacgtcaaatttgtggtaaatctggtcgttttttaaccgacagacccaaatcgggactgtctcttataaatcataagaatacactgagatagcctggatcgatactgcagagttccaccaagagtccactattgaagagcgcgtactccaatgctgagggctaaagacgtctatcagggcgatggacgactacgtgaagcatatcctactctagttcttttgggacgaagtgcgcaaagcactatatctgaacctacaggagacccgatctagacttaccgtcaaaaccgcgtagggtagagaactaaggaaaaacgaatggtgggggctacgggctggcatctgtatcctggctactggtatcacaaa

SEQ ID NO: 10800 - DNA, 877 bp, Zea mays
  misc_feature: Ceres CLONE 1339146-F
  misc_feature: Encodes the peptide sequence at SEQ ID NO. 10801
  misc_feature (655)..(655): n is a, c, t, g, unknown, or other
  misc_feature (742)..(742): n is a, c, t, g, unknown, or other
  misc_feature (746)..(746): n is a, c, t, g, unknown, or other
tccccgcggtggcggccgctctagaactagtggatcccccgggctgcaggccccccccccccgggacgagtggaggaggcaccctatggcggggaaccagctgcgccacgccacacccgggctcggcatcgccatcgtcgccttcgggatctacctcgtcggcgaggccgcctacaaccgcctctaccgcccctccggcgacaaccaccactagatcgccggcaggatccgtgactcggtcaagaagctggagccaactttaccaagcactggtgctgttgatgtttttacagttttgagctcataaggtcagccatgcccgtgcccacgagagcgactttgcacagaggcccctcctgattcaaacaatcaaaagcaagcatgtgttactattccctatgtcattgatgacttcacttaagaccttcccttctctgacttttacaaatccaggtccccgaccgtgcgccgatcgaacacctggctccggccatgagcacttgtcgtcggcgaccccttcacatagtagcaagcgtacgagatccatcctaaagactactcgagggggggcccggtacccaattcgccctatagtgagtcgtattacaattcactggccgtcgttttacaacgtcgtgactgggaaaaccctggncgtacccaacttaatcgccttgcagcacatccccctttcgccagctggcgtaatagcggagaggcccgcaccgatcgcccttcccancagntgcgcagcctgaatggcgaatggcaaatggtagcgttatattttgttaaaatcgcgttaaatttttgtaaatcagctcattttttaaccatagggcgaaatcggcaaatcccttataatcaaagatagaag

SEQ ID NO: 10801 - protein, 42 aa, Zea mays
  misc_feature: Ceres CLONE 1339146-F
  misc_feature: Functional homolog of the protein sequence given in SEQ ID NO 96870
  misc_feature: Useful for making plants with modulated time to senescence
MAGNQLRHATPGLGIAIVAFGIYLVGEAAYNRLYRPSGDNHH

SEQ ID NO: 10802 - DNA, 909 bp, Zea mays
  misc_feature: Ceres CLONE 1339152-F
  misc_feature: Encodes the peptide sequence at SEQ ID NO. 10803
  misc_feature (744)..(744): n is a, c, t, g, unknown, or other
  misc_feature (798)..(798): n is a, c, t, g, unknown, or other
  misc_feature (846)..(846): n is a, c, t, g, unknown, or other
  misc_feature (849)..(849): n is a, c, t, g, unknown, or other
  misc_feature (866)..(866): n is a, c, t, g, unknown, or other
  misc_feature (899)..(899): n is a, c, t, g, unknown, or other
  misc_feature (908)..(908): n is a, c, t, g, unknown, or other
tccccgcggtggcggccgctctagaactagtggatcccccgggctgcaggaattcggcaccagcccccccccccaaagatttgttgaagtacgctgctgagaacaaaacttcattgacccgtataatgttggacaatatggttgttcctcttgggaatggggatttagacgtttcaatgcttaaagatgcagttcggttgataaacggtagatttgagactgaggcgtctggaaatgtgacagttgatacagtgaagaaaatcggagaaacgggggtcacctatatttcaagtggagcattaacgcactctgtgacggcgcttgacatctctctcaagatagacaccgagctggctcttcaggttggaagacgcacaaatcgtgcttgactcccacagcattacgttgtggacgcaacgcacgcaagcaggatgacagagggaccagcgtggcaaaccagcttaaatagcctaataataacttggcgctgaggcctctgactgcaactacgtgggattcattcttcagtttcatgcacaaacgccgcaatattgttgatcggatcagaataattggtaggacagacaggttttgttctagcgccaagtttgggagcttgcgttctgcggcagataggcagggccagtaggtgtaggtctacctcctcctgggcccagcacagctcgacaggaggtaccaggtagttaggtctactgtaaaacggggatgtcgcactgaactcgncatacccaagacaaatacaaaggtggagatagatgcttatctaactggcattgntgataaaaaaaaaaaaaaaaacttcgaggggggcccggtaccattcgnccntatagtgagcgtatacnattccctggcgtccgtttacacgtcgtgatggnaaaacctgnc

SEQ ID NO: 10803 - protein, 128 aa, Zea mays
  misc_feature: Ceres CLONE 1339152-F
  misc_feature (2)..(112): Pfam Name: QRPTase_C Pfam Description: Quinolinate phosphoribosyl transferase, C-terminal domain
  misc_feature: SWISSPROT Homolog: EC 2.4.2.19 Nicotinate-nucleotide diphosphorylase (carboxylating)
  misc_feature: The sequence is a functional homolog of SEQ ID NO 2 in US patent 7304220
PAVAAALELVDPPGCRNSAPAPPPKDLLKYAAENKTSLTRIMLDNMVVPLGNGDLDVSMLKDAVRLINGRFETEASGNVTVDTVKKIGETGVTYISSGALTHSVTALDISLKIDTELALQVGRRTNRA

SEQ ID NO: 10804 - DNA, 881 bp, Zea mays
  misc_feature: Ceres CLONE 1339162-F
  misc_feature: SWISSPROT Homolog: EC 3.2.1.23 Beta-galactosidase
  misc_feature (837)..(837): n is a, c, t, g, unknown, or other
cgcggtggcggccgctctagaactagtggatcccccgggctgcaggtcgaggccatgtcggcgctaaagaacaggtatggaaatgtctgttcggcgggatacaaacagaggctcggttcttcagtttactcctcgtcatcatccgctgcatccccggacccacctttaaggtgcagatgcttctccctcctctggaagtcggtcaggcccttgccactcccagtgacacccaccttacctctgtggtcgtccggtgacttgaagatgctctccttcttgcgaccggagaagaaccccacctttttggctttccccttggtttgaaactgctgccatgcattctgccttttgttttgggcaaattcaagctgctcaaagcgggattttgatttgaaagcatgtattttcttacgctttgcagctttaacatcctcagggtcacttggttcgatacgaagtttggccggcaagctacgcgcctgaaaatcagatgttgctgcttgttcaattttcctctttattgccatttttgtagcttcagcttccttttcagcttgtcccaaggcatcgggggggggggggggggggcccaactaatttgactcaaggggggccccggaacccattccgcccaatagggagccgaataacaattcacgggccgccgtttaacaacgtcgggatgggaaaaacctggcggttacccaattaattcgcttggcagcacttccccttttcgcagttggggaattaccaaaaaggcccgaacgaatcgcccttcccaacatttgcgcaccctgaaggggaaatggcaatttgaaagcggtaaaatttggntaaattccgcgtaaatttttgtaaatcagctcattttttaccaa

SEQ ID NO: 10805 - DNA, 891 bp, Zea mays
  misc_feature: Ceres CLONE 1339168-F
  misc_feature: Encodes the peptide sequence at SEQ ID NO. 10806
ccccgcggtggcggccgctctagaactagtggatcccccgggctgcaggaattcggcaccaaggagagctcactagtcccccccccccccccccccatcttctttgtgcttgttgcagcactgaattgcaggatatgcttggtacaagtacaggatccggacgtacactggactccgagatccgtgtcatcatggctcagtacatgcccctgaacaaccaagaagacgtgcagagccattctcttcacattgagatgcgaggacatgaggacgtatacttgcttaggttggaccgcatacttgatgtatcgtatatcatataacttgagttagatggtgtatatagcgtaactcccttatgaataacatgcttaacacttgaacaatctgaataccaatgccgatgctgtgccaaggctgaaatcgtctctgattagtaataattttaatcttttctttcggtgcctttaaaggagattgactgacgaagaccgtgggggacactgtctgaaggcccatagatttaatcgcccctttcaccaggtaattgagtcatgaaagaaatcctttcctcacacaaatacaaaaagataaaaaacctgcatgggcgggatgcccaaatccaaatccccactattgtgtaaaaattcacattaaatgggcgcgtcaatctactcctttttgaagagaaaaccaagtcgtacacatcctatacaactaaaagacatccccaattccccttgtgtggtataacgattaggacacaacgctcgactatccaaaaggtatccaacctgaatagcaagagccttgatcaggttatatcccctaaggtacctccccctatgagaattttggtgttttgaccaaaggccctaatcgcactccatg

SEQ ID NO: 10806 - protein, 62 aa, Zea mays
  misc_feature: Ceres CLONE 1339168-F
MLGTSTGSGRTLDSEIRVIMAQYMPLNNQEDVQSHSLHIEMRGHEDVYLLRLDRILDVSYII

SEQ ID NO: 10807 - DNA, 743 bp, Zea mays
  misc_feature: Ceres CLONE 1339179-F
  misc_feature: Encodes the peptide sequence at SEQ ID NO. 10808
gctctagaactagtggatcccccgggctgcaggcccccccccccccccagccacaccccaacatcaaatccctcccatctcttcccctccgccgccgtctctgctctccaagatcgcgatggcgtcagaaaagaagcagtcgaacccgatgcgggagatcaaggtgcagaagctcgtgctcaatatctccgttggagagagtggagatcgactcacccgcgccgccaaggtgttggagcagttgagtgggcagtctccggttttctccaaggcaaggtatactgtgaggtctttcggtattcgtcgtaatgagaagattgcatgctacgttacggtcaggggtgagaaggcaatgcagcttcttgagagtggcctcaaggtgaaggagtatgagcttctgaggaggaacttcagtgatactggctgctttggttttggtattcaggagcacattgatcttggaatcaagtatgacccgtctactggtatttatggcatgggacttttacgtcgttctggaacgagctggttatcgtgttgcacgccggcgcaggtgcaagtcccgcgttggcatccagcacagggtgaccaaagaagacgccatgaagtggttccaggtgaaggtacgagggtgtcatccctcacaaggcccaaaacacctcgtaatcattgatagtcatcaaacgacttgccttttacactccagttcaggtataatctgtgactatgaaattcctgtgttt

SEQ ID NO: 10808 - protein, 184 aa, Zea mays
  misc_feature: Ceres CLONE 1339179-F
  misc_feature (66)..(163): Pfam Name: Ribosomal_L5_C Pfam Description: ribosomal L5P family C-terminus
  misc_feature (9)..(62): Pfam Name: Ribosomal_L5 Pfam Description: Ribosomal protein L5
MASEKKQSNPMREIKVQKLVLNISVGESGDRLTRAAKVLEQLSGQSPVFSKARYTVRSFGIRRNEKIACYVTVRGEKAMQLLESGLKVKEYELLRRNFSDTGCFGFGIQEHIDLGIKYDPSTGIYGMGLLRRSGTSWLSCCTPAQVQVPRWHPAQGDQRRRHEVVPGEGTRVSSLTRPKTPRNH

SEQ ID NO: 10809 - DNA, 823 bp, Zea mays
  misc_feature: Ceres CLONE 1339193-F
  misc_feature: Encodes the peptide sequence at SEQ ID NO. 10810
tctcgtggatcccccggactgcatgcccccccccccccgacttctcccacgtcgccgtccgcgcgttcgttgccggagcctctgtctgcgcctaccgaggaccgagtattccgtcttgcctcatctcacgctcctgtctggttttcacatctgctgtgctgccccttggcgcgcccaccaccacagttgaccacgctgaatagtactatgcctactcgactgagaagaatcctgctaattgatctccaagtctgcactgtctagccaactatcttgctcgccatcaactcagagactttgaagctgctgtagcagtcttatgattgttttgctgatgcaattaatgcttaaccaaatccatgacaacttgctcatcgctgatgcttgaactacggcaatgacactcaaaatacctcctagatttgctttcttgcgatccgtgatccctttccctaatcaagttttttggggtcgaggtgccgtaaagcactaaatcggaaccctaaagggagcccccgatttagagcttgacggggaactccggggaacgccccgagcccggttcgccctaaagcgaaaggaatgaccgctagggggcctgcaagtgtaacggtcacgctgggcataacctccacgcccgccgcgtttaatgcctcgctacaggtcgccttttctgccactgttcgaattaaatgagagcccaacccctatctcgctacccatctattgacattcccagatggaccaggtcatgatagcaaagctcatgattatgcttcaatcccagttgaattatgtgggatatcagctcttttttatatcc

SEQ ID NO: 10810 - protein, 66 aa, Zea mays
  misc_feature: Ceres CLONE 1339193-F
SWIPRTACPPPPDFSHVAVRAFVAGASVCAYRGPSIPSCLISRSCLVFTSAVLPLGAPTTTVDHAE

SEQ ID NO: 10811 - DNA, 782 bp, Zea mays
  misc_feature: Ceres CLONE 1339210-F
  misc_feature: Encodes the peptide sequence at SEQ ID NO. 10812
  misc_feature (530)..(530): n is a, c, t, g, unknown, or other
  misc_feature (571)..(571): n is a, c, t, g, unknown, or other
  misc_feature (601)..(601): n is a, c, t, g, unknown, or other
tggcggccgctctagaactagtggatcccccgggctgcaggcccccccccccccccccggctgaagcgcgtggagcagcagctggagatggagcgcgagatgcggcggcgcgaggtgtgggaggagttcgaggccaagatgcgcaccatgcggctggagcaggcggccgccgcggagcgcgtggagcgggaccaccgggagaaggtggccgagctccgccgcgacgcgcaggtcaaggaggagaagatggccgagcagtgggccgccaagcacgcgcgcgtcgccaagttcgtcgagcagatgggggggtgctcccgttcatggtcctctgccaccgacatgaactgttgaactggacaaacgagccgctgaccacaccgtcgctagctatcgcgtgctacgtgctccggttcacggctttcttgcattctgggacgcgacttgtaaacgccatggattcccttgctcacgttcacttccgctttctttttttcttttctttttatttacaactgtttgttacggtcggntcaatgcttctctctctatctactagtagttgatcagagtncagaaatgtaatgctgccgttactggtcgnagtttcatccctcctaaaacttgcgttctgtctcttcttgaaaaaaaaaaaaaaaaactccgaggggggggccgggtaccaattcgccctattagggaggcgtattaaatttccctggggcgtccgttttacaacggtcgtggctgggaaaaaccccgggggttaccccaacttaatcgcc

SEQ ID NO: 10812 - protein, 87 aa, Zea mays
  misc_feature: Ceres CLONE 1339210-F
MEREMRRREVWEEFEAKMRTMRLEQAAAAERVERDHREKVAELRRDAQVKEEKMAEQWAAKHARVAKFVEQMGGCSRSWSSATDMNC

SEQ ID NO: 10813 - DNA, 865 bp, Zea mays
  misc_feature: Ceres CLONE 1339233-F
  misc_feature: Encodes the peptide sequence at SEQ ID NO. 10814
  misc_feature (737)..(737): n is a, c, t, g, unknown, or other
  misc_feature (787)..(787): n is a, c, t, g, unknown, or other
  misc_feature (791)..(791): n is a, c, t, g, unknown, or other
cgcggtggcggccgctctagaactagtggatcccccgggctgcaggaattcggcacgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacggggggggggaggatcagcgtagagaagatcgctaggcccgccatgatctccgatttcgcggagctcaaggtcagcagcaaggagcgaaggccgggcgaggcacgctcgcccacgacggctcccaccacgaaatcgttcaccaccacggagccgttctcgtcgtcggagacgcccacgcagtcgtccatgtgaagtcgtgggcgtaggaaggaagcatttttttttttttggtttagtttgtatggtgtgcagggttacaggatttttttttttttgaggagtttcttggttggtttgctgtgaggaaagatgtcgtaggcctctcattgcatctttgatcatgtaaatatctgtaaacgaagatgatcaaagatagctttgcacgaaaaaaaaaaaaaaaaactcgagggggggcccgttacccatttcgcctatagggagtcgtatacantcactgggcgtccgtttacacgtcgtgactggaaaaccctggcgtacccnactnatcgcttggaggacatccctttttcgcagtggggaaatagcgaaaggcccgcacgatcgcccttcccaaagtgg

SEQ ID NO: 10814 - protein, 49 aa, Zea mays
  misc_feature: Ceres CLONE 1339233-F
MISDFAELKVSSKERRPGEARSPTTAPTTKSFTTTEPFSSSETPTQSSM

SEQ ID NO: 10815 - DNA, 913 bp, Zea mays
  misc_feature: Ceres CLONE 1339273-F
  misc_feature (714)..(714): n is a, c, t, g, unknown, or other
ccccgcggtggcggccgctctataactagtggatcccccgggctgcaggaattcggcaccagctcgtgccgaattcggcaccagctcgtgtccaattacccaccacctcctatagagtatccgcattacgattgactccgcgacccattacaaccctatagagaggcaaatcactgttcactgcccgcctatttaccttgcagtgcatgccactatcctgagctgacccaacttaatcgacttgcataacattcccctttcgccacatgtgcgaatactgaatagggcatggccgattgcccttcccaacatttgggcaaaatgcacggtaaatgtttgtttgatcagcgtcattatttatgctatatgccgccatcgagttttagttacttcatatcattatatatacaccgagatcggatcgagagatgcccttataagtcacaagagtccactgttatagaactgagagtccttcctcataggaacaagaatccactattaaggagatggtactctaccggaaccggcacactaatcgactatcttggcgatgagccgctacatggcacttcaccctaaccctattgttagcccccgatgtacagcttggcgctaaatgccgaccatattgctagagcacgattgatagatagcgcaaggagcgcggggtacgacgctgagaagtagagcgatcacgctgaacgaaagcancatacgccgctgcttaatgagccgctacggtggcgttaagcgcacatcctcgagattatgcccgcaacacgatgcgtcagtgttctattacgttcaatatgctcctatcacgatacgtaatcctgataatgcctcataatcttcccatgatgaggagtccctttacatttcgtgagacatgaacccgtttagggcattt

SEQ ID NO: 10816 - DNA, 863 bp, Zea mays
  misc_feature: Ceres CLONE 1339274-F
  misc_feature: Encodes the peptide sequence at SEQ ID NO. 10817
gtggatcccccgggctgcagggagagagctcactagtccccccccccccccccccgctacctgatggccaagtaatcaccatcggtgcagagagattcaggtgccccgaggtcctcttccagccatccatgattggtatggaggctgctggaatccatgagacaacatacaattcaatcatgaagtgtgatgtggatatcaggaaggacctctacggcaacattgtgctcagtggaggttcgactatgttccccggtatcgctgatcgtatgagcaaggagatcacttcccttgcaccaagcagcatgaagatcaaggtcgtcgcaccacctgagaggaagtacagtgtctggataggaggttcgatcctagcttcgctcagcactttccaacagatgtggatatccaaggaggagtatgatgagtctggcccggcaatcgtccacaggaagtgcttctaggtttcgcaagttcctcattgttatctagtctcaagttatgcccccgtcatttctcgagatatgtgtggcagatttgcctgcgacgtttattttcatcggacctgagtcttctcggggttagcagctacctttgtatgttgtggcttccctgtgcgagcgtgctgtgacgtatcacctggtttgtggagattacatgttgtcaaacttgcctggtttgaatggctgcgcgttaaaaactgatagttatttccaaaaaaaaaaaaaaaaactccagggggggcccggcacccaattcgccctatagaggagcgaattacaatcccttggccgccgctttaacaacgtcgggattgtgaaaacctcggggttacccaacttaatcgcttggaagcactccccctt

SEQ ID NO: 10817 - protein, 152 aa, Zea mays
  misc_feature: Ceres CLONE 1339274-F
  misc_feature (1)..(152): Pfam Name: Actin Pfam Description: Actin
GSPGLQGESSLVPPPPPPLPDGQVITIGAERFRCPEVLFQPSMIGMEAAGIHETTYNSIMKCDVDIRKDLYGNIVLSGGSTMFPGIADRMSKEITSLAPSSMKIKVVAPPERKYSVWIGGSILASLSTFQQMWISKEEYDESGPAIVHRKCF

SEQ ID NO: 10818 - DNA, 881 bp, Zea mays
  misc_feature: Ceres CLONE 1339294-F
  misc_feature: Translation starting site: 98
  misc_feature: Pfam Name: SapB_1 Pfam Description: Saposin-like type B, region 1
  misc_feature: SWISSPROT Homolog: EC 3.4.23.40 Phytepsin
  misc_feature (51)..(51): n is a, c, t, g, unknown, or other
  misc_feature (624)..(624): n is a, c, t, g, unknown, or other
  misc_feature (733)..(733): n is a, c, t, g, unknown, or other
  misc_feature (736)..(736): n is a, c, t, g, unknown, or other
  misc_feature (804)..(804): n is a, c, t, g, unknown, or other
  misc_feature (863)..(863): n is a, c, t, g, unknown, or other
gctctagaactagtggatcccccgggctgcaggccccccccccccccgatncacacgtttgtcccagtcactccggaagggatactggcagttcaacatgggtgatgtcctggttgatggaaagtccactgggttttgtgccggtggctgtgcagccatcgcagattctggaacttccttgcttgctggccccacagccataattactgaaatcaatgaaaagattggtgctgctggtgtagtcagccaggagtgcaaaactgttgtttctcaatatggacagcagatcctagatcttttgctagctgagacacaaccaacgaagatctgttcccaggttggtctgtgcacttttgatggcactcatggtgtcagcgctggaattcggagcgtagtggatgatgaagctgggaaatcaaatggtggtctcaagagtgatccaatgtgcaatgcctgtgagatggctgtggtatggatgcagaaccaacttgcccagaacaagacacaggagctcatcctgaactacattaatcagctttgcgagcgtcttccgagtccgatgggagaatcagctgtggactgtggcagtcttgcgtccatgcctgacattgcgttcaccattgnagggcagaagttcaagctgaaaccagagcagacattctgaaaggtggtgaaggacaggctgcccagtgcatcagcggattcacagctatgggtatcccaccacccgtgnccntctctggatccttgggtgaggttttcatgggagtctaccacaccgtctcgactaggcaaagctgaggnttggcttcgcgagtcaccccttagggatatgggtttggcagcaacccgtcagaggcaangccgtaatttgtgtggtt

SEQ ID NO: 10819 - DNA, 887 bp, Zea mays
  misc_feature: Ceres CLONE 1339306-F
  misc_feature: Pfam Name: WRKY Pfam Description: WRKY DNA -binding domain
  misc_feature (796)..(796): n is a, c, t, g, unknown, or other
  misc_feature (823)..(823): n is a, c, t, g, unknown, or other
  misc_feature (846)..(846): n is a, c, t, g, unknown, or other
  misc_feature (856)..(856): n is a, c, t, g, unknown, or other
  misc_feature (857)..(857): n is a, c, t, g, unknown, or other
cgcggtggcggccgctctagaactagtggatcccccgggctgcaggaattcttttttttttttttttttgggaaagtagtgattttttttaagagagagagagagagagaaagagagagcaccaacaacaatggcattattcctcgttttgagaacggcaatagccttgttttgttggtctgataatccctctgcctgagatacaattaactatagtgtgtgtgtgctctactacggcaacggcaaccctcctgatggggctgtcgctcggtccggtcggactgactgttctcacgtactacagcgacgtcgacgacacatgtccagatctactgctgctgctgctgctaatataacaatctactgctgaaacgtaacgacgtcactgagaccgccgaagtcaaagcggtcctggagcacggattcccagccgaagcagccgtccaggaactccgtcacggggtccggagcggccgtgtcgtgccactcgtgcgccagctgcgccccgaacccgaccccgacctcggacgacgccgacggggacgaccacccgccctgcgacggcgagcttctgctggtgtccgccgcggacccccaggagctggagccgaagtcgacgacggcgggaggggccaccgccgacgcagccgctcctccctgctgccacgcgcccctgcacgtgtgctccccgtagtaggcgatctcgtacgccgacggctgctcgcgcgtctgctgcacccggcgggtcgcgttgcatccctggtccttgtgcgcgcagcggtagtagagactcgcntggcttgtgtccgctgatgtacttctngccgtacttctttcagatgaagncgtcacccgnncgtgcgctggtcaacctcatggtcagctct

SEQ ID NO: 10820 - DNA, 878 bp, Zea mays
  misc_feature: Ceres CLONE 1339313-F
  misc_feature: Pfam Name: YgbB Pfam Description: YgbB family
  misc_feature: SWISSPROT Homolog: EC 4.6.1.12 2-C-methyl-D-erythritol 2,4-cyclodiphosphate synthase
  misc_feature: SWISSPROT Homolog: EC 3.2.1.23 Beta-galactosidase
  misc_feature (834)..(834): n is a, c, t, g, unknown, or other
cgcggtggcggccgctctagaactagtggatcccccgggctgcaggaattcggcacgagagagagagagagagagctcactagtccccccccccccccgttggaagggcgccgattcttcggtgttcatgagggaagctgtgaaattgatgcatgaagcaggctacgagctggggaaccttgatgctacgctgatcttgcaaaaaccaaaaattagcccgttcaaggagacaatccgatcgaatttgtgcgacctacttggggcagatccatctgtggtcaatctcaaggccaagacgcacgagaaagttgacagtctaggggagaacaggagcatagctgctcatactgtagttctcctgatgcggatgcgaaagtagaaagaacaaatggcagctaattgtatcatgctacacgaaaaaggttgttatcttatacttgtgattgttgagtgatctagccagtatggaaaatcttcatgtggtagaaacaataaagctgattgcaatgagaaattttctgtatttcaaaaaaaaaaaaaaaaaaaactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcaaattgtaagcgttaatattttgttaaaattcgcgttaaatttttgttaaatcagctcattttttaacaataggncgaaaatcggcaaatcccttataatcaaagaatagaccgagata

SEQ ID NO: 10821 - DNA, 850 bp, Zea mays
  misc_feature: Ceres CLONE 1339375-F
  misc_feature: SWISSPROT Homolog: EC 3.2.1.23 Beta-galactosidase
  misc_feature: SWISSPROT Homolog: EC 2.7.7.9 UTP--glucose-1-phosphate uridylyltransferase
  misc_feature (834)..(834): n is a, c, t, g, unknown, or other
tacccgcggtggcggccgctctagaactagtggatcccccgggctgcaggcccccccccccccaattacgctcaagggcaaggtgacaatcaccgccaagtctggagtgaagttggagattccagacggagctgtatttgaaaacaaggatgtcaatggccctgaggatctttaagctatgcttgccgtcaccagtttttcccaaggacatgtcaataggagctgccaacccaaatcactcccgctgagctctaccttttgtaattctcgtgccgttccgcttccgctgtgagggtcctgtgagcccgctagggaatatgattgtaaaatcttctttggtgcgtctgcacttctgtttttggtgcgccagggactaaaaaaaaaaaaaaaaaaaactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcaaattgtaagcgttaatattttgttaaaattcgcgttaaatttttgttaaatcagctcattttttaaccaataggccgaaatcggcaaaatcccttataaatcaaaagaatagaccgagatagggttgagtggttgtccagtttgggacaagagtccactattaaagaacgtggactccaacgtcaaagggcgaaaaaccgtctatcagggcgatggcccactacgntgaacatcaccctaat

SEQ ID NO: 10822 - DNA, 870 bp, Zea mays
  misc_feature: Ceres CLONE 1339382-F
  misc_feature: Encodes the peptide sequence at SEQ ID NO. 10823
gctctattctagtggatcccccgggctgcagggtttccccccccccttggttaccctggagggcctaccttgtttaaaaatttgaattttggtatcgacctggacagccgcatagcattggttggtcctaatggcattggcaagtccactatactgaaactaatttctggggatctgcagccaacttctggaacagtatttcgctctcccaaggttcgcatggctgtattcaatcagcatcatgttgatggccttgatttgacggtgaatccccttttgtacatgatgaagtgctatccgggtgtgccggagcagaagttgagggcacatctgggttcgtttggtgtttcgggaagccttgccctccaatctatgtacactttatcaggtggtcagaagagtagggttgcattcgcgaaaataacccttcaagaagccgcacatcattctccttgatgagccttctaaccatcttgatctggacgctgttgaggcgctcatccaggcttcactcattttccagggaggggtgcctgatggcgcgccccgacgagaatattatcactgcaaagtgtgtaatatttttgcccggaggtcgaaaattaaacctgaccccctctctcgtttatttctcaaggaccaacaaaaatatgctctatgtacccttatcattgtactaatcgcaccctaactcaatatatcctttatggcatgccccatcaccccgcgacttaatcgtccatacattttcctgtgttcttgtcatcttaaatctacttcttcctcttcctcattttaatcccgaccacttagctcactaactcattgctaatcatcaccctactacataccccgtccgcctcaccacca

SEQ ID NO: 10823 - protein, 78 aa, Zea mays
  misc_feature: Ceres CLONE 1339382-F
MAVFNQHHVDGLDLTVNPLLYMMKCYPGVPEQKLRAHLGSFGVSGSLALQSMYTLSGGQKSRVAFAKITLQEAAHHSP

SEQ ID NO: 10824 - DNA, 825 bp, Zea mays
  misc_feature: Ceres CLONE 1339393-F
gctcttttctagtggatcccccgggctgcaggaattcggcacgaggccggcgccggcggttagagagatgcgggcaacctgaagaaagcacttgcaggtctgagaagaatcaatttagatgggcttcgatggcgcgtatttgatgctaagggtcaggtgctgggacgattggcttcccaaatagccgttgtgcttcaaggcaaggataaaccgacctatgcgccacatgtggaaaatggagacatgtgcattgtacttaatgcacaggatatcagtgttacaggaaggaaaatgacagataagatttactactggcatacagggtatgttggccatttgaaggaaaggaggctcaaggaccagatggagaaagacccaactgaagtgattcgcaaagctgtgctgcgcatgcttccccgcaacaaactgcgtgatgatagggatcgcaagctgcggatattttctggaattgagcatccattccatgaccgccctcttgaagcttttgtgatgccaccacggcaagtacgggagatgcgaccccgtgcaaggcgtgcaatgttaagggcccagaaaaaagagcattcaaacagggcccaaggaggaagaagatgctaagaatgccacagctgaggtcactgcataggctcctcatgtgaatttgcatgatgcaaatttgctcgatgctgttttaggcctatcttttttgcttggtagccttttccagtggataggcacaggaggctcggatggtgccaacctcgttctgaatcacctttttatttccattgcaatttgtactgggaacctgcctgtcacagctgc

SEQ ID NO: 10825 - DNA, 846 bp, Zea mays
  misc_feature: Ceres CLONE 1339396-F
  misc_feature: Translation starting site: 154
  misc_feature: Pfam Name: DUF850 Pfam Description: Eukaryotic protein of unknown function (DUF850)
gctctagaactagtggatcccccgggctgcaggccccccccccccccccccgcagaccgcaccctgtcggcgagctcgctcccgttcccgtccgctgctctccgctcgacgccgccgtcttccgcgcagctagtgtctacactcccggcgacgatggcggaggacttggttttggacacggcgatccgagactgggtcctgatcccgctctccgtggttatggtcctcatcggcgtgctccgctactttgtctccaagctcatgcgctccccggcgacctctccgtctcccgaccccaagctcgttaaggaagggcaggtggtcatcagggcgaggaacctgaggaccaacgcacagttcatcccggccaaggctttcaaggcacgcaaggtttattacaccaacgaggaaaatggattacttcatgttccaaaggaagacgcgcagaaggctcaggcagccatgttttctgatccaaacatggccatggacatgatgaagaagaacctatccatgatagttcctcagacacttacatttgcatgggtgaacttttttcttttcaggtttcgttgcagcaaaaatcccctttccattgactcagagattcaggggaatgctgcaaaatgggattgacctgagcactgttgatgtcagctatggtagtagccgggcatggtatttcctcatttattcggctttgaggggcttttccggctgatccttggggaaaaaacgccaatgatgatgcccagaaatgatgcaaatggtggtcgaattggattaacccacaatgatttgggagcaagaaaaacaccctgaaatctgcaccagtgtgggtcttcc

SEQ ID NO: 10826 - DNA, 704 bp, Zea mays
  misc_feature: Ceres CLONE 1339405-R
ccgggccccccctcgagtttttttttttttttttttctttttttttttttttttttttttttgaagtaacaaacacactaaacaaatcccaggaagtggatcatcccacttccgtgtatgtacataaccgatgcctcagtgtacatacactggagcagagccgacaaacgccgctagatatgttacgcccccaacgattattgcggaatatctcacaaggattattgcagaacatctcacatggctcacagggcaaacctggtaggtcttgggctcttggcaatccatggcagcgctgaaactgcacaaacgatgaggaacaggtggtctagtccttgtagacaagaggcttgttgacccatcttattcggcagccacacgcctgcagcatctggatgagttcaggggacagcacggtcttcagcccacagagcatcttcagcttcttcagcctcccgcaggctgctcgcaatgcgatctcgaacccttctatggatacccatgagaggtgcaccatcttaatgtcctggaggcaccgcagggagctcagcaggtggcacaggcccagccccgtgacttggcagtacgatatcgtaagctgtctaaggttcaaagcataacgagcaagagcccacaggccagcgtcatcaaccgaatagcatcgtttcaagtccagctctatcaggttcttgcatccgattgca

SEQ ID NO: 10827 - DNA, 846 bp, Zea mays
  misc_feature: Ceres CLONE 1341435-F
  misc_feature: Encodes the peptide sequence at SEQ ID NO. 10828
  misc_feature (686)..(686): n is a, c, t, g, unknown, or other
  misc_feature (701)..(701): n is a, c, t, g, unknown, or other
  misc_feature (702)..(702): n is a, c, t, g, unknown, or other
  misc_feature (778)..(778): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
tccccgcggtggcggccgctctagaactagtggatcccccgggctgcaggaattcggcacgagcccccccccccccaaagaccaccatcctctacaagctgaagctcggcgagatcgtcaccaccatccccaccatcggattcaatgttgaaactgtggagtacaagaacatcagcttcactgtctgggatgtcgggggccaggacaagatcaggccactgtggaggcattacttccagaacacgcagggtctcatctttgttgtggacagcaatgatagggaccgtgttgttgaagcaagggatgagctccaccgaatgctgaatgaggatgagttacgtgatgctgtgttgcttgtttttgctaacaagcaagatcttccaaatgctatgaatgccgctgagatcactgataagcttggactgcattcacttcgccaacgtcattggtacattcaaagcacttgtgctacaacgggtgagggattgtatgaaggcctggactggctgtccagcaacattgcaaccaagtcctaaattgtcaagcgaggtttggatcatctaggagcttttggatgatgatgatgatgatggtgctggatatttagggttgggttggtatttccgtatgtaagatgtatgcccctgagctcgccagtttttgagctctgctttagatcccacagntaaaattgtttatgnnaattgggccttgaaatgttcttgaccaaacagctaaaagagtcagttgagtaactgggtgcctttattacttttgnaaaaaaannnnaaaaaaaaaaaaannnnaaaaaaatccgggggggcgcgggaacaatatccccaaaaa

SEQ ID NO: 10828 - protein, 177 aa, Zea mays
  misc_feature: Ceres CLONE 1341435-F
  misc_feature (15)..(173): Pfam Name: Arf Pfam Description: ADP-ribosylation factor family
PAVAAALELVDPPGCRNSARAPPPPKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATTGEGLYEGLDWLSSNIATKS

SEQ ID NO: 10829 - DNA, 872 bp, Zea mays
  misc_feature: Ceres CLONE 1341452-F
  misc_feature: Pfam Name: ERp29 Pfam Description: Endoplasmic reticulum protein ERp29, C-terminal domain
  misc_feature (792)..(792): n is a, c, t, g, unknown, or other
ggagctccccgcggtggcggccgctctagaactagtggatcccccgggctgcaggaattcggcacgagtcttgccgagacctatgacaaggtggcttctgttttccagttcgatgaatgaggtgttatagctaaccttgacgctcaccaacacacgaatttgggtgagaagaatgcatgtagtgaatctcctacctcgacttgtttcccatacccctttcagctggtgaagattatgatgataataccgactcgattgactttgccaaggtcattaccgacaaaatggctaccggccgagacacaaagggactactaacctcaaaggctggccgtatatcaggtctggcatgccctgtttatagacgatcacttgcgagcttccggtgaccaccttataggaagtcctctccaacatgagatgaggaggcagagaagctccatgttgctgctgcaaggcatgaataggtctctgtaaccctcgcaaagaagattctagagacaggcatcgagtatactgacaacgacaccgaaacgtcttgcatcgcatggtgtataaggtccatcaggcccctccaaggccgtacgatcttatcatcaagaagaaccctctatctactttctcatcctaaagaatctgctagctccattttcacgtttcagatataagcgacaagaactgcagctttataactgtgataatgagagttcaatgtggctataactaattttgcggctttgcctaaaggatatgtaatactcggacgtcttgcgaattatctcttttacgtgngcttctcgctatatgccgtatcaccatagtacattctatgatgtagaatgtcatgacatcgtgactactgaactgacttt

SEQ ID NO: 10830 - DNA, 922 bp, Zea mays
  misc_feature: Ceres CLONE 1341459-F
  misc_feature: Translation starting site: 166
  misc_feature (712)..(712): n is a, c, t, g, unknown, or other
  misc_feature (761)..(761): n is a, c, t, g, unknown, or other
  misc_feature (767)..(767): n is a, c, t, g, unknown, or other
  misc_feature (781)..(781): n is a, c, t, g, unknown, or other
  misc_feature (869)..(869): n is a, c, t, g, unknown, or other
  misc_feature (870)..(870): n is a, c, t, g, unknown, or other
  misc_feature (901)..(901): n is a, c, t, g, unknown, or other
  misc_feature (915)..(915): n is a, c, t, g, unknown, or other
  misc_feature (916)..(916): n is a, c, t, g, unknown, or other
  misc_feature (917)..(917): n is a, c, t, g, unknown, or other
ggagctccccgcggtggcggccgctctagaactagtggatcccccgggctgcaggaattcggcaccaggagagagctcactagtccccccccccccggcggtacgcgcacacagccaaaccatcctcctctccgccgcccgccgcagcagcacccaccgggcaagatgaagacgatcctggcgtcggagacgatggacatcccggagggcgtcacggtcacggtggccgccaagctggtcacggtggagggcccccgcggcaagctcacccgcaacttcaagcacctcaacctcgacttccagctgcaggaggccggccgcaagctcaaggtggacgcctggttcggcacccgccgcaccatggccgccatccgcaccgccatctcccacgtccagaacctcatcaagggggtcaccaagggctaccgctacaagatgaggttcgtctacgcccacttccccatcaacgcctccatcaccaacagcaacaccgcaatcgagatcaggaacttcctcggcgagaagaaggtcaggaaggtggacatgcttgatggcgtgaccatcctccggtccgagaaggcaaggatgagctcatccttgacggaaacgacgtcgagctcgtatctcgctccgccgccctcatcaaccagaaatgccatgtgaagaaagaagatatcccgaagtttttggacggtatctatgtgagcgacangggcgtcatcgaagaggagcagtgagcgacagagtagccgaaatggcangagatngatatgaatgtcgntttgagtgcaaatttgtgagactgaatgtgaaccattttctcattcccttaatagtgactgcggtggtcgtggttcaaacggatttanngctatactggatttgcgtatcaatgggatgntggctgcctggtannngttga

SEQ ID NO: 10831 - DNA, 964 bp, Zea mays
  misc_feature: Ceres CLONE 1341471-F
tgctctttcgccccaccctctccccttatgggccatgtgtcttccccccttaatggagctccccgcggtggcggccgctctagaatagtggatcccccgggctgcaggaattcggcacgagagagagatagagaagagctcactagtcccccccccccctcgctgacactgctgtgagctctgtgcttgaaatggccatggtctgtaatagcgaactgggcttgagtgaaaataaatccaccagcgcgctagcgtgtgtcagcgaccatcatgctcaatctaatggccggttggctggggtaacggcagtccggctacgccagtgacgagccggcaccttcttcctggcggcgagggcctttggcgcatagcggcatgggcggtgtgtatgcagtatgcggcgttgcgtactacaattaccgttgttccaaaaacggagaagtaaaaaacaaacttaagctcgggggggggcccggtacccaattcgccctatagtgagtcggattacaattcactggccgtcggttttacaacggggtgactgggaaaaccctgggcgttacccaacttaatcgccttgcaggccatcccccccttttcgccagtttgcgcgtaatagcgaaatagggcccccaccgaattcgcccttcccaaagagttgccccatccctgaatgggtgcaatgggcaaatttgtaagccgttaatattttggttaaaacttcccgttataaattttttgctaaaaacatgtccttttttttaccaataaggcccaactcgcgaaaacccccttataaatcacaagaaataccccccaaaaagggtttgagcggctgtccagtttcggaaaaggaatcccctatttaaaaaccggggactccatcttcaaagggcgaaaaaccgccctatccaggggagggccccctacggggaacattcccctaataggttttttgcgcgcc

SEQ ID NO: 10832 - DNA, 902 bp, Zea mays
  misc_feature: Ceres CLONE 1341486-F
  misc_feature: Translation starting site: 451
  misc_feature: SWISSPROT Homolog: EC 3.2.1.23 Beta-galactosidase
  misc_feature (902)..(902): n is a, c, t, g, unknown, or other
gctcattaactagtggatcccccgggctgcaggctccccccctacgacggcgtgtgcagcgacgaccccctccgatcccgccagtcagtgaagtccgcctttgaaatccaataactcggaacaatgatgatgacgaaataggccgagttttcttggacaatgatgttaagttcggcaaggttttcctttctctttttttattctactgcgtggactatgtgtatattgccaaaggcatgcttgagccatgcgcccggtgctgggagcgcaaagaccatctgatggcggaaacaccggaaataagagcgtgccgctgtgtgtttcctttgaaggaataaaaaaaccaaaaaaaaaactcgagggggggcccggtacccaattcgccctatagtgagtcgtattacaattcactggccgacattttacaacgtcgtgactgggaaaaccctgatgttacccaacttaatcgccttgcagcacatccccctttcgccagctggcgaaataaagaagagtgccgcaccgatcgcccttcccaacagctgtgaagcctgaatggggaatgccaacttgtaagcgttaaaattttggaaaattcaccgttaaatttttgataactcagctcattttttaacccttaggccgaaatcggaaaatcccttataaatcaaaagaataaaccgaaaaagaggttgagtgttgttccagtttggaccaagagccccaattaaaagaacgtgggctccatcgcccaaagggcgataaaccgtccatcaggggcgatggcctcctcgggggacccgtcaccctaatccaggtttttgtggggcgaggtgtgcgataagcaccacatcggacccctaaaggggcgccccggaataaaagcttgatgcgcaaatccn

SEQ ID NO: 10833 - DNA, 875 bp, Zea mays
  misc_feature: Ceres CLONE 1341487-F
  misc_feature: Encodes the peptide sequence at SEQ ID NO. 10834
  misc_feature (839)..(839): n is a, c, t, g, unknown, or other
  misc_feature (845)..(845): n is a, c, t, g, unknown, or other
tccccgcggtggcggccgctctatcaactagtggatcccccgggctgcaggtccccccccccccaaccccccccagaaggctagggaccccaagtacccacgaatcagcactaccggaaggaacaagcttgatcagtaccaaattctcaagtacccccttaccacagaatcagcgatgaagaagattgaagataacaacactctggtcttcattgttgacctcaaggcagacaagaagaagatcaaggctgccgtcaagaagatgtatgacatccaggcaaagaaggtcaacaccttgatcaggcctgatgggaagaagaaggcttacgtgaagctgactcccgactatgatgctcttgatgttgccaacaaaatcggcatcatctaagtgctgcattaggcatcctaattcatctgttgggtcctagttctatgtgaaaccagagttttctagctatggctctcaatcgctccattaccatgtgttatgcacacttctgaatttgatatcatccaagtgaccttttgaactaaaaaaaaaaaaaaaaaaaactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcaaattgtaagcgttaatattttgttaaaattcgcgttaaaattttgttaaatcagctcattttttaaccataggncgaaantcggcaaatccttataaatcaaagaataga

SEQ ID NO: 10834 - protein, 70 aa, Zea mays
  misc_feature: Ceres CLONE 1341487-F
  misc_feature (1)..(67): Pfam Name: Ribosomal_L23 Pfam Description: Ribosomal protein L23
MKKIEDNNTLVFIVDLKADKKKIKAAVKKMYDIQAKKVNTLIRPDGKKKAYVKLTPDYDALDVANKIGII

SEQ ID NO: 10835 - DNA, 979 bp, Zea mays
  misc_feature: Ceres CLONE 1341489-F
  misc_feature (12)..(12): n is a, c, t, g, unknown, or other
  misc_feature (13)..(13): n is a, c, t, g, unknown, or other
  misc_feature (15)..(15): n is a, c, t, g, unknown, or other
  misc_feature (17)..(17): n is a, c, t, g, unknown, or other
  misc_feature (20)..(20): n is a, c, t, g, unknown, or other
tccctttttttnntntnctnctctgcccctcaaccgtgttttcgccggggctccccatagctggagatccccgcggtggcggccgctcttcaactagtggatcccccgggctgcaggttttcggcaccagagagagagagagagctcactagtccccccccccccccccccgtatttaaggtcgccagccaggtgtaggcgggcaaggcttatttgctgtctgggactgggaggaacatcctaaacgagggtgccttagtttgtcggtggagcagattggtgttggtttctgtgggcttttacgggtggtgttactctcatctccatctctcccaggaggctaccccaagcatgtagtagcttccattctgattctgggacggtgttgcacgttacagtgctctcaagctgtctctgcaaagtgtggttttttattccatttccctcctgctcttggtctccaaaaaaaaaaaaaaaaaaaactcgagggggggcccggtacccaattcggcctatagggagtcgtattacaattcactgggccgccgcttatacaacgttgtgactgaggaaaaccctggggtgacccaacttaaatcgcttggaccacatctccccttgcgcaagcttggggcaataccgaaagggccccgcaccgatcggcctttctcaataattgtcccctcctggatgggcaaatggcacatttgtcaccgtaaaaattttgcgtaaaattcccggtgaaatttttgcgaaaccaggccttttttttaacccaatggggccaaatcgggcaaaaccccttttaaactcaaaaaaatagaccgcagatacggctcgttggctgtcccactttggaaacccaggcctcttattagaaggcgggacttcatcgcccaagggggaaaacaccgtcttatcgggcgagtgcccacctccgggtcgcttcccccaacccaagtgttttgggcttgagggg

SEQ ID NO: 10836 - DNA, 889 bp, Zea mays
  misc_feature: Ceres CLONE 1341530-F
  misc_feature: Pfam Name: Prismane Pfam Description: Prismane/CO dehydrogenase family
  misc_feature (457)..(457): n is a, c, t, g, unknown, or other
  misc_feature (699)..(699): n is a, c, t, g, unknown, or other
ggagctccccgcggtggcggccgctctagaatagtggatcccccgggctgcaggcgaaaccggtaaatacggtcacccgacgccaacccaggtcaacgtcaaagcgacggcgggtaaatgcattctgatttccggtcacgatctcaaagatctctacaacctgctggaacagaccgaaggcacgggcgttaatgtctacacccacggcgaaatgctgcctgcgcatggctacccggagctgcgtaaattcaagcatctggtcggtaactacggcagcggctggcagaatcagcaagtggagttcgctcgtttccctggccccatcgtgatgacctcgaactgcatcatcgacccaaccgtaggcgcttatgacgatcgtatctggacccgcagcattgttggctggcctggcgtgcgtcatctggacggtgatgatttctctgcggttatcacccangcgcaacagatggcaggcttcccgtacagcgaaattccgcaccttatcaccgtggggttttgggtcgcagacgctgcttggcgctgctgatacgctgattgatctggtgagccgtgaaaactgcgtcatatcttcctgcttggtggctgtgacggggggcccggtacccaattcgccctatagtgagtcgtattacaattcactgggcgtcgttttacacgtcgtgactgggaaaacctggncgtaccaaactaatcgccttgagacatccccttccgcagctggggtatagcgagaagcccgcacgatcgcccttccacagttgcgcagctgatggcgatggaaattgaagcgtatatttgtaaaatcgggtaattttgtaaacagtatttttaacatagcgaatggcaatcttaaaataaagatgacggg

SEQ ID NO: 10837 - DNA, 919 bp, Zea mays
  misc_feature: Ceres CLONE 1341535-F
  misc_feature: Encodes the peptide sequence at SEQ ID NO. 10838
  misc_feature (503)..(503): n is a, c, t, g, unknown, or other
  misc_feature (606)..(606): n is a, c, t, g, unknown, or other
  misc_feature (631)..(631): n is a, c, t, g, unknown, or other
  misc_feature (636)..(636): n is a, c, t, g, unknown, or other
  misc_feature (676)..(676): n is a, c, t, g, unknown, or other
  misc_feature (683)..(683): n is a, c, t, g, unknown, or other
  misc_feature (703)..(703): n is a, c, t, g, unknown, or other
  misc_feature (716)..(716): n is a, c, t, g, unknown, or other
  misc_feature (786)..(786): n is a, c, t, g, unknown, or other
  misc_feature (811)..(811): n is a, c, t, g, unknown, or other
  misc_feature (834)..(834): n is a, c, t, g, unknown, or other
  misc_feature (835)..(835): n is a, c, t, g, unknown, or other
  misc_feature (836)..(836): n is a, c, t, g, unknown, or other
  misc_feature (837)..(837): n is a, c, t, g, unknown, or other
  misc_feature (838)..(838): n is a, c, t, g, unknown, or other
  misc_feature (839)..(839): n is a, c, t, g, unknown, or other
  misc_feature (840)..(840): n is a, c, t, g, unknown, or other
  misc_feature (841)..(841): n is a, c, t, g, unknown, or other
  misc_feature (842)..(842): n is a, c, t, g, unknown, or other
  misc_feature (843)..(843): n is a, c, t, g, unknown, or other
  misc_feature (844)..(844): n is a, c, t, g, unknown, or other
  misc_feature (845)..(845): n is a, c, t, g, unknown, or other
  misc_feature (846)..(846): n is a, c, t, g, unknown, or other
  misc_feature (847)..(847): n is a, c, t, g, unknown, or other
  misc_feature (848)..(848): n is a, c, t, g, unknown, or other
  misc_feature (849)..(849): n is a, c, t, g, unknown, or other
  misc_feature (850)..(850): n is a, c, t, g, unknown, or other
  misc_feature (851)..(851): n is a, c, t, g, unknown, or other
  misc_feature (853)..(853): n is a, c, t, g, unknown, or other
  misc_feature (854)..(854): n is a, c, t, g, unknown, or other
  misc_feature (855)..(855): n is a, c, t, g, unknown, or other
  misc_feature (856)..(856): n is a, c, t, g, unknown, or other
  misc_feature (857)..(857): n is a, c, t, g, unknown, or other
  misc_feature (858)..(858): n is a, c, t, g, unknown, or other
  misc_feature (859)..(859): n is a, c, t, g, unknown, or other
  misc_feature (860)..(860): n is a, c, t, g, unknown, or other
  misc_feature (861)..(861): n is a, c, t, g, unknown, or other
  misc_feature (864)..(864): n is a, c, t, g, unknown, or other
  misc_feature (865)..(865): n is a, c, t, g, unknown, or other
  misc_feature (871)..(871): n is a, c, t, g, unknown, or other
  misc_feature (872)..(872): n is a, c, t, g, unknown, or other
  misc_feature (873)..(873): n is a, c, t, g, unknown, or other
  misc_feature (874)..(874): n is a, c, t, g, unknown, or other
  misc_feature (875)..(875): n is a, c, t, g, unknown, or other
  misc_feature (876)..(876): n is a, c, t, g, unknown, or other
  misc_feature (877)..(877): n is a, c, t, g, unknown, or other
  misc_feature (878)..(878): n is a, c, t, g, unknown, or other
  misc_feature (879)..(879): n is a, c, t, g, unknown, or other
  misc_feature (880)..(880): n is a, c, t, g, unknown, or other
  misc_feature (881)..(881): n is a, c, t, g, unknown, or other
  misc_feature (882)..(882): n is a, c, t, g, unknown, or other
  misc_feature (884)..(884): n is a, c, t, g, unknown, or other
  misc_feature (891)..(891): n is a, c, t, g, unknown, or other
  misc_feature (892)..(892): n is a, c, t, g, unknown, or other
  misc_feature (893)..(893): n is a, c, t, g, unknown, or other
  misc_feature (894)..(894): n is a, c, t, g, unknown, or other
  misc_feature (895)..(895): n is a, c, t, g, unknown, or other
  misc_feature (896)..(896): n is a, c, t, g, unknown, or other
  misc_feature (897)..(897): n is a, c, t, g, unknown, or other
  misc_feature (898)..(898): n is a, c, t, g, unknown, or other
  misc_feature (899)..(899): n is a, c, t, g, unknown, or other
ggagctccccgcggtggcggccgctctagaactagtggatcccccgggctgcaggaattcggcacgagggaacagatcatgcatctttgaggatatgggacccaagaagtgcacaaagcaggcatgttattcgaggccatggttatcatactgatggattgacatgcttatcaatgactttggattcacaaacggttgttagtggctccaaggacagttctgtgcacgctgtgaatgtaaactcgggccagatcgttggctcactagtaggccacaccacttccattgagtgtgttggtatctcatcaagctatggctgggtagctacagggagcatggatcaaaagctgatcatatgggacctcacacaccagtccagccgatgcacttgtgaacatgatgagggagtgacatcactggcatggttaggttcgtcaaggtatgttgcgtcaggatgcatcgacggcaaggtgcgcatctgggacagcctctctggggattgntgccaggagttcagtgggcatgcagatgtagtacagtcgatggccatcacagctgacggcaacgccatggtctcggtctcatcagatggctccgcccgtgtgnttgacatctccccatgtcagtgaangaaanctggacggagtaaatgggtgctgtgtatgctaatgcttgntcgcggngcatgtgcatgaatgatgantgcatgccatggnaatatgttattctactcatgggaaactcgtgcatttgtattgcatataagtccgtactcttagtatctgntacagttgaacaataatggatttgnagtctattccttccttctcaaannnnnnnnnnnnnnnnnntnnnnnnnnnaannaaaaannnnnnnnnnnnanggaaaannnnnnnnnaacctcgggggggcccgaac

SEQ ID NO: 10838 - protein, 151 aa, Zea mays
  misc_feature: Ceres CLONE 1341535-F
  misc_feature (25)..(63): Pfam Name: WD40 Pfam Description: WD domain, G-beta repeat
  misc_feature (66)..(104): Pfam Name: WD40 Pfam Description: WD domain, G-beta repeat
  misc_feature (108)..(146): Pfam Name: WD40 Pfam Description: WD domain, G-beta repeat
  misc_feature: SWISSPROT Homolog: EC 2.7.11.7 [Myosin heavy-chain] kinase
  misc_feature (110)..(110): Xaa is any aa, unknown, or other
  misc_feature (145)..(145): Xaa is any aa, unknown, or other
MTLDSQTVVSGSKDSSVHAVNVNSGQIVGSLVGHTTSIECVGISSSYGWVATGSMDQKLIIWDLTHQSSRCTCEHDEGVTSLAWLGSSRYVASGCIDGKVRIWDSLSGDXCQEFSGHADVVQSMAITADGNAMVSVSSDGSARVXDISPCQ

SEQ ID NO: 10839 - DNA, 903 bp, Zea mays
  misc_feature: Ceres CLONE 1341544-F
  misc_feature: Encodes the peptide sequence at SEQ ID NO. 10840
  misc_feature (757)..(757): n is a, c, t, g, unknown, or other
  misc_feature (793)..(793): n is a, c, t, g, unknown, or other
  misc_feature (886)..(886): n is a, c, t, g, unknown, or other
  misc_feature (903)..(903): n is a, c, t, g, unknown, or other
ggagctccccgcggtggcggccgctctataactagtggatcccccgggctgcaggcccccccccggagccaccagcacactcgtctctttcctctaccgccgccaccatcgcctcgcggccgcctgccgctccgctcggaagtttttggtgaagattttttgaagctgagaagatggtgctgaagacggaactctgccgcttcagtggccagaagatctatcctgggaaaggcatccggtttattcgtgctgattctcaggttttcctttttgccaactctaaatgcaagcgctacttccacaaccgcctgaagcctgcaaagcttacctggacagcaatgtacaggaagcagcacaagaaggacatccatgctgaagctgtcaagaagaggcgccgtgccaccaagaagccatactcgaggtccattgtgggtgcttccttggaagtgatccagaagaagagagctgagaagcctgaggtccgtgatgctgctagagaagctgctcttcgtgagatcaaggagcgcatcaagaagaccaaggatgagaagaaggcgaagaaggctgaggtgtccaagtcccagaaggcgcagacgaagggtgctgttcagaagggttccaaagaccccaagttgggtggcggcggtggcaaacgctgaaaaggaacgaagtgtcattccgagacctcatcaaagccacctttgtagtaccttggttaattttgtattttctttcagagttacttgtgactcttaantttgcatctttatatattgggagaaatgatcgccgntcgttcatatgatttcctcaaaaaaaaaaaaaaagaaaaaaaaaaaaaaaactcgagggggggcccggtaccaattcgccctatatgagtcgnattacaattacctgccn

SEQ ID NO: 10840 - protein, 161 aa, Zea mays
  misc_feature: Ceres CLONE 1341544-F
  misc_feature (3)..(73): Pfam Name: Ribosomal_L24e Pfam Description: Ribosomal protein L24e
MVLKTELCRFSGQKIYPGKGIRFIRADSQVFLFANSKCKRYFHNRLKPAKLTWTAMYRKQHKKDIHAEAVKKRRRATKKPYSRSIVGASLEVIQKKRAEKPEVRDAAREAALREIKERIKKTKDEKKAKKAEVSKSQKAQTKGAVQKGSKDPKLGGGGGKR

SEQ ID NO: 10841 - DNA, 968 bp, Zea mays
  misc_feature: Ceres CLONE 1341548-F
  misc_feature: Translation starting site: 119
tcagaactagtggatcccccgggctgcaggaattcggcacgaggagcctggactaccgccgccgcccttcgccgatatcttcagcggcgaacagcgcccaccagatcccgcccctgcgatggagtccgtggtgaacccgaaggcatacccgctggctgatgcgcagctgacgatgggtatccctcgatatcaatccagcaggccgccaactacaaacagcttaagaagggagcgaatgaagcgacgaagaccctgaataggggcatatcgggagtttgtagtgatgggcggcggacacagaagcctctcgagatcctgctccacctccccttgttagctgaggataaaaacgtgccatatggtgtttgttccatccaagcaaagttcttggccgtgcttgtgggggggacaagaccgggttattgtttgctcagggacccataattgagggtacgccagcttgaaactaaagaatacgggggtctccaggaactccatttgaaaaagctttctcatcttgatttggccgaaaaaccttttacagggggaggggggctccctccaacccttttttttcaaaagccttgggaacggggggaagggcgggctttggtttaactttgggccctttttcaaactaatttttggaaaccccttggtaaacgtcgcacacaaacctggaaatgggaacgggcactccatatggttggggagagggcacctgaaacccgaaaaaatgcccctctggaattgtggggggccttggttccctgctggaaaacattacacccagtccactgctattaataaagctaatgtacctcgcaatcatctggttattcactacctgagtctccgctagccccctcgacacgagtggcactaacacaagctttgcgggggcggggcgcgcgcccccaccgcccacttacggggtgtatatacatcgcggcccaccttaacacggg

SEQ ID NO: 10842 - DNA, 867 bp, Zea mays
  misc_feature: Ceres CLONE 1341551-F
  misc_feature: Encodes the peptide sequence at SEQ ID NO. 10843
  misc_feature (654)..(654): n is a, c, t, g, unknown, or other
  misc_feature (678)..(678): n is a, c, t, g, unknown, or other
gctctttactagtggatcccccgggctgcaggaatttggcacgagagaacctctaaaatttcccccactcgccagtcgcagcagcacctgtagccatggacgccagcggagccggtagcaaggggaagaagggtgcggccgggcgcaaggcaggcggccccaggaagaagtcggtgacgcggtccgtcaaggccgggctgcagttccccgtcggccggatcgggcgctacctgaagaagggccggtacgcgcagcgcgtgggcactggcgcccccgtctacctcgccgccgtcctggagtacctcgccgccgaggttctggagttggcagggaacgcggcgaaagacaacaagaagacgcgcatcatcccgcgccacgtgctcctggcgatccgcaacgacgaggagctcgggaagctgctggcaggcgtcaccatcgcgcacggcggcgtcctccccaacatccactccgtgctcctgcccaagaaggcggcggagaaggcggccagcgccggcagcaaggagccccagtcccccaagaaaggcgccaagttcccccaagaaggcttagaaagtagggacttcatttgcactgtgtgctgtagcatgctcgtgtctcaatctggggatgggatgtgccctgctctagttccgnccttggggctttatggatgtccgncttccatcgaaagatcctccgcatcagagctcgttgtgtacttaaaaaaaaaaaaaaaaaaactcgggggggggcccgggaccaatttccccctatagggagccgaatacaattcccgggccgcgtttttacacgccgggatgggaaaaccctggggttacccacttaattcccttggagaaatccccc

SEQ ID NO: 10843 - protein, 226 aa, Zea mays
  misc_feature: Ceres CLONE 1341551-F
  misc_feature (29)..(102): Pfam Name: Histone Pfam Description: Core histone H2A/H2B/H3/H4
  misc_feature (187)..(187): Xaa is any aa, unknown, or other
  misc_feature (195)..(195): Xaa is any aa, unknown, or other
MDASGAGSKGKKGAAGRKAGGPRKKSVTRSVKAGLQFPVGRIGRYLKKGRYAQRVGTGAPVYLAAVLEYLAAEVLELAGNAAKDNKKTRIIPRHVLLAIRNDEELGKLLAGVTIAHGGVLPNIHSVLLPKKAAEKAASAGSKEPQSPKKGAKFPQEGLESRDFICTVCCSMLVSQSGDGMCPALVPXLGLYGCPXSIERSSASELVVYLKKKKKKLGGGPGTNFPL

SEQ ID NO: 10844 - DNA, 531 bp, Zea mays
  misc_feature: Ceres CLONE 1341560
  misc_feature: Encodes the peptide sequence at SEQ ID NO. 10845
atcaaagcagcgtgccagagccagaaggagattggattttctgtcaaccccagtggagctcaaattgtgcactgctgcggcaagttgtcaaaggcctccccagaaaatggatcaaccgggtccagtggccgaaaacatctctccgtcagatgcatgtcaagacatttcacagaatgttccaccagagcgtgcggatgccatcacaccgctggcttctagtaaccaccattcaccaacgacaccagatgatccattctctctcgaaatgcatgaggcgaacgcatcagatcttctggacatgtcctactgtgatggcttgataatcgattctcgtcgtgatccacgtgacggtagcctcatgtagaagaaaaagttaccaacgcaaaatgacacttttaatagcaagagtgtcttcctgaaatccagcaactccctgtataaaaatcgtgttgcatgttggatggaacttgtatcttgtcttggcaaaaataattgcattgctggtctgttaaaaaaaaaaaaaaaaaaaaa

SEQ ID NO: 10845 - protein, 85 aa, Zea mays
  misc_feature: Ceres CLONE 1341560
MDQPGPVAENISPSDACQDISQNVPPERADAITPLASSNHHSPTTPDDPFSLEMHEANASDLLDMSYCDGLIIDSRRDPRDGSLM

SEQ ID NO: 10846 - DNA, 1044 bp, Zea mays
  misc_feature: Ceres CLONE 1341563-F
  misc_feature (22)..(22): n is a, c, t, g, unknown, or other
  misc_feature (42)..(42): n is a, c, t, g, unknown, or other
  misc_feature (44)..(44): n is a, c, t, g, unknown, or other
  misc_feature (45)..(45): n is a, c, t, g, unknown, or other
  misc_feature (1044)..(1044): n is a, c, t, g, unknown, or other
tttttccccccctccgccgttncccacactctcccctccttntnnttcaaactggcactccccgcggtggcggccgctctataactagtggatcccccgggctgcaggcccccccccccccccccaaccaaggcgcgtcaccaagttcaccagcaattggagcagcctccagcgtccacggatttgttaggtctccccttcttacaagggttcttcgtcgtgtcctctacccctcccctccccgcctatgtatgtgctgtgaaatcgttgatgttctcgtcgggtgaacaaaggccagtagttagcttgcctgcttcataaatcgagccggattgtaatgggcctcttaaatttggcgccccctgttttggaatatagttgtatccgtgccttccctgcttgcaaattttcttctgctctggtaaaacaaaaaaaaaaaaaaactcaaggggggggcccggtacccaattcccccctataggggtccgtatcacaatttacctgggccggcgtgtttacacggtcgggaactgagaaaaacccctggcggttatcccaactttaatgcgcgcttggaggaaacatcccccctttccccaaggtgggcggaactaccaaaacaggtcctggaaccggatcgccccttctctcaacagctgtgccaacccttgaattggcaccacggggaaaattggacaagcgggttaaaatatttcgggactaacactcccggggtttactagttttatgccaaaaatcgcgcgtccctttctttcaaccccaatcaagcctcgaaatttgcggcacatactcccctttattacacccgcacaagaacaataccccccaaaaacagggttgagaggggtccttctccgtttttggcaccaagaaagccctcctattctacgaaaggctggcacttccatcccacaaagggcatacaacacccgctttatcagcggtgggtgggcccatctcccggaaccactcctccctaattaggtttttgcgggcgtgtaggcggcttctaagcacgagatn

SEQ ID NO: 10847 - DNA, 754 bp, Zea mays
  misc_feature: Ceres CLONE 1341568-F
  misc_feature: Encodes the peptide sequence at SEQ ID NO. 10848
  misc_feature (754)..(754): n is a, c, t, g, unknown, or other
ggagctccccgcggtggcggccgctctagaactagtggatcccccgggctgcaggccccccccccccacagctcgccctcgccgtcagagaagggcaagctcggcgtcgagtggaatcaggcttatctgctaccaatggcgcgacttgcagaatgcttccctggtagggaacggctgggctgtcaattcgcctggaagtggggaagctttatgctactgtgtgtgaaggtggtagtgcatgcgcgcccagtctcctagatgtagcgagccaaatatgtgctgaactgtagtcaatggatgtaaagggtccggctcttctgatacagccaaccccaaccaaacacacggctccccgccctgacgagcagtttggctcaaaaaattagaaacggcgagaagcattgtatatttttaaagggtcaatgtttttaaaatttatatataagtttcaatctcttaaaaaaaaaaaaaaaaaaaaaaaactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcaaattgtaagcggttatattttgttaaaaatcgcgttaaatttttggtaaatcagctcan

SEQ ID NO: 10848 - protein, 40 aa, Zea mays
  misc_feature: Ceres CLONE 1341568-F
MARLAECFPGRERLGCQFAWKWGSFMLLCVKVVVHARPVS

SEQ ID NO: 10849 - DNA, 777 bp, Zea mays
  misc_feature: Ceres CLONE 1341598-F2
  misc_feature: Pfam Name: AOX Pfam Description: Alternative oxidase
  misc_feature: SWISSPROT Homolog: EC 3.2.1.23 Beta-galactosidase
  misc_feature (737)..(737): n is a, c, t, g, unknown, or other
caccgcggtggcggccgctctagaactagtggatcccccgggctgcaggcccccccccccccccgtgccgccctagttggtggggtagcggcatttgcgaagatcggtggggcgatgaaagccgcaggcggtgtcaagattggtgcagccgctgcagccgtgacggctgcagcatcagctgccatatcgggaaaagacgcaaaagaagacacttcaaagccggaaacgaaatgatatgacccatggattggtcgacaagtatgaaattgcctctccagaggtttagaagagagagggtgccatagtcaataagttacaggagtaaaatttcatgcttcatgtgtttttttatctcgggaataagaatgacaatacagttttccccagaagtatgattttgtgttgtgcaacagtttcggctgttgaatgcttttagtcactgtctgaatggctttttctgctgtgccaaaaaaaaaaaaaaaaaaaaactcgagggggggccccggtacccaattcgccctatagtgagtcgtattacaattcactggccgtcgttttacaacgtcgtgactgggaaaaccctggcgttaccccacttaatcgccttgcagcacatccccctttcgccagctggcgtaatagcgaaagaggccgcaccgatcgcccttcccacagttgcgcagcctgaatgccgaaatggcaattggaagccgttatattttggttaaaatccccgntaaattttttgtaaaacacgctcattttttaaccaatagg

SEQ ID NO: 10850 - DNA, 777 bp, Zea mays; identical to SEQ ID NO: 10849
  misc_feature: Ceres CLONE 1341598-F
  misc_feature: Encodes the peptide sequence at SEQ ID NO. 10851
  misc_feature (737)..(737): n is a, c, t, g, unknown, or other

SEQ ID NO: 10851 - protein, 77 aa, Zea mays
  misc_feature: Ceres CLONE 1341598-F
HRGGGRSRTSGSPGLQAPPPPRAALVGGVAAFAKIGGAMKAAGGVKIGAAAAAVTAAASAAISGKDAKEDTSKPETK

SEQ ID NO: 10852 - DNA, 819 bp, Zea mays
  misc_feature: Ceres CLONE 1341662-F
  misc_feature: Encodes the peptide sequence at SEQ ID NO. 10853
  misc_feature (545)..(545): n is a, c, t, g, unknown, or other
cgcggtggcggccgctctagaactagtggatcccccgggctgcaggccccccccccccccccgatccccaacaggcaacagcccagccgctgtcgccctcgttccgtagtacggcgccgccagatcgtcagtcaccatgatcatctccaagaagaaccgccgcgagatctgcaaatacctcttccatgagggggtcttgtacgccaagaaggactacaacctggccaagcaccccaagcttgatgtgcccaacttggaggtgattaagctcatgcagagcttcaagtcgaaggagtatgtgagggaaaccttctcatggcagtactactactggtacctcaccaacgatggcattgagcacctccgcagcttcctcaacctgccatcagaggttgtgcctaataccctcaagaagtcttccaagcccccgtctcgccccttcggctctggcccacctggtgaccgccccagggccctcctcggttatgaagggacaggggctaggtttgggggatagggatggttacagaggaggtccacgtggngctccaggtgactttggtggtggataagggtggtgctcctgcaaatttcaaccatcttttaggggtagcagacctggctttggcccggggggcggggtgcctttcgggctgtggatcttccagggagggtggggcacatgagctacataaattcgttctttaatatgaaaacatgagatttgtttgtttaacgagcggtgccggggttaactggtttgggaccctttttgtaaagaaatatggatccagcgcgagtttcctcaaaaaaaaaaaa

SEQ ID NO: 10853 - protein, 126 aa, Zea mays
  misc_feature: Ceres CLONE 1341662-F
  misc_feature (3)..(98): Pfam Name: S10_plectin Pfam Description: Plectin/S10 domain
MIISKKNRREICKYLFHEGVLYAKKDYNLAKHPKLDVPNLEVIKLMQSFKSKEYVRETFSWQYYYWYLTNDGIEHLRSFLNLPSEVVPNTLKKSSKPPSRPFGSGPPGDRPRALLGYEGTGARFGG

SEQ ID NO: 10854 - DNA, 830 bp, Zea mays
  misc_feature: Ceres CLONE 1341666-F
  misc_feature: Translation starting site: 169
  misc_feature: Pfam Name: AAA Pfam Description: ATPase family associated with various cellular activities (AAA)
  misc_feature: SWISSPROT Homolog: EC 3.6.4.3 Microtubule-severing ATPase
  misc_feature (431)..(431): n is a, c, t, g, unknown, or other
tggagctccccgcggtggcggccgctctagaactagtggatcccccgggctgcaggccccccccccccgtacgttaaagacggacagaagaacctcaagcgcgaactcctccgtgcgcaggaggaggtcaagcggatccagtccgtaccgctcgtcatcggccagtttatggagatggtcgacggcaacaacggcatcgtgggttctactacgggcagcaactactatgtgcggatcctcagcaccatcaaccgcgagctgctcaagccgtcagcatctgtcgcgttgcatcgtcactccaacgctttagtcgacgtgctgccgcccgaggccgactccagcatctccttgctgggatcgtcggagaagcccaacgtcacctacaacgatattggaggatgcgacatccaaaagcaagaaatacgggaggncggttgagttacccttgactcatcatgagttgtacaagcagattggtattgatcctccaagaggggtgcttctgtatggtcctccgggtactggcaagaccatgcttgccaaagcagtcgcacatcattaccaccgctgtttttatcagagttgttgttacccgagttcgtttattattactcggccgccccccctcccatgctgttatgaagccctccatatgtcttatccctgcccgtcccatatcattatttattttttcactccccccttatactaccgttcaacaatcgcagtcacccacgcctcacccctatatcctaccttttgatccttccatccccacccccccaccaccgccgctttttatgtctcttttcctcctgtactccccactt

SEQ ID NO: 10855 - DNA, 766 bp, Zea mays
  misc_feature: Ceres CLONE 1341668-F
  misc_feature: Encodes the peptide sequence at SEQ ID NO. 10856
tggagctccccgcggtggcggccgctctagaactagtggatcccccgggctgcaggattcggcaccagagtccccccccccccccctgaaattgaggacaattcaaggaaaataggggcattgttttcaaaactaaatagtgatgacatatctccaaacgtttcatcaaaactcaggcagttgtgcagtgcaattgatgctagcgattttgccactgcgatgcacctccaggtactcttgacaacaagtgactgggacgagtgcaacttctggctcgcggcattgaagcggatgatcaagacaaggcagaatttcagaatgtaaaccttgtggcctttttctgcagccagttctgtacacacctttttctgctgcttgccagaaatgatagctgtagcagttcagagagtttgcctgcacaggggtcttatcatgctgctttgttctcggctcttgattctgcctaagcgctttggtaccctcagtgctgttatacattttgataaaaagttttttttgtttcgacatctgctataaggtgacctgcggcctggggttgttcgttatgaatgctaatttgaagaggacctttaatctgttatagctgggggatcccccggtttcaattccccctcctaaaattcccgcaggttggacattccagaaattctaaaaggttaaaacaatggaccgcggctttgttcacaaaaaaaaaaaaaaaaaaacccgaggcggggcccgcgcacccaattcccaccaaaaaggg

SEQ ID NO: 10856 - protein, 34 aa, Zea mays
  misc_feature: Ceres CLONE 1341668-F
MHLQVLLTTSDWDECNFWLAALKRMIKTRQNFRM

SEQ ID NO: 10857 - DNA, 831 bp, Zea mays
  misc_feature: Ceres CLONE 1341675-F
  misc_feature: Encodes the peptide sequence at SEQ ID NO. 10858
ggagctccccgcggtggcggccgctctataactagtggatcccccgggctgcagggtccccccccccccccccccccgacgctagcgagcgagagagacgcacatctatctgtcaagcgacgccgcggcctcgatcagagtcggaggcgaacacccccatggcggcggctggcggcggcgcaggagggaaggtatccttcaagatcatcctcacctccgaccccaagctccctttcaaagtgttcagcgtgcccgaggcggcgccctttaccgcggtgctcaagtacgccgcggaggagttcaaggtcccgccccagaccagcgccatcatcaccaacgatggaattggcatcaacccccagcaaagtgcaggcaacgtgtttctgaaacatggttcggagctgcgtctcatccctcgcgatagggttggagctgtagtcatgtcttccggttagaggatatatacagtccaatgcataatgagcaaaacttgagagaaataaagctttgatgttggccttgcttggctgcaggatgttgttacaaggataataagcgaaccttaccgtacatgtctcaagttgtatgctctctgtttgcaagcggagagattctcgaagtgaaccccggatcctgaattcactccactatacacaatctatatatcccccccctttattttttcttcttcgacttttgcgcgggggcttcgatccttctttccccccccccttccccgctcgggccgcccgatacaacttttttcttctcaggttcccactctccaccctcgcgtcgccctttatctttcgcgcactctacacccccctt

SEQ ID NO: 10858 - protein, 98 aa, Zea mays
  misc_feature: Ceres CLONE 1341675-F
  misc_feature (10)..(85): Pfam Name: UPF0185 Pfam Description: Uncharacterised protein family (UPF0185)
MAAAGGGAGGKVSFKIILTSDPKLPFKVFSVPEAAPFTAVLKYAAEEFKVPPQTSAIITNDGIGINPQQSAGNVFLKHGSELRLIPRDRVGAVVMSSG

SEQ ID NO: 10859 - DNA, 804 bp, Zea mays
  misc_feature: Ceres CLONE 1341685-F
  misc_feature: SWISSPROT Homolog: EC 1.1.1.1 Alcohol dehydrogenase
tggagctccccgcggtggcggccgctctagaactagtggatcccccgggctgcaggcccccccccccccccccgtcccgttcgccgagatcaacaaggcgttcgacctgatggccaagggggagggcatccgctgcatcatccgcatggagaactagatttcgctgtctagtttgcgatctggtctgggcttggggttaataaaagaggcaatgctagcctgccctttctatgaggaggtacatacacgctggcgatggaccgcgcttgtgtgtcgcgatcagtttggcttttgccaagcagtagggtagcttcccgtgtcggtaattatatggtatgacccatccccttttggctctacttggtatgaacagtagatccagattccaactaccagaaaaaacaaaaagaaacaactcggaggcggtgaccggaaacccaactcgacctatagagagcggaattacgattctctgggccgatgttttactacgtgcgcgaatgggcatacccatggtgtttagccaacttattcgccttgcagcactatccccttttccccagctggggtaatagacgaaaaagccctgcaccggatcgcccttccaaacagttggcgaaccctgaatgagaaagtggaaagttccaagggttaaaatttttgtaaaatttcccgctcaatttttggtttaaaccgcctccttttttaaccaataagggcgcaacccgggaaaaccccttaatcacccaaaaaaatcacccgggaaaggccctcaccttttcttcctttttttccaccaaatct

SEQ ID NO: 10860 - DNA, 842 bp, Zea mays
  misc_feature: Ceres CLONE 1341686-F
  misc_feature: Encodes the peptide sequence at SEQ ID NO. 10861
  misc_feature (766)..(766): n is a, c, t, g, unknown, or other
tggagctccccgcggtggcggccgctctagaactagtggatcccccgggctgcagggagagagagagagctcactagtcccccccccccccccccccggcaggaccggtcactcggaacgcaggctagcagcacagcaggagccagagccatcccctctcctcgctacgcttcgcttcctcggcgccgattcctcctcctcctcctccaccctcgtccgtccccttccggagcacgagctcgcccgagatggagaacgcgagatcgggtgtcgctgtgaacgatgagtgcatgctgaaggttggcgagctgcagtcgaagaggctgcaccgcttcataagtttcaagatggacgacaagttcaaggagatagttgtggaccaggtcggggatcgcgctaccagctacgatgacttcgcaaacagcctccctgagaatgactgccgatacgcgatctatgatttcgactttgttactgcagaggatgtccagaagagcaggatcttctatatcctatggtccccatcctccgccaaggtgaagagcaagatgctttacgcaagctcaaaccagaaattcaagagtggcctcaatggcattcaggttgaactccaggccacagatgcgagtgaatcagcctcgatgagatcaaggatcgggcacgctaggcgcacgccatcgcgagtttcatgatcacgcatcatggatcgccacctaactggggattttatgcattatagacttggggctgcgaagactgccttggnggatttgggggttggtgctgtgtaaaagatcgcatgggttcagaagacctggaaggttggatctatcaggaattcc

SEQ ID NO: 10861 - protein, 147 aa, Zea mays
  misc_feature: Ceres CLONE 1341686-F
  misc_feature (12)..(137): Pfam Name: Cofilin_ADF Pfam Description: Cofilin/tropomyosin-type actin-binding protein
MENARSGVAVNDECMLKVGELQSKRLHRFISFKMDDKFKEIVVDQVGDRATSYDDFANSLPENDCRYAIYDFDFVTAEDVQKSRIFYILWSPSSAKVKSKMLYASSNQKFKSGLNGIQVELQATDASESASMRSRIGHARRTPSRVS

SEQ ID NO: 10862 - DNA, 799 bp, Zea mays
  misc_feature: Ceres CLONE 1341703-F
  misc_feature: Encodes the peptide sequence at SEQ ID NO. 10863
  misc_feature (724)..(724): n is a, c, t, g, unknown, or other
ccccgcggtggcggccgctctagaactagtggatcccccgggctgcagggagagagctcactagtcccccccccccccccttcgctcgtggttgcgccatccctcactctcctccgaagccatcgtccccgtcccagcctccccggactccaggggcaaaagctgcagcgtcgagatggtgaaggggcgcacggggcagcgcgtgaggctctacgtccggggcaccgtccttggatacaagcggtccaagtcgaaccagtacgagactacgtcgctggtgcagatcgagggggtgaacaccaaggaggacgtcgcgtggtactgcgggaagcggatggcctacatctacaaggccaagaccaagagcagcggcacccactaccgctgcatctgggggcaaggtcgcccgcccgcatggcaacttccggcgtcgtccgcgcccaagttcaggtccaacctgccgccggaatccatgggccgtaaggttcagggtgttcatgtaccccagcagcatctaaagataatctggatggtgtggagggacccttttcttctagattttatcttcagctggcccttgaaaggggttgtgttcagggttgagagttaccagggggaacttgtttatcctggaaaccttttaaagttctctgaagttttgggggtatggggtccctggaagttttattgggaagtttaggttaaaacttaaaaaacacccccnataatacgggatacaatataaatctatccctccggggggggcgcccggtacccccttttccccaatgggggggcg

SEQ ID NO: 10863 - protein, 174 aa, Zea mays
  misc_feature: Ceres CLONE 1341703-F
  misc_feature (12)..(107): Pfam Name: Ribosomal_L35Ae Pfam Description: Ribosomal protein L35Ae
MVKGRTGQRVRLYVRGTVLGYKRSKSNQYETTSLVQIEGVNTKEDVAWYCGKRMAYIYKAKTKSSGTHYRCIWGQGRPPAWQLPASSAPKFRSNLPPESMGRKVQGVHVPQQHLKIIWMVWRDPFLLDFIFSWPLKGVVFRVESYQGELVYPGNLLKFSEVLGVWGPWKFYWEV

SEQ ID NO: 10864 - DNA, 1117 bp, Zea mays
  misc_feature: Ceres CLONE 1341713-F
cctccccccttttccccctttttttccccccaccccctcccttcgccctcctccccactgaaactccccgcggtggtggccgctctagaactagtggatcccccgggctgcagtccccccaacactgcgtgaaggaatagcattaggtatgatggtgtcattctcggaattggtgaagtttacaatggaagcaagcatagacgacagcatgtaatggttcgaggaccacgccacgacagtctccctttctggaggcaaatggattcagtgcgtaatctatatagagcgccctgaccgatctgatttagataaaatctcgacccgccgcccgccattctgctgagatcccccccgctgatttccaagctaccgcagaccccgccttttttatccccccccgctgtattgctctatgaacaaacatggacccttattctttcgttcccccccccacctcggctgtattctcccccgtaaagctcgaattattgattccattcccatatgagcacaatatatggccaacggtcgcggcgtcattttttaccacccccttttccccccccccccatggtatttagggcctacgcaatctgccaacccttcagccccaatctgaacttctttgtgtctgtctcatgaaccacgtgagaaagggctcgcccaccccttatattgcttccaccctcttctgtggctcgcacaccacatcacccccccaggtgcctgtcctataatattttcgatcatccccgcgcttcgtattctacacctcacggttccttccctcactccttaatatcgttagtgaaatgcgcgccccccccgctccttatatattctcccacccccgcttttgtccctccccacccccgcgattttataacacgcgcctccgcatatatcgcgtctaactttatacattagtttaattcattcattttctcatctacgatgtttgataaaagatgacgatacgactatcgctccctccttcttttgtataccactgccacacctctctctacgaccaccctagagatgtttagtttgtttatcacggcagtccgtgtactttgccgcgaatccaactgtagtcgtgccagccaccgcgcgg

SEQ ID NO: 10865 - DNA, 824 bp, Zea mays
  misc_feature: Ceres CLONE 1341732-F
  misc_feature: SWISSPROT Homolog: EC 3.2.1.23 Beta-galactosidase
  misc_feature (824)..(824): n is a, c, t, g, unknown, or other
tccccgcggtggcggccgctctataactagtggatcccccgggctgcagggctcactagtccccccccccccccgaaccaggccatctacctcctcaccactggtgccagggagagtgctttccggaacatcaaaaccattgccgagtgccttgcagatgagctgatcaacgctgccaagggctcatccaacagttacgccatcaagaagaaggacgagattgagcgtgttgccaaggccaaccgttgaacggagcttgtatcctggtgcactctgcgctggaaacttttatgttgctggcagtcgtatcggttcctgttttaccaatgtttagagttttttgagacctatatgcggttttggttttcagtgcacaattaaaattactgagtaatgtagttgattgggaacagaaagtgcctggtttaccgaactccatttctcttgtcatttttctttattctgtagtctgtattatgtatgcgtatgagtattgagatgattctgcatttgaattgtctgctttgttgctgtcgccgtttgtgtaccaatggtaacagggtaattttagtaaaaaaaaaaaaaaaaaaaactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcaaattgtaagcgttaatatn

SEQ ID NO: 10866 - DNA, 875 bp, Zea mays
  misc_feature: Ceres CLONE 1341767-F
  misc_feature: Pfam Name: Enolase_C Pfam Description: Enolase, C-terminal TIM barrel domain
  misc_feature: SWISSPROT Homolog: EC 4.2.1.11 Phosphopyruvate hydratase
  misc_feature (546)..(546): n is a, c, t, g, unknown, or other
  misc_feature (627)..(627): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (685)..(685): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (767)..(767): n is a, c, t, g, unknown, or other
tggagctccccgcggtggcggccgctctagaactagtggatcccccgggctgcagggagagagagagagagagagctcactagtccccccccaccccccccaagcgggcagttaatgagtacacttgcaacgctcttgttctcaaggcaaatcaagtgggcactgtcactgaggccatagaggttgtgaagcaggcaaaggatgctcattggggtgtgatggtgtcacataggtcgggagacactgaagattctttcattgctgacctggctgttggtgcttcagccggacagatcaaagccggtgccccctgccgtggagagtgtctcactaattacaatcagctgcttagaatcgagggagaacttggaagtgaaggcgtctatgcaggggagaattggagaacagtcaacacgagctgatctgtggtatcgtttgagttgcggggagaattggaaatattgatccgccttcgtatgtagccacttagcttttctttgttttcttgtcaaattgccgtgagttcgtcctcggcaagtatatggnaaaatagggtggtgaaatgtaccattttttactagatgatgggcaattgttgttgaacatacatatagtgatgcactgggngtggggtttacatcnnnnnnnnnnnnnnnnnnnnnnnnnnnnnnnngaannnnnnnanaaaaaaaaactccgaggtagactggcgccgccacctttaccgagcaaacctcccgcgctcttttggtttgcgtgtcnnnaancccgaggcgttcgccacttgcccaccgaaaaatctttgaaagcagccgggggaacctcggggaactccccccggccttgggatctccttttttttaacgggggggggg

SEQ ID NO: 10867 - DNA, 853 bp, Zea mays
  misc_feature: Ceres CLONE 1341791-F
  misc_feature: Encodes the peptide sequence at SEQ ID NO. 10868
ggagctccccgcggtggcggccgctctagaactagtggatcccccgggctgcagggagagagagagctcactagtccccccccccccccccccgcgtctcgtctcgttgcggcggtggcctcctcctcctccctctcctcagcgtcccccctcgctcgcctaatctctcgccgcggccttgccggtgccgcagacggccatgggtctgcgaaggtgcccttgtggaaagatccgttgagcccgagcaagtggaaggaagagcactttgttctagcaagcctctcaatgtggggggttattttttatggcggttaccagctttttagtggaaagaaggaagccgagactgaggcgggatcaccacaggcataggtggcggagatggagttctacccatatctgtggcctgggaacaatgttaaataaaaggaatgctttatggtgagctttcaagctgataaattgtggcaacaggagattttgctttacgtaagccatatattgagaagctactcttactcatccaccatgaataatctttgctgcagtggagcttcatgtcggcgaacaatgcaaacgctgcacttctttcatgcgattgaggtggctgatgcttatagttctgatgccaccgacaggtggacgctgaacttgcagattgataagatctccgtgcttccgttcaaagtttgcggtgtcactgatgactttagcacacttttaattgcagggttcagttgataatcggaggataggggctgcaccgtgatctttgccagccaaaggagctcaaaagttcatggcgcgaccgagccccttccgggggggggggggccattacaatctacggccg

SEQ ID NO: 10868 - protein, 123 aa, Zea mays
  misc_feature: Ceres CLONE 1341791-F
GAPRGGGRSRTSGSPGLQGERELTSPPPPPPASRLVAAVASSSSLSSASPLARLISRRGLAGAADGHGSAKVPLWKDPLSPSKWKEEHFVLASLSMWGVIFYGGYQLFSGKKEAETEAGSPQA

SEQ ID NO: 10869 - DNA, 858 bp, Zea mays
  misc_feature: Ceres CLONE 1341798-F
  misc_feature: Encodes the peptide sequence at SEQ ID NO. 10870
  misc_feature (813)..(813): n is a, c, t, g, unknown, or other
aagctggagctccccgcggtggcggccgctctagaactagtggatcccccgggctgcaggaattcggcacgagagatagagagagagagagctcactagtcccccccccccccccatgattcatattcacttgctcgcacagatgctcaggtatggcgaccgataattgctaccccaaaacatggacgatcatgaaataaagccggacattttgtaatttcgcctcgaaagcacaacttccagtctcacaatctgtgacacaaaaacttctggagaccgctgtagcttcatatcgcctacagaaagaaaatccgcttctcaagcccttccatcatattaaatgtacaaattgccagactcatatagcaaaacgtactgacttggctgaagatgtctactaactgttctcttggtgcctatgtcttccctcacgttggcggccacgacacgattgctgtatgaaatgcaactgggctagcactccttggcgatccttctaacagtccacagctgatatcctggatactcgtggacgaatgcaaactgcatggcctgcaaatcccacatagggtggctattcagagccaccaagaaaactctgtggcctaggtctttctgggggatccgcagctcacgaatcgcacacgacccacaaggatatccccgtgactgatgctccaaactaccatgcgtataagggcatattagcagacggactactaagccatgtatgacctggtgtttccaatcctacagtacggtctggctcatacgcactgactgcctcttgtgtgttgatagtacattgacggngcagttccctgtaacacaatcactcaatttctactgaagcaccag

SEQ ID NO: 10870 - protein, 41 aa, Zea mays
  misc_feature: Ceres CLONE 1341798-F
MACKSHIGWLFRATKKTLWPRSFWGIRSSRIAHDPQGYPRD

SEQ ID NO: 10871 - DNA, 874 bp, Zea mays
  misc_feature: Ceres CLONE 1341831-F
  misc_feature: Encodes the peptide sequence at SEQ ID NO. 10872
  misc_feature (719)..(719): n is a, c, t, g, unknown, or other
  misc_feature (803)..(803): n is a, c, t, g, unknown, or other
  misc_feature (863)..(863): n is a, c, t, g, unknown, or other
cgcggtggcggccgctctagaactagtggatcccccgggctgcaggccccccgcctgttcttcccagacgaggagagcgagggagcgagacgagatccattcccaacttcagctgcgcctcgactcgtagcccgaaccctagccaccaagccggaggcgagagagcagccatggcgcggtgcctcgcgctcgtcgccctcctcgtactcggcctcgccgccgccgcctccgcggccgacgcgcccttcgtcgtcgcgcacaagaaaatttcgctctcccgccccaagccgggcgtcgagcgcgtcgctgtctccctcgacctctacaaccagggatccgcgactgcctatgatgtgtccattaatgacgactcttggccaacagaagtgtttgagcttgtcactggagagaaatcgaagacattggaaaggcttgaccctggtgccactgcttcacacacatatgtcctggagaccaaaacacagggcaggttccagggttcaccagctatcattacataccgtgttcccacaaagacagctcttcaggaggcatactcaactcccatcttcccactggatattctcgctgagagacctccagagaagaagtttgaatgggctaagaggcttgtgatgaaatacgggtcacttgtgtctgttgtctcttttggtggactgtttatctaccttgtcgcgagcccgtcgaagagcagctcnaaggcagcaagaagagacgctgatctacttataggtcgcagttgacggggtagctggtggttttgcctggaggaaactctggtnagttgagcctgtgcgaaagcttttaggttacatttactcaccactccatgaacggcacgnagtatcatcag

SEQ ID NO: 10872 - protein, 197 aa, Zea mays
  misc_feature: Ceres CLONE 1341831-F
  misc_feature (8)..(184): Pfam Name: TRAP_beta Pfam Description: Translocon-associated protein beta (TRAPB)
MARCLALVALLVLGLAAAASAADAPFVVAHKKISLSRPKPGVERVAVSLDLYNQGSATAYDVSINDDSWPTEVFELVTGEKSKTLERLDPGATASHTYVLETKTQGRFQGSPAIITYRVPTKTALQEAYSTPIFPLDILAERPPEKKFEWAKRLVMKYGSLVSVVSFGGLFIYLVASPSKSSSKAARRDADLLIGRS

SEQ ID NO: 10873 - DNA, 781 bp, Zea mays
  misc_feature: Ceres CLONE 1341854-F
  misc_feature: Encodes the peptide sequence at SEQ ID NO. 10874
  misc_feature (545)..(545): n is a, c, t, g, unknown, or other
ggcggccgctctagaatagtggatcccccgggctgcaggccccccccccccccccgaggacctggggacgttcgataatgactaccaggctctccgttgtctattcgactcaggaatatatgaattatgtctctatgaggactatagaagtactttgttgtacttgtctcgggctcacatgtgctgcccttatccagtgatctgccgtgaatcgctcctgttatctaggaatgtgaggctgctcggctacatggtatgcatatcattgctcgatgtgctcagacgtgatgatcaccctgctctgctaccttactattggctctctctatcgtgttgtcatacatctcgagcatctgttaacgaagctgtcgaacttcaggcccctcccatgacccaattccgccctatacacacgcgtctatttgtatgatgatattcctcatgccttttctgctccggaaacttgctgtcgtcttgagaattaattgacttgcttcctgctccatatactgctgctgagcctaaatgatttgacgtcccactcnctcctacttcccatatatagatatatgtgaagtggcgctagatccagtgaaagtctttatgattctcgttgaactctcgtgcgcatttttgataatcgcactacattatttccctctaggccgaaatgccagtatgtcccttctaaaccgagatcatatgccctgcctccggatcggaagattcttctttgttacgaaacagagtcactaataactcgaggtgggagtcggcgacc

SEQ ID NO: 10874 - protein, 40 aa, Zea mays
  misc_feature: Ceres CLONE 1341854-F
MTTRLSVVYSTQEYMNYVSMRTIEVLCCTCLGLTCAALIQ

SEQ ID NO: 10875 - DNA, 871 bp, Zea mays
  misc_feature: Ceres CLONE 1341893-F
  misc_feature: Encodes the peptide sequence at SEQ ID NO. 10876
  misc_feature (676)..(676): n is a, c, t, g, unknown, or other
  misc_feature (775)..(775): n is a, c, t, g, unknown, or other
  misc_feature (787)..(787): n is a, c, t, g, unknown, or other
  misc_feature (862)..(862): n is a, c, t, g, unknown, or other
  misc_feature (867)..(867): n is a, c, t, g, unknown, or other
cgcggtggcggccgctctagaactagtggatcccccgggctgcaggaattcggcacgtggatcagttcgtcctccgtctctctccacaagtctcctctaggcgccaagcaatgacaaggtcagcaccgccggcctctcctccggcgccgaagcccgtgctgcgcgggagccagctggagcagctccgcgagatcttccggcgcttcgacatggacggcgacggcagcctgacgcagctggagctgggggcgctgctgcggtcgctgggcctgcgccccacgggggaggaggcccgcgcgctgctggcggccatggactccaacggcaacggcgcggtggagttcggcgagctggcggccgccatcgcgccgctgctcaccacgcagacgcacctcgtcgaccaggcccagctcctggaggtgttccgcgccttcgaccgcgacggcaacggctacatctccgccgccgagctggcgcgctccatggcgcgcatcggccagccgctcaccttcgaggagctcacgcgcatgatgcgcgacgccgacgccgacggtgacggcgtcatcagcttcaacgagttcgccgccgtcatggccaagtccgcgctcgacttcctcggcgtcgcctgatgccctctgatggaccgatcgatcgattggtctcgctccccgcccgncgtcgtaaccccgtgtccatgtccctcgcccgccgttgattacctgttctctctctctggtttttttttggtaggaagatgctcatccggttaatgtangataactgacgncatataatgtaactccaactcatcggtgggttggtacatggatgaactcggaaatgtgtacatattttggatggnattgntcat

SEQ ID NO: 10876 - protein, 172 aa, Zea mays
  misc_feature: Ceres CLONE 1341893-F
  misc_feature (136)..(164): Pfam Name: efhand Pfam Description: EF hand
  misc_feature (100)..(128): Pfam Name: efhand Pfam Description: EF hand
  misc_feature (24)..(52): Pfam Name: efhand Pfam Description: EF hand
  misc_feature: SWISSPROT Homolog: EC 2.7.11.1 Non-specific serine/threonine protein kinase
MTRSAPPASPPAPKPVLRGSQLEQLREIFRRFDMDGDGSLTQLELGALLRSLGLRPTGEEARALLAAMDSNGNGAVEFGELAAAIAPLLTTQTHLVDQAQLLEVFRAFDRDGNGYISAAELARSMARIGQPLTFEELTRMMRDADADGDGVISFNEFAAVMAKSALDFLGVA

SEQ ID NO: 10877 - DNA, 888 bp, Zea mays
  misc_feature: Ceres CLONE 1341900-F
  misc_feature: SWISSPROT Homolog: EC 3.2.1.23 Beta-galactosidase
  misc_feature (814)..(814): n is a, c, t, g, unknown, or other
gcggtggcggccgctctataactagtggatcccccgggctgcaggcccccccgggaggcggcgccgcgcgctaccgcaacatcagagagagacgtctctgtggctgtataggtagagtagcctgtactgtttaccacccctcttccttccatcctatttccacctagtatagaggtcaaacctcttctccgtgtagtgacggaaccttttcttaatttccatctttttactgttctgaatcaagtgattagaaagaacaaaaaaaaaaaaaaaaaaaaaaaaaactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgancgggaaagccggcgaacgtggcgagaaaggaagggaagaaagcgaaggagcgggcgctagggcgctgggcagtg

SEQ ID NO: 10878 - DNA, 911 bp, Zea mays
  misc_feature: Ceres CLONE 1341906-F
  misc_feature: Translation starting site: 156
  misc_feature: Pfam Name: TRAPP_Bet3 Pfam Description: Transport protein particle (TRAPP) component, Bet3
  misc_feature: SWISSPROT Homolog: EC 3.2.1.23 Beta-galactosidase
  misc_feature (735)..(735): n is a, c, t, g, unknown, or other
  misc_feature (805)..(805): n is a, c, t, g, unknown, or other
  misc_feature (849)..(849): n is a, c, t, g, unknown, or other
  misc_feature (856)..(856): n is a, c, t, g, unknown, or other
  misc_feature (878)..(878): n is a, c, t, g, unknown, or other
  misc_feature (897)..(897): n is a, c, t, g, unknown, or other
  misc_feature (901)..(901): n is a, c, t, g, unknown, or other
cgcggtggcggccgctctagaactagtggatcccccgggctgcaggctcccccccccccccccgattggttgatgagttcttagcaaagtcaaatgtatcaaggtgtgttgacttcaaggagactgccgatgttattgcgaagcttggcttcaaaatgttcttgggcgtgactgcaaccgtgaccaattgggatgctgagggtacaagttgcagccttgtcctggaagacaaccctcttgttgatttcgttgagctccctgacacttgccaaggccttcagtattgcaatttgttaagtggagttattaggggggcattggaaatggtgtctatgaaggcggaggtgacatgggtgcgtgacatgcttcgcggggacgatgcctatgagatgcgggtgaagcttatcaagcaagtcccggaggaatacccctacaaggatgatgactagttctattttagtgcaagattgcttgtttggattttgacatcgttttcgtcgatggtccgtagttctgctataacctgatatcataggaggaaagctgcgtctgttttgcttgtgtattgtagaaatcatacataatctttcctgagttgcggctttgaattagcctgctggattcgctatgcaaattggtgttatctagaattaaagtattttcgatcttatcggtttgccctcatttcatgtaaaaaaaaaaaaaaaaaactcgagggggggcccggtacccaanttcgcctatagtgagtcgtattacaattcactgggccgtcgtttacaacgtcgtgactgggaaaaccctnggcgtaccccacttaatcgccttgcagcacatcccccttttcgncagctgncggtaatagcgaagaggcccgnaccgatcgccctttcccancagntgcgcagcct

SEQ ID NO: 10879 - DNA, 873 bp, Zea mays
  misc_feature: Ceres CLONE 1341927-F
  misc_feature: Encodes the peptide sequence at SEQ ID NO. 10880
  misc_feature (1)..(1): n is a, c, t, g, unknown, or other
  misc_feature (630)..(630): n is a, c, t, g, unknown, or other
  misc_feature (780)..(780): n is a, c, t, g, unknown, or other
nggcggccgctctagaactagtggatcccccgggctgcaggcccccccccccccccccattccttcactgccagtcttgcatcccgtccccgtccgcgccggccgacgccgccttttcgtccccgcgtcagcgtcgcggctccactgagcgtgcgtgtcaccggcgggaggcaagggcaggcggtggtggcgatggcgtccgctgacgcgcgcttggcggggatcgcctcctccatccgcgtcatccccgacttccccaagccagggatcatgttccaggacatcacgacgttgctgctcgatcccaaggcgttccgtgacaccatcgacctctttgtcgagcggtacaaggaccaagggatcaccgtggttgctggtgttgaagctagagggttcatttttggtcctcctatcgctttagccattggcgcaaaatttgtgcctttgaggaagccgaagaagttgccaggcgaggtgatctccgaagagtattctttggaatatggaactgacaagatagaaatgcatgtcggagctgtacaggccaacgaccgggctcttgtagtcgatgatcttattgctaccggtggaacctaatgtgcagctgtcaaccttaattgaacggttggnagcaaaggtttgttgaagtgtgcttgtgtcattgaatgcccacgaactgaaggccgagacaggcttgtgggaaaggggccagttttttgtccttgtggaagcagacgcttgagcggaactggacttttcccacaaagatttggccgcccncgatgctcaattcccaggggtaccatgtgggctaatttctgtgagcgccgcaaataagtttttttccaaatggggatcccctgaatgtttggc

SEQ ID NO: 10880 - protein, 134 aa, Zea mays
  misc_feature: Ceres CLONE 1341927-F
  misc_feature (30)..(135): Pfam Name: Pribosyltran Pfam Description: Phosphoribosyl transferase domain
  misc_feature: SWISSPROT Homolog: EC 2.4.2.7 Adenine phosphoribosyltransferase
MASADARLAGIASSIRVIPDFPKPGIMFQDITTLLLDPKAFRDTIDLFVERYKDQGITVVAGVEARGFIFGPPIALAIGAKFVPLRKPKKLPGEVISEEYSLEYGTDKIEMHVGAVQANDRALVVDDLIATGGT

SEQ ID NO: 10881 - DNA, 872 bp, Zea mays
  misc_feature: Ceres CLONE 1341941-F
  misc_feature: Encodes the peptide sequence at SEQ ID NO. 10882
  misc_feature (605)..(605): n is a, c, t, g, unknown, or other
  misc_feature (606)..(606): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (784)..(784): n is a, c, t, g, unknown, or other
ggcggccgctctagaactagtggatcccccgggctgcaggaattcggcacgaggagctcactagtccccccccccccccacaccgcaatcttcaatctccccagcaatccctagcagaagccttccatcctcactcgctcgatggcccgcacgaagcagacggcgaggaagtccaccggcggcaaggcgccgaggaagcagctggcgactaaggcggcccgcaagtctgcccctgcgaccggcggagtgaagaagccccaccgcttccgccccggcaccgtcgcgctccgggagatccgcaagtaccagaagagcacggagctgctgatccgcaagctgccgttccagcgcctggtgcgggagatcgcgcaggacttcaagaccgacctacgcttccagagctctgctgtctccgcgctgcaggaggcggctgaggcctaccttgtcgggctcttcgaggacaccaacctctgcgccatccacgccaagcgcgtcaccatcatgcccaaggacatccagcttgcccgccgcatccgcggggagagggcctaagcgtcatattttctgtcatcagtgcccgatcagaagatgtaaggatatgctgnngttctgtagtttgggttactgtcgaatcatcgagtgttggctgttcactgctgtaacttaattatcatgatgcatatgaaatggcaatgacctctgttatcagttcctcgaattttcccgttgnnnnnnnnnnnnnnnnnnnnnnnnnnnnaaannnnnnnannnnnngaaaaaaaanaaaaaaactcgagggggggccggtacccattcgccctaaaggggcgataacatttccctgccggccgttttacacgtcggactgggga

SEQ ID NO: 10882 - protein, 136 aa, Zea mays
  misc_feature: Ceres CLONE 1341941-F
  misc_feature (58)..(132): Pfam Name: Histone Pfam Description: Core histone H2A/H2B/H3/H4
MARTKQTARKSTGGKAPRKQLATKAARKSAPATGGVKKPHRFRPGTVALREIRKYQKSTELLIRKLPFQRLVREIAQDFKTDLRFQSSAVSALQEAAEAYLVGLFEDTNLCAIHAKRVTIMPKDIQLARRIRGERA

SEQ ID NO: 10883 - DNA, 779 bp, Zea mays
  misc_feature: Ceres CLONE 1341949-R
  misc_feature: Encodes the peptide sequence at SEQ ID NO. 10884
  misc_feature (12)..(12): n is a, c, t, g, unknown, or other
  misc_feature (34)..(34): n is a, c, t, g, unknown, or other
  misc_feature (277)..(277): n is a, c, t, g, unknown, or other
aaaaaaaaaatnttttttttatatacaaaagaanacaaaaatccgtgggcttccccaaatgggtccgggccccccctcgaggcgccctttccgtttgcctcgtgccgccgtcggcctatggccggcggcaccgaggacacctcgctggcgcttttggtctcggatgtggctcacgctgaaggccggagacgcgttggcgtcacgcgcccaagaatcggtccgcccgaacgaacgacgtccagcccggcacgacgcctccgcgcggtaaggtcctggncgtcttgggccctgtctgcgaggacgtgctacctggttgatcctgccagtagtcatatgcttgtctcaaagattaagccatgcatgtgcaagtatgaacttaattcgaaacttgaaaacctggcgcaaatgggctccattttaaaatccaggtttaataaggtttgggttttgatgggagcgtgccacctccggaaaaaccggtaataaatttctcagaggcttaaatacgtggcaaaaaaaaccccccgaaatttcccggggaaagggggcccccccgttggttttgtaagataaaagggggttaaacgcggggggtttctgcccccccccaaatcccaaaggatatccctgggaaaacctttgagccgggatattcaccagggccctttctttggggggcggtaaaaacccattttttcaaaattttttggcgccctcaaagagaaattttttcagaggggaggggaaaatggggggcgcccccccctgcgggggggtga

SEQ ID NO: 10884 - protein, 160 aa, Zea mays
  misc_feature: Ceres CLONE 1341949-R
  misc_feature (4)..(4): Xaa is any aa, unknown, or other
  misc_feature (12)..(12): Xaa is any aa, unknown, or other
  misc_feature (93)..(93): Xaa is any aa, unknown, or other
KKKXFFLYTKEXKNPWASPNGSGPPLEAPFPFASCRRRPMAGGTEDTSLALLVSDVAHAEGRRRVGVTRPRIGPPERTTSSPARRLRAVRSWXSWALSARTCYLVDPASSHMLVSKIKPCMCKYELNSKLENLAQMGSILKSRFNKVWVLMGACHLRKNR

SEQ ID NO: 10885 - DNA, 808 bp, Zea mays
  misc_feature: Ceres CLONE 1342010-F
  misc_feature: Encodes the peptide sequence at SEQ ID NO. 10886
ggatcccccgggctgcaggaattcggcacgaggttgtcatcgttcgttccacccagctggcaggccagccggtagtccgcgagccacagttccggccttatttcctccgagtacttggtgatggtagtcggggctcagaaccgggtcgggaacggcgcctgtcgtatggcccggatgaaagcttggggaccgggtggttcgggcgaggggctccgatcctccccgctgtcgtagcgtcccccacgcctggggtggtagccccggcgcaccttctcgtcgacgtgggctcgacggtcgcggtggtggtgctcgttgtcgaggcgactccgggctgcaggcgttgcgtcccgcgagcgcccgttgtggaccgatgcttcccggatgtgtcgagaggtcgcgtggagatgctccgattttgtaaccttgcgcgctagatttttgtcttaccagctctttttttagccaatactccgagatcgcttgaatcccttatagatcacaagaatacaccgagataggggtgagtgttgttccagtttggaacatgagtccactattaaagaacgtggactccaacgacaaagggcgaaaaaccgtctatcggggcgatggcccattacgtgaacatcaccttaatccagtttttggtttccaggggtcgttttagattatttctttaccctcgcgggagcccccgattttaaccttgcaggctctatccccccaccttgccgcacatattttgtttttatttctacacagtcgcccccttcgtccctttcccattttccatcccccttaccctccc

SEQ ID NO: 10886 - protein, 37 aa, Zea mays
  misc_feature: Ceres CLONE 1342010-F
MVVGAQNRVGNGACRMARMKAWGPGGSGEGLRSSPLS

SEQ ID NO: 10887 - DNA, 832 bp, Zea mays
  misc_feature: Ceres CLONE 1342023-F
  misc_feature: Pfam Name: Isoamylase_N Pfam Description: Isoamylase N-terminal domain
  misc_feature (564)..(564): n is a, c, t, g, unknown, or other
cgggctggcatacttcagatacacgtgacatatgccgcctctgggccctggtgagtcataacgatgatcgtggacattggcgctacacacactacagtctacccgctccgaatgctgaccctgatgagcgaagctgacctgctgaacgtcttaatgagcgccgagtttacatctcatacccatatctgcctatagtgacacagattaatgttctgtgcgcgtcggtctacctccttttctatgagagaatcctgccgctagccgactaactcaccttggaatacttcccccttctcaccagatgtttgtattagagaagactgccgcacctatcgcccttcccaactgctgcgcagactgaatgactaatggcaaattgtaagcgttaacatcttctgctatcactcgcgttacagttttgttaaatcagctcattttttaaacaataggccgaaatcggcaaaatcccttataaatcacaagaatagaccgagcatagggttgagtcgttgttccagttttggaacaagagtccactattaaagaacgtggactccaacgtcnaagggcgaaaaaccgtctatcagggcgatggcccactacgtgaaccatcaccctaatccagttttttggggtcgaggagccgctcaagcctaaatccgtaccctaaacggaacccccgatttaatcttgaatgttaaaaacatctaaccggccctgcaacgtcctccattactccttggctcgaccgttatgtcactgctactatttgttcttctctccctctttatccttcgtcctcttcctaacaaccctctcctcacctaccttc

SEQ ID NO: 10888 - DNA, 780 bp, Zea mays
  misc_feature: Ceres CLONE 1342024-F
  misc_feature: Translation starting site: 396
agtggatcccccgggctgcaggaattcggcacgagctcttgcagtgcgcggaccggaaacccattcctgcctatagcgaaccaaacgaccactgcattgcgcgcaaggtccagcagcgcacatgacactgctagtccagactgccactcgcatagcctagttaagcattccaccctagcaatatgaccaacaaaggtagaagcccccgccgcacaacataaacttgcgatccacaaaacgaacgctactcgtatgaccgtacgatggcaccagattaacaataaccccaggacttcatgtttttgccacgaagtttgaggcggcaattaggacctctcgccgtggatcctccttgccaagtgaatgccctttgacatgatggtcacacgcttagcatggatggcgcacaggtaggagtcctcaaacaggccaacgaggtatgcctcagcagcctcctggagggcaagcaccgcatggctctggaacgcaaatcagttttgaagtcctgtgcaatttccctgacgagcctctggaagggcagcttcctgatcagcagctcagtgctcttctgatacttgcggatctcacggagggcaacagttccagggcggtagcggtgaggcttcttcctccaccagtggtgggggcagacttacggccagccttggtggcaagctgcttcctgggagccttccctcccggggacttgcgagcagtctggtttgaacgagccatttcccccgcctctttcggaccctccgcagctttaaaatcggggcg

SEQ ID NO: 10889 - DNA, 1045 bp, Zea mays
  misc_feature: Ceres CLONE 1342024-R
tcccctctccaagggcacaaatactagccggagcataaaatgtaagcctggggtgcctaatgagtgagctaactccattaattgcgttgcgctcactgcccgctttccagtcgggaaacctgtcgtgccagctgcattaatgaatctgccaacgcgcggggagaggccgtttgcgtattgggcgctcttccgcttcctcgctcactgactcgcctgcgcccggtcgtttcggctgcggcgagcggtatcaactccttcaaaggggggaataccggttatccaccagaaacaagggacaacgcaaaaaaaaacatgtgaccaaaaaggccagtaaaacgcccctaacccccaaaaaaggcccccaattgacaggggtttttgtagggggttctggctatcccccccccccccccccccaaaatgccccccccagggcccccaggctctccccacccccggaacggtggttttgacgactccctttggggtttcccctcctataaaaaattcccctcctgctgtctccgcctccgtacccacacctccccgctcccccttaactggtagtagatcaatccgctatcttctcgcccccccgtcccggaatagttttaggacccttccactcggcgaacaatgcatggacccaaccgtccccttccgcagaattaattaggggcgtccgctccgcaatagcccacctctggcgtcgtattgttgttgtggtatcaaacgactcttgccttcttttccgccaacccacttttagcttccccttacaactcgctcactcatgacttccctcttttttcacgttatgaatcgctgtgtgtaaatgcaccgtgttattttcccgacttaatagttcgcgtgcgtactatacgctattccaaccggcttatgtgttccataccacccacactgtatcatgtcgcgtcacatctacataagcccgtctacgacgaataagtgctaacctcggcgcgtatcttattctcacctctaccatcactagtatcctcacatatcccttgtccactgacgg

SEQ ID NO: 10890 - DNA, 848 bp, Zea mays
  misc_feature: Ceres CLONE 1344079-F
  misc_feature: Encodes the peptide sequence at SEQ ID NO. 10891
  misc_feature (468)..(468): n is a, c, t, g, unknown, or other
acccgcggtggcggccgctctagaactagtggatcccccgggctgcaggaattcggcacgaggctgtagagcagatgtacaatgagatggcttctcgccaccgcgtgaggtccccctgcatccagatcatcaagaccgccacagtacacttcaagctgtgcaagagggacaacaccaagcagtttcacaacagtgagatcaagttcccactcgtgtaccgcaaggtcaggccgccgaccaggaagctgaagaccacgttcaaggcttcgaggcccaacctgttcatgtgatttagctgtggtcagtgtatgtgatcgtaagaatctgtgttttaagttttgacgctaagacttgggtggtttgaagattcaactcgttttgaaacgtgcatggtgaaccatttgccgactgccggcttgttcgtactcggcacacttaatgttgatctatatggagtgggtgatttanaaaaaacccacaaccaaatcccacaaaataaaccgcttgcacaaaacatctaacataggaaaaatacctcccaaaaacctccagggggggcccggtacccaattcgccctatagtgagtcgaattacaattcactggccgtcgttttacaacgccgggactgggaaaaccctggcgttaccccatttaatccgcttggaagacattccccctttcgccagggggggaaataacaaaaaggcccgaaccgatcgcccttcccaaaatttggcgcaccttgaatggcgaatggccaattgaaaggcgttaatattttggttaaaattcccggtcaaattttttggtaaatcccccttcttttttttaaccaataagggccgc

SEQ ID NO: 10891 - protein, 71 aa, Zea mays
  misc_feature: Ceres CLONE 1344079-F
  misc_feature (1)..(71): Pfam Name: Ribosomal_L18ae Pfam Description: Ribosomal L18ae protein family
MYNEMASRHRVRSPCIQIIKTATVHFKLCKRDNTKQFHNSEIKFPLVYRKVRPPTRKLKTTFKASRPNLFM

SEQ ID NO: 10892 - DNA, 884 bp, Zea mays
  misc_feature: Ceres CLONE 1344131-F
  misc_feature: Encodes the peptide sequence at SEQ ID NO. 10893
ggagctccccgcggtggcggccgctctatactagtggatcccccgggctgcaggaattcgctacgacacacagagagacaaagacagctcactattcccccccccccctcaaggccgccaataaccggctgaaggtgcagtagttcgcgtcctccgacggtgaggacaacagccagatctacgcgatcatggtgaagatcaaccgttcctgtgacgacgtggatttcctgctgttcctgcccgaccacaattcggatgccaccaaagagctgttccgccgggagggcagtcacgaacttgcctcacttcatcttctactagggcctcgacaatgtgcacgatgaggaggccctcggtcccgagctcgtcgcgcacaacgtactctactatcgatgacagtcactcagcggtggtgcagctgcactcgcgtcatgactgggaggcgctcatcgactagcaccgtcaccacaacggcaagctcgtcgtgctggacgtgtacctctatcactgcgggccctgggcctaggagtaccccaccgtgatgaagctggcgcgctccatggtcgacaacaccgtcttcgcgcgcatgtacggagacgagatacgacagctgtgtgcgactcctcacggccatgaggatcgtagaggcgtgcactttcgtattcatcacggcacggcagatcttcgcctgtctactcgtctccgaataggcaagagtcctcagcgatatctcctatacaaagtgtcaggctcgctgctgaatgcaatatgaaaacaaacattctgatcataccagctcatcctatagaacgcttctttttaactgagacgtacacatttagaccctgcgaccccatcacgaatgtcaatggtagactgttatt

SEQ ID NO: 10893 - protein, 76 aa, Zea mays
  misc_feature: Ceres CLONE 1344131-F
MKLARSMVDNTVFARMYGDEIRQLCATPHGHEDRRGVHFRIHHGTADLRLSTRLRIGKSPQRYLLYKVSGSLLNAI

SEQ ID NO: 10894 - DNA, 905 bp, Zea mays
  misc_feature: Ceres CLONE 1344136-F
  misc_feature (712)..(712): n is a, c, t, g, unknown, or other
  misc_feature (747)..(747): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
  misc_feature (824)..(824): n is a, c, t, g, unknown, or other
  misc_feature (829)..(829): n is a, c, t, g, unknown, or other
  misc_feature (831)..(831): n is a, c, t, g, unknown, or other
  misc_feature (833)..(833): n is a, c, t, g, unknown, or other
  misc_feature (834)..(834): n is a, c, t, g, unknown, or other
  misc_feature (835)..(835): n is a, c, t, g, unknown, or other
  misc_feature (836)..(836): n is a, c, t, g, unknown, or other
  misc_feature (837)..(837): n is a, c, t, g, unknown, or other
  misc_feature (853)..(853): n is a, c, t, g, unknown, or other
  misc_feature (854)..(854): n is a, c, t, g, unknown, or other
  misc_feature (855)..(855): n is a, c, t, g, unknown, or other
  misc_feature (856)..(856): n is a, c, t, g, unknown, or other
  misc_feature (857)..(857): n is a, c, t, g, unknown, or other
  misc_feature (858)..(858): n is a, c, t, g, unknown, or other
  misc_feature (859)..(859): n is a, c, t, g, unknown, or other
  misc_feature (860)..(860): n is a, c, t, g, unknown, or other
  misc_feature (861)..(861): n is a, c, t, g, unknown, or other
  misc_feature (862)..(862): n is a, c, t, g, unknown, or other
  misc_feature (863)..(863): n is a, c, t, g, unknown, or other
  misc_feature (866)..(866): n is a, c, t, g, unknown, or other
  misc_feature (871)..(871): n is a, c, t, g, unknown, or other
  misc_feature (873)..(873): n is a, c, t, g, unknown, or other
  misc_feature (874)..(874): n is a, c, t, g, unknown, or other
  misc_feature (875)..(875): n is a, c, t, g, unknown, or other
  misc_feature (876)..(876): n is a, c, t, g, unknown, or other
  misc_feature (877)..(877): n is a, c, t, g, unknown, or other
tccccgcggtggcggccgctctagaactagtggatcccccgggctgcaggaattcggcacgagacatctctcggtatgccgggtgtaggaaacgggtgacgcctaagaggggggggtgaattaggacttctaaaacttttactaaactaggccacaattaaatccctagagcaaaacctatgcaaataatcaaaactacaatgtgcaaactaggttttgtctaagtgttgctatctctaccgcaaaaggctaagtttcaatctacactaaataagtatgactacaagattgaaacttaaatgcttaatataaatgcggaatgtaaagagctaagtagagaagcaaactctcgtggatgagcctatgatcgacgtgagttcgagtcagttctacggtgaaggatacgatgacagtgataagagaattcctgacatgactataatcaacaagcagctaggttggaacccaaagacacctctcaaggatctgctggagacaacattgacgtaccagcacaagacatacaaagaagctgtgaagaggcaaatgtcgcaggcttcagcaacaagttaagttggcgctggctggagacggctcctcgtttagagccctagtcgcagcagctggttcgcaagtcagaatacatatacgccgggtatcgttctggttgaggccctagacgcgcccatgttttgtctgctacaagggatgntatccctatgtgatatactactacctgtgtttggntgctcctagttttttttctgccatatattgattatattggaaaactatatatattaaattcctttaaaaccccnnnnaaaananannnnnaaaaaaaaaaaaaaannnnnnnnnnnaanggganannnnnaaaaaaacccgggggggccccggaacaa

SEQ ID NO: 10895 - DNA, 887 bp, Zea mays
  misc_feature: Ceres CLONE 1344143-F
  misc_feature: Pfam Name: EFG_C Pfam Description: Elongation factor G C-terminus
  misc_feature (387)..(387): n is a, c, t, g, unknown, or other
  misc_feature (415)..(415): n is a, c, t, g, unknown, or other
  misc_feature (674)..(674): n is a, c, t, g, unknown, or other
  misc_feature (737)..(737): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (766)..(766): n is a, c, t, g, unknown, or other
tggagctccccgcggtggcggccgctctagaactagtggatcccccgggctgcaggaattcggcacgaggagagagagagctcactagtcccccccccccccttcccactgccaggagggtcatctatgcctctcagctcacggccaagccaaggctgctggagccagtctacctggtggagatccaggccccagaaatgcacttggtggtatctacggtgttctgaacagaaagagagtcatgtctttgagagatgcagagccgggtaccccgctctacacatcaagctttctccctgcatcgagtcctttggtttctccagcaactgagggcgcaactctggtcaggcgttccccagtgtgtctttgaccatgggacatgatggnctcagatcctttggaaggccgctcccangctgctcagctggtgctggatatccgcaggaggaagggtctcaaggaacaaatgacccctctttctgaggttgaggacaagctctaaaattttgggctggtggggatacttgttcatctgccggtttaatcatcaattcgtctactggaatagcaccgactccattattttatttttgtttaagtggccaaaggcacctgtttttgaacaaatatttgggatggaggcgccctgccccccttaaaggctgaaacaattnaattatccggctgggaaggttccaaaggaaacaagatttgatgtctggtttattaaaaaaaanaacaaaaaaaaaaaannnnnaaaaaaatnttctctcggggggggcccggaacccatttcccccaaaagggggtcaaataaatttcctgggcccggttttaaaacgcggggaggtgaaaaaccgtggggtacccaaattaatcccctggac

SEQ ID NO: 10896 - DNA, 1008 bp, Zea mays
  misc_feature: Ceres CLONE 1344146-F
  misc_feature: Encodes the peptide sequence at SEQ ID NO. 10897
  misc_feature (872)..(872): n is a, c, t, g, unknown, or other
  misc_feature (1008)..(1008): n is a, c, t, g, unknown, or other
aagctggagctccccgcggtggcggccgctctagaactagtggatcccccgggctgcaggaattcgacaaccagtactacatcaacctgctctctggcgacggtctgctgccgtcagaccaggcactggcgtcgtcggctgccgtgcctggggtagaggcggacgtcgcaggctcctcgccactacgccttcgacgcctccgtattcttcaggacttcgcggatccatgctgcggatggggaggttgcaccgggcgtcggcaccagggcgaggtccgccggaactgccgggtggggaacagtccgataaggcatgcaggttccgctcaactatctggtcgcccgggcgggttgcattgctgattttgtaccagttaagccaagccagaaatttggttgggttaaaaaataaatcggctttggggatgggaaatattgaaaaagggcccttcgtttaaaatagctactaaggaggggggctttggatggacaaaaggggactatctaccgcttacggttcctctgcgtgttccccaaaaaaaatttttttttagaccccttgtagacgcgggggacaacaaaagtaaactatttctcctccggggggggggcgccccgggccacccatttcccccccctttaggggggggggttattcacaagttgccggggggggcccggctttattataagcgcgcgggggtgggggaaaaccccctggtgggttacccccccaatttataagcgtgtgggggagacggtgcccctcctctcttgtgcgggtgggggtgggatgaaaagaaaaaaggagcgcccgcctacgacacgctcctttcctcataaaaggtggctcgacgtactagaagggggggngagcgaataaatatctctgccgtcgcgttttctatgttgtgtgttatagagtgggcgccctggtatattatctgggcagcgaaacgcgcctctcctttttgtttcagacacaagaggcgtgcagactcggcgtgan

SEQ ID NO: 10897 - protein, 119 aa, Zea mays
  misc_feature: Ceres CLONE 1344146-F
  misc_feature: SWISSPROT Homolog: EC 1.11.1.7 Peroxidase
AGAPRGGGRSRTSGSPGLQEFDNQYYINLLSGDGLLPSDQALASSAAVPGVEADVAGSSPLRLRRLRILQDFADPCCGWGGCTGRRHQGEVRRNCRVGNSPIRHAGSAQLSGRPGGLHC

SEQ ID NO: 10898 - DNA, 760 bp, Zea mays
  misc_feature: Ceres CLONE 1344215-F
  misc_feature: Pfam Name: Chal_sti_synt_C Pfam Description: Chalcone and stilbene synthases, C-terminal domain
  misc_feature: SWISSPROT Homolog: EC 3.2.1.23 Beta-galactosidase
  misc_feature: SWISSPROT Homolog: EC 2.3.1.119 Icosanoyl-CoA synthase
ggagctccccgcggtggcggccgctctagaactagtggatcccccgggctgcaggaattcggccaagggccgcgtccgccgcggcgaccgcgtctggcagctcgccttcgggtcgggcttcaagtgcaacagcgcggtgtggcgcgccgtccgccgcgtgcgccgccccgcgcgcagcccctggctggactgcatcgaccagtacccggcgcgcatggacgcctagcacgtacctgcaatgcagtggctgctatctatctatcgctcgcttcgctagctaccagtgcagtgctgcacttcaccgatggatggatcggatatttgatatggtataggacgcggtcggtcgatttgcatgcatgcaccaagtgttactataccgttctgaaggtacgtttgaactttgttcgtttgtattgcactattgcttgttgtttaagtagcggttaagggagggaagtactactccggtcctgtcctgtgtgagccttatgtacgtgcaattttaatgtgttttgatattacaagacttgacggttggcaaaaaaaaaaaaaaaaaactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgccctttcccacagttgcgcagcctga

SEQ ID NO: 10899 - DNA, 835 bp, Zea mays
  misc_feature: Ceres CLONE 1344241-F
  misc_feature: SWISSPROT Homolog: EC 3.2.1.23 Beta-galactosidase
tccccgcggtggcggccgctctagaactagtggatcccccgggctgcaggaattcggcacgaggagagagagctcactagtccccccccccccccccccgctccgcgctgggggacgtggccagggactgcgcctgcggaacgttcagcatcatcaacagcctgccggccaagtgcggcctcccgccagtcaactgccagtaatgagctgatgatggccagtgcgatgcactgggcaaaaggcaagggatccaaacacgctgaataataaaagggcaccggggtcgagtcgactcggtgtcctcattccgtcattcggaatgaatgctaaagcaaactcttgagggtcgcgtgcccttttgcgatcttgtacgcacacgaccggcctgtggctgtgcaatgtgcaacatcgctttgattcaaagaaccaacaataatacagaacccactctgcacagcagggctcactgaaacgtccgtaaaagggacaaaaaccggctataaagatgatggcgcactaaaacgaaacatcactctcgagggggggcccggtacccaattccccctatagagaggcgtattacaattcagtggccgtccttttacaacctcgagactggaaaaaccctggcgttacccaacttaatcggcttgaagcacatccccctttcgccaggtggcgtgataagtgaaaaggcccggaccgatcgcccttcccaacagttgggcaacctgaatggcgaatgggaaattgtaagcgttaatattttgttaaaatccgcggtaaatttttggttaatcagcctcttttttaaccaaaaggcggaaatcggcaa

SEQ ID NO: 10900 - DNA, 821 bp, Zea mays
  misc_feature: Ceres CLONE 1344264-F
  misc_feature: Encodes the peptide sequence at SEQ ID NO. 10901
  misc_feature (683)..(683): n is a, c, t, g, unknown, or other
  misc_feature (684)..(684): n is a, c, t, g, unknown, or other
aagctggagctccccgcggtggcggccgctctagaactagtggatcccccgggctgcaggctcactagtgccccccccccccccccccgccaagttgggaggggtcaacttcaacaagaacaagtgcaccaagggtatgcagaacgtgaaggccaacctggttgtgatcttctgccaggtcacctacgataatctgctctcgcacgtgcccatctacgagcaggtcaccccatccatcctatctgaacgcctgaggcgtaatggatccttggcacggaaggccatactagatctgatggctgatgggctcataaggatgcgatatctgttcattctcatcagcatcatataccccagggtaaccatatcatgagaagcgtctggcctattgcggactctatctagtctacaagaattcgagtggctattatatctgatgcatttgaaacgggcatcgatacaccgtacggacgcgtcgaacgtccaatatctctgagattaatgtacgatttgaagaccaggtttgttcagaactctttggggccgccaagaggggccatgcgctctgggttgtgcccgcgacccaattccgcctatagtgacgcggattacgatactcatggcgacctattgcgacgaactgactgagatacacctgtacgtacccataattaccgacctgnnagagatccccctttcatcaggctgcgtaaaaagaaggaggctagcactgatgcccttgcataaggtgggcaccctgaatggcaatggaaaattgtaacggttaattttggggagatccgggtccaattttgccaaac
